United States Patent 9,073,990 (PROTEASE-ACTIVATABLE PORE-FORMING POLYPEPTIDES) - sequence listing, part 5

SEQ ID NO: 12537 - protein, 735 aa, Helicobacter pylori
MLGLATQISAQQIPADTTQMDSIRLDEVLVAAVRATRESPVTFSNLNSERIETRNLGQDIPILMNYLPSVVTTSDAGAGVGYTGIRVRGSDATRVNVTINGIPYNDSESHGTFWVNMPDFASSTENLQLQRGVGTSTNGAGAFGASLNVLTEAVSEDAYASLAGSAGSFNTHKATLKFSSGLLKEHFEVSGRLSRIRSDGYIDRASSDLDSYFLQGAYLDENTLVKALLFGGHEITYQSWYGFDPATLGAIGVDNDLESNRTFNIAGIQFDDSGNFEGFYENQVDNYKQDHFQLHWNERWTRAFQTNIALHYTRGRGFFEEYVDEWYYTNILFAPDASYAFLGLDNPVIDGEEQTTTDYIRRRWLDNDFLGTVFSAIHNSGPLELTLGGGWNTYRGDHFGELIWARYSGSLERGDRYYNDDSRKDDFNVFAKANFTAGDHWRFFADMQYRSVAYEANGADTGLVDDTFGFFNPKLGLTYQFRPGSSLYFSYAVANREPNRNDYEGGNPRPERLHDLELGWRSLGEQLTLNANLYYMRYKDQLVLTGQLNDVGAPLRANVGDSYRTGLEIDADLRISPRLRWQPNIALSINRNVDYFFRRDGELTSLGDTEIAYSPGVVAGSRLVWSPAEDLQLGVLTKYVGDQYMSNIEAEGSRLEAYSQTDLNVQYRIPASGGFPEITLTGLVNNLFDAKFSSNGYFYTYDDDFSNPGVVTTIEGAGYYPQAGIHFLAGARVRF

SEQ ID NO: 12538 - protein, 314 aa, Helicobacter pylori
MLKFKYGLIYIALILGLQATDYDNLEEENQQLDEKINHLKQQLTEKGVSPKEMDKDKFEEEYINRSYPKISSKKKEKLLKSFSIADDKSGVFLGGGYAYGELNLSYQGEMLDRYGANAPSAFKNNININAPVSMISAKFGYQKYFVSYFGTRFYGDLLLGGGALKEDAIKQPVGSFIYVLGAVNTDLLFDMPLDFKTKKHFLGVYAGFGIGLMLYQDRPNQNGRNLVVGGYSSPNFLWKSLIEVDYTFNVGVSLTLYRKHRLEIGTKLPISYLRMGVEEGAIYQNKEDDERLLVSANNQFKRSSFLLVNYAFIF

SEQ ID NO: 12539 - protein, 186 aa, Gluconacetobacter diazotrophicus
MLAAVVFMMVSTSNGVAHAQVGSEPAPFAGAAQAVDYLLGPGDKVRVTVYGEESLSGEFFVAGTGLMSLPLIGEIKVGGMTVGQFQTAVQDKLKDGYLRDPRVSAEVLTFRPFYILGEVEKPGTYPYTSGLTVLNAVATAGGFTYRADKKIVYIKRNGDASEIKGELKPSTLVSPGDTIRIGERFF

SEQ ID NO: 12540 - protein, 340 aa, Gluconacetobacter diazotrophicus
MIVFSFLLVAAGVSYSAPTIEAGTGADSTKAGIGNEASGDNSSAFGFENTASGKNSSAIGNKNEASGFESSVLGGKYKVTGSHSGAFGDPNVVTGNGSYAFGNDNTINGNNNFVLGNNVTIGSGIQNSVALGNGSVVSFSNEVSVGSKGKERKITNVADGEVSATSTDAVNGRQLYNAMQNSNDNFKSEIYKKIDTVGSLSAALAGLHPMQYDSKTPAQVMAALGHYKNKHSVAVGASYYFNDRFMMSTGIALSGEKRPKTMANIGFTLKLGKGSGVTYNETPQYVVQNEVKRLTLENQELKSKINNQDDRIKAQDNKINEQDEKIKNLEEKLNKLLKTK

SEQ ID NO: 12541 - protein, 781 aa, Gluconacetobacter diazotrophicus
MTHHPRKPGLRSRLLAMSCLAGVVCSVALSGAETRAATTTTTPPKRHATSSTAATSAAHAPAAPAAHAATAAHPVTPRAAAPRTTVARAASPEDISVVSSRQALNGGGGMMRLETAPHTVQTVAKEYIDMRAPTSTALDLIKNLPSLSVSTPDTGGMQGGMIEVRGLTDLDMGLMVDGAPAAAAKYMAEDIDSENLEEVNVTPGSSGIDLPVMSAAGGVMNEQSHIASHKAGGLMDFSYGTNNLSREFLRLESGDIGNSGVRAYVSFSNTHDRAWMGAGINERHHLDFGVQKDWANGSTAKVFVSWNNENFTIDNYPTAQEFYTFKHTGQGWGRSANPSDDNYWKNNKDHWNQVFLTAPLHIVLPARFSFDLQPYFSFGQGWDASPGGVVDGVNQTSFFLQNATRQVGAVTKLGYQIDPHNAFSLGYWYENNYTDQSYPSGATNADGTPPSPWYLYKTTSPYGQNAGYELHSLFLQDTAKYLHDKLVIHAGFKFVMANTWTADPYNRYSTNTTEPLPQLSIGYTFNEHHQIYVNAEGDYRQPSAVDMGWLPTAPNAFPKNQYSIKEELGYRYHDKYVIVDLALFNYNVTNRIVNQYIGYNSFKPISIGNQTMRGFDLMVSGRSIHGFSPYASIEYLNARQDSNVMDLNEAVPTLIHSKGTQAVMAPHVMANFGLTYTYKGFFANGSVHYTGAQSVSVAGDQRMPGYVTNTLSLGYHFKPFMFAKSPTFRLNFTNLTGSIVRTGPMGVVYRATDQNANTTGTGNSFMVEPRFTMTGTVSTAF

SEQ ID NO: 12542 - protein, 190 aa, Gluconacetobacter diazotrophicus
MAPTGERLRGAYKASVFSGRIEAGWRVETALAGVTPYAAAQAISYRLPSYLEQGNGAIDSFALGYVARNVSAPRSELGLRLDRTTVMADALLTWRGRAAWARNFNTARDVAATFQSLPGTGFLVSGAAMAPDAALVPPEPKSTGATASRLPRTSRASSPTTYPATPARERCDTRGEKLRAGVSPRFESWP

SEQ ID NO: 12543 - protein, 721 aa, Gluconacetobacter diazotrophicus
MSRFPAAPSPAEAALCGCIVAFCAHAAPARAGDPVVTLPSLSIEATDLPSLADSPLSASSPGASDRAAAQLGSPDAVALFHDTPGFSAYSAGGISSLPVLNGMADDRVATVVDGVRISAGCPNHMNPAMSYIDPDSVQTATAIAGITPVSLGGDSTAGTVDVERRDPQFARKGQVLVTGHVTGNYRSNGGGSEASGTVTLADDTFSLRYTASYAHAGDYHAGGDGGVVRSTDYLTFNHAVTLGMHKGNHLLALTAGQQDTPYEGFPNQYMDMTNNRSTYVNGKYDGSFDWGDLEVRGYWQRVDHVMDMLGDKGGHSPTTGMPMNTDSRMAGYTLKATIPLGPRDTLRLGSSFDHDGLNDWWPPLQGSMMMGPGTFHNVNNGHRDRLGHYAEWEARWTPRLSTLLGFRNDLVMMNTGPVSPYSWTGMMAAADATAARAFNAMDRGRTDVNFDVTALTRWQALDSLTIEGGYARKTRSPNLYERYAWGRGAMATKMIGWFGDGNGYVGNPNLTPEIANTASITIDWHDPHGQAWDLKIQPYYTYTHHYVNVVRLAQYSNGTSLLEFVNHDAQSYGINASGSYRLWNTVRYGQGDLVGTVDWVRGQDLVTRSGLYHQMPANGMVGVHETVGNWTGRVEMTFVKSKDTVDRLRNEPRTPGYALLGLGGSYRWRYLALNAGIDNVMNQKYYLPLGGLSLGDYDATGVLGPLKGMGRSFNVSLTGSF

SEQ ID NO: 12544 - protein, 583 aa, Gluconacetobacter diazotrophicus
MPKHLNIFLAILGLSQLVQAQDEEKDDIGTETVTVTKAYTPTISDAFKIKSIPNLNDSIVLQKKKIEYNIFSVPVASTFTPAKGKASAVKKMPPPELYNSYASAGAGNPSNAMAKFYTSRAINRDERLDLGFNHNSSRATIDGVDLESKYSNTEVDASYSKRDRDMSWGANVDLQHQLYNWYGLPAGVFDLTTIGGIDERQNYFMGELGANINVEDAYFKDAKIKYRRFWDAVESGENRAIFGTGLEFPVGDESFGININMDYVGGSFANANVNSISNAGEIKYSNFQVGLNPTLSMLRDDLTLNLGVNIVYGLDMENSESNFYVYPAVTASYRLLDDTVIAYGGIEGELKQNSYHGFVEDNPFISPTLDIQPTDSQYDAYIGLKGQLLPNLSYNIKGSYTAENRSPLFKLNPQNSFRNDEKGYYFGNSFEVFYDDIKTLGLFGELNIDVNRNFTLGINAEVYEYDTETNNPAWNLPNLKGSLFMDYQINEQWYMGVNLFYIGEREDFSTIVVQNPPPTGIDATRIILDSYFDANAHVGYRVNDQLSIFVKAANIANNNYQKWANYPVQGFQILGGATYKFDF

SEQ ID NO: 12545 - protein, 343 aa, Gluconacetobacter diazotrophicus
MKKTIRSISSPQQYQQLQQTPATVYNQDGTKVDVNGSVRLILKKEKDERGDLVDNGSRVSFKASHDLGEGLSALAYAELRFSTKEKVEVKDTNQQVVRKYEVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTAAAKQEKEKAFMVGTELSYAGLALGVDYAQSKVTNVEGKKRALEVGLNYDLNDKAKVYTDLIWAKYGPKGATTRDRSIILGAGYKLHKQVETFVEGGWGREKDANGVTTKDNVVGVGLRVHF

SEQ ID NO: 12546 - protein, 452 aa, Gluconacetobacter diazotrophicus
MMRSFCFGLLRAMACLSLVASSLNAVRAEPREDRSELSPDVERLEVIAQPWLHDWLWLPEWIRLSFNYTNEIDANPSGGNQQTGTYTHNVAINSAFSSGFGKEASEWQEIDHWTLNITASQRSGTSLSQKIPNELAVQQIYGYGQTFRLAGLWLERNQAEDGLLKMKFGKFATFDDFASSPLYCFYTNNGFCGQNWGIPNSLPVMAYPANQYGFVFYLGEEDGPHVRSGTYQINPDGAEPAFHGADFQIRDSDGLAQFVQFNVPLGSGKPQAARRLEDGSVVLVPEDELEVYYVSGLPQPGLQLGGWIGNWQFPLVNGNGKTSESNEGVYGLVSVPWDFGGLVLDGRLWANATYGLTQSVQDVPNTYAGGWVGKGLFRNRPHDAVVIGLANVNWSRDIPDGPIWESVLELGYQFMLGSNVSIQPGVQYIFNPMGKGDVDDPLLLGLQMSFSF

SEQ ID NO: 12547 - protein, 745 aa, Gluconacetobacter diazotrophicus
MSRRGLPVGWPPRRLVFFGVFLMLLAQPSRARHPVPLSFLHVMFRPVPARRPLAVMMLAMSGLADAAEPAQASDITLPAVSVTGTATASYNPPDASGATRTDTPLREIPQSVRVVPRAMLDDIAATRFDQTFDYVSGVARQNNFGGLWDNFAMRGFTGNENTGAGYLVNGFAANRGYTAPLDAATIDRVEVLKGPTSSLYGSSEPGGTFNVVTRQPQFRPAQRYGFELGTRDGYRATADVTGPLGEDIAGRLIAVADHQGSTRDFIHSQRYLVAPSFTWMLGNDTILQYAAEFQRYTTPMDRGVVAVNGQLGRIPRSRFLGEPGDGSLRLDSQSHQVSVEHQFSPQWKGRLAVSYRGGALAGHSSEASSLAADGRTLWRQHRYRDFQSDDVALQASVTGKFSTGLAAHELLLGVDAYRFGNTMAILRKNPSAAAPYAIDIYNPVYGQPAPPLAWNMDTYERQHNVGAYVQDQISLGERWRVLAGVRFDSFSQSLDDHLRGTRTTQHHNAVSPRVGVSYLASNNLSLFANASQSFRPNAGTDAAGQPFDPERGRALEAGIKFDSDDRRTGATLAVFEIRKRNVLAADPADPSFYLAAGEARSRGVELDVAGQLGTHWRVSGSFALTDAEITQDTRLAPGTPLSNVPRTSASLLAMYEDAAPVGQRYGAGAGLRYVGQRPGDVQDSFSLPAYVLVDLHGYWQYSRHVRVSLNVGNLFDKTYYASSYSSLWVAPGAGRSVRLGVQLSY

SEQ ID NO: 12548 - protein, 642 aa, Gluconacetobacter diazotrophicus
MNIRHLLATSAATALLSSLAHAASDTAQAQPAAPASGADLPTISVTDTRHLPESFDRRYASTQVLTREDLDRLSPADPSITQALATLPGVTVAQNGGPGSSASVSIRGSSASQVAVFIDGIRIGSPTTGIAPWADLPTEAFERVEVISGPAAASFGNNAMGGVVQLFTRRAAHQPNQTTVSFGGGSNKTFDTQFRTSGTVPSTGPLAALGGLTYSLGLHDYNTAGIDATRPFFYGHEDGRNPYHAQDLDARLGYARDNWSISTFALYHRSDLSYDNSGYANRELDHQLTTGVAFHLDITPDTQFDQSFGYANDRQFIYADNPALATDQINSQRISTSTSLTHQEHGFHLFGLPLSGESKLAYDFTREQAFLPVDIPGGVPTRNDSAFSLHQSATLGRVTMFVAGRHEIIAGQAVNTGNAALSWAITPVYTARVSYGNAFRLPTFNDLYYPGYGNPNLSPERSTSVEAALDANTAYGTFTAAIYDTRVSNLIAYNPATFSPMNIGRSHIRGIDLSYKGTIGRSTPVSVAVGILNPQDETNQTWLSRRPRQTVSLNVDHTWDELKLHALSTGASLLYGGSTFDDPANRQYLASYLTVSLRASYRINAHLTVSASLSNLFDRQYMTAYGYNTLGRTAFGKVSYTF

SEQ ID NO: 12549 - protein, 384 aa, Gluconacetobacter diazotrophicus
MKPIRYQHACAVMFLIAGAAHAQSSVTLYGVVTDGLNFTSNGGGHTSFRMQSGDVPNSRWGLLGSEDLGGGYKAVFRLENGFDVNTGALQQGGREFGRQAYVGLASDRYGTLTLGRQYDPTVDLFSGFTGAGSWAGVAAGHPFDNDNTDWDFRVNNAIKYVSQNWHGLTVEGMYAFSDQAGGFADNRLYSAAVQYQNGGLRAAAAYLKINNGGLATGAVTSDTVFTGSSEQNIDAGVSYRFEKAQVSLAYSHVDMYDPTAGVWLPAAGVQPRGGKWNAWKFNNIEVNGQYFLPHGFSVGAAYTFTAARLASTVGEYSPKWHQLALMLNYDLSKRTAVYLQGAYQHVVSAHTGTDFDFAQIPLIGAGLSSSVNQGVIRVAMVHRF

SEQ ID NO: 12550 - protein, 710 aa, Gluconacetobacter diazotrophicus
MSQRLSLCIQHKAGQRRAVLQEMNMNQSQFQRRAVALASLLFIAQTHAMAQEALLESVVVTGTAEQPESITKPFSIITADELNANGASTVGEALRYQPGVSATGFGPNSSRPIVRGQDADRIKILRNSAATVDVSALSFDHALPVDPFALHQVEILRGPAALAYGGNAVGGVVNLIDQRIARKPVQGLQGEVNLLGGGAADQTAGGFKLDAGLGQGVSIHLDGFKRTTRDLETPTFTDPEGVTGSRVQNSSSKSDGASIGASFQTGNGYIGVSAERYNNEYGVPKSLDVRIGMESERYALEGEQNFNGAAFKQVKYRLAKTDYQHQEFEDGAPATLFVNDGVDGRVEVALQPFSMAGMNINTSTGLQFERTDFSAIGDEAFVPSTSTDQTGVFTIFRASRGQENSGVFEFGLRGDQVDVNAATSGLSALNGPVAGAGVDAGPAINRSFTPSSVSLGYTAPIGNGWSLGGSLSRVERAPSSFELYADGVHVATDAYEKGNPNLQEERGRHVEVTSTWAQGESKFNATAFASRYSNYIALIGRTGADAEFIEAPGEPPIQVFDFTAVPAEFQGIELGYQTAYAMGAGQLQPSIQYDLVRGKRTDGGGNLPRISPQRVVASAAYTQSGWTVTPELIWVSDSKAGAGDIEVEGYELVNLRIGKAFTWGNTGGEVFANLQNLTDELAFSATTLNTVRGYTPLGGRSALVGVKLAF

SEQ ID NO: 12551 - protein, 797 aa, Gluconacetobacter diazotrophicus
MKDRQTMWTSARNRIVRRYPPPASGQPAFRQGARTVTLSLTLSPVVAGLVFGLGAASAADRPQAETEAGTKTETKAGTRTAPKTAPKAGTRAAATPRKGPAQDAAKAKEERILVTGRKSPTVASSGTKTDTPLVDTPQSVTVIDRHEMDIRGVLSLSQAVRYTAGITPDQRGSTATRYDLFALRGFTIPNFLDGLKLQDSPTGYATAQIDTSRLDRIEILKGPASALYGQSSPGGLVAMSSKLPTSATSYGSLVATGGSFDLYRVDGDVGGALTGNGFVRYRLYGTANGSHSQLSQTQSRRYSISPAVTFGGDGDTTLTLLGNVQDDPQNASYGSVPLEGSLKRAAFGYIRQNFYDGDPNFEEFNRRQWATTYIFNHRFNADWAFSSRGRHDDVKTVYESVYSEGVYLDPDYERDYAQEALGNFSRGTAYAREHLRNLAFDNQLTGHFSTGPLRHAIMLGFDYQESEATELDGFGSAPSINVLHPVYRQQITPPAISNNYLTDQHQIGVYAQDQVDLGNLHLTGSLRNDWYRSHQQDTIGGSYSSQNPEMITWRAAGLYHFKFGLAPYISYSTSFQPQSGVVSSNGGQSTRQADPTVGKQLEGGFKYQIPGLPILLTAAGFHIEQTNVLVAVPNSNYSTESGKVRSDGFEFEAHVNVYKGLTVVATANTQKVRDLSTGKPLIQVGKGGETLFGYYTMPSGRLKGLGFGGGLRHVDSAFGGTASYGDITVPSYTLFDASASYDLANLGHAFIGWKVQASVRNLFNKRYVASCYGYAPYDEWCWYGERRTAQASLGFSW

SEQ ID NO: 12552 - protein, 686 aa, Gluconacetobacter diazotrophicus
MTLRRASLLVYMALSSTAVMADKLANIERITTTATRSVGSATPLPFVISTVSQQQLALIAPTHIEQVLKQIAGANVQHGNGQEYLPALRSPVLSGAGACGGILTTEDGIALRAAGFCNINELFEAHTEMAERIEVLKGPGSALYGSNAVHGVINVITPDSTQDRGFAGLDLGSFGYKRAKFQQGHDMGDSGIGISASVTRDSGYRDDESVEQEKLSLRYRLETDDLAVMSGLTFTHLDQQTAGFIEGFESYKDRDVAQSNAYPDAFRSAQALRVWSQFTWQDERNTLVLTPYFRDQNMTFFKHFLPGTPLEENAQTGAGIQSLWRYQEDENIQIELGFDSEYTQATMLQYQQNPTQGSAFLVATVPQGKHYDYEVASSLYAPFFNLQWQWQALSIDVGARFEHLSYDYENNMQAGRNRDDGTPCAMGGCRYSRPQSSENSFSTWSPKLGLSMVLNDNNVLYSNLSKGYRAPQASELYQLERKQTVADLAPETASNLEIGLKGNIAALSYILSAYTMDKKQVIFRDSDFFTINDGQSSHRGVEVEFEYAINLDWQIRFAGTHAKHKYESDQQLGEINIKGNEMDTAPRNIANVQLNWQPSDTINTSLEWHHVSRYFTDAENRHEYEGHQLLNVRVNWQPTAQLSLTLRINNLADTAYADRADYTSFSGDRYFPGKPRHLAMTMQYSW

SEQ ID NO: 12553 - protein, 570 aa, Gluconacetobacter diazotrophicus
MRISVFYLSAALLTPSGTSQAADLARPAAPLAGAVWTWTGFYVGAHLGAGFGTVKVDNPYGPSIYGDTIRVPKALAGLQAGYNWQVPGSPWVLGIELDASALDADGTDTCLAYSGQFVSANCRVREHALGTVTGRIGRVFGPQGRSLAYLKGGAAVLAGDLTMTTNAVDYLNQPAAKLDATRWGWTVGAGLEYGLSSGWTVKAEYDYAAFGRRGIDSPDGGFLQIPNDPSSLINTVGAATQARQDMHLVKLGLNYYFGRGAGIAEQTPLLPVKAPATSPWAAWQFDVGARYWYSRGRYQNDLTLNTVNAQQDHLVSRLTYESEGHSGEVFWRIDSPRKLFLKGFAGGGGLVAGKMNDEDWFPTDPNFAAAYSNTYHGKVTGTIAYATLDAGIDLLGDATGKLGVFAGYNFYRDRKDAFGCAQIALVGLPSPCSVPDPTSQIAITQHEDWHSLRLGANGSLTIAPGAKLTVDAAYLPYAHISALDVHHNRTDVPDKNSPAWGTGRGVQLEAILSYDVTPTFNVGVGGRYWAMWATDVETAGFGSPVATQLLPIRVERYGTFVQASYKFDVR

SEQ ID NO: 12554 - protein, 986 aa, Gluconacetobacter diazotrophicus
MSFRRVSALTIAVLAVTAPALAQGPAPRFDIPAQDARAGLMALCLKAGCAFAFSTEPGRTYRANAVAGTMSWQEALKRLLAGTGLRYEMADHASVRVWADATPASPRVAPTPEAPVDLDAVTITAAFVAGIEDSLLQKRRADAIVDAISAGRIGELPTANLAEALQRVPGVAIEREVGEGQFVSVRGLGPLFQSVTLNGAPVAFNENIRNSTQSGRQFRFRALSADLLAGAVVAKSATADIVDGGIGANIDIRTVRGLEGASYLSFRADAHAEARSGAVSPDLAVSGRWRRVDGRLGVVGGLSTERREVQYDRLQIQRYRNVVMNGQVLAVPDDVRTTVEQEQRARATAFVGVEWRVAPTASLYFDVLASRFDNAIREDRIVYTIGDYATSALAEPRVVEGSLVGGRITAGQISNNLEVSDQVHDNVSLSLAMKALVGDWRLEPRLSVSNADSNLDTPLQRIGAVSPLGVSYDFDLGPDLVRGREAPRLATSFDLTDPHQLTFSRYGVRATQVEDHDSTGLIAAERPVEWRLGPLRIERLRLGGQVSDRRRDYQRRDRDATLRPGAAVDPGFFGVLAPEDGFDRLVADRPPAWTAADFSAFRAAFVLAGEADSVIVDAADLKPAGADLQGSYKVGERILAGYGRLDFSTTVLGRPASGNVGVRTARTATDVAGSRLGVSATGQLEVTPVDYDGSQAVTLPSANLAIDLNERWRLRLAASRSITRPSLADLRSATVPASSLVSILYERGQMEIDHPSEGTLFSGVGGNPALKPYLATNYDLSLEREFENFGGVSLAAFHKTIDDFIVVSARPERLAFDTRSGPPVTALVMMSRPHNAGEARVTGVEAAFSRRFPAGLGVWASATLVDAWSRDALGQRGRLNGVSRLSYSISPFLEHGPLHAHLSWTWRSPFGSEADMQGGGVSSFVVASTGYLDAAGSYDLTSHVSLFVQASNLTDTIEAAYEGQRSRPLQIGRSGRSFGLGVRIRG

SEQ ID NO: 12555 - protein, 841 aa, Gluconacetobacter diazotrophicus
MIRTSQHSRSKLASAIKFGLIASVSTTAFTVSTSAVAEEAKVERIAVTGSRIQRQDMETASPVTVIDAATIKAEGFTSVDQMLQAQTSMAGAAMGSSTNNGSDGVAQVDLRGMGSQRTLVLLNGRRMVNSGSGADSAVDLNSIPVAMIARVEILKDGASAVYGSDAIAGVVNIITKKDFEGFQIDVTGGMTDKSDGENGEISALYGFNTDTGNYTFGAAYSERRGVVQSDRDWTDPGASSFIPNGSLGGMVKDENGNWVDREEGYDYTQDSFYQTPSKRYSLFANMTQELGDDLVLTGDILYTKRKSNQQLAPQPANLDLDVCEAGDDPTKCVELDQDMIDAGITPNDKGQVNYRKRMSDVGPRIYTQDTDTLRVSAGLAGSIDVNTGMDWDLAYTYGKNKAKTAVENSINASIMTDAIYADQDPWLTGQPMTDQDLLNSVAYTEEADGGNEQHVFSAGLTGELFDLDAGAVAYAIGAEYRYESGYYNPDPIVVAGESTAAQQDPTDGNYNVISVFQEVSVPFTDKLTGEFALRFDDYSTFGNASTWKIGLTYEATDDLMIRTVAATGFRAPSVSELYGGNSGSFDYLDDPWGNEQDPQILVIRTSDEDLKPEESESYTAGLVYSPSYVDGMSLTVDYWRFKVKNAIARMDTQNGLNNCFAGDQAACEAFNIGPNGDLDNLTNSLTNVGYQDTSGIDFNLAYSFEALSLDWTISNDTTYLLNFEQDGVDYTNTIDGNFGAYAQVRNNFSIKAGQDDWSVMYFNRYIGEMDDLGEGTKVDAILYHNVSASYYFNDTWMVSAGVKNLTDEEPSNVSNGSAGGTVPEVYDTIGRQYYAGVTVKF

SEQ ID NO: 12556 - protein, 351 aa, Gluconacetobacter diazotrophicus
MSVFRLSLLSASLLAGVSLHAQATPDFYGRIDYSVTHSDTGAATHKGLDGTVLENNFTRLGVRGTEALTEGLTLFYQVEMGVDSASESGNSKPFTARPTFIGIRHANWGSLAAGRMEPVFKMTKGFVDVFDNYSMKHDRLMAGDKRWGDSFEYKTPVWHGWQLGASLLLEDNYYQDSDKRKENGNYQLALTYGDKKLKNSDLYFAAAYSDGVEDIKAWRAVGHWKLASLGLENLKLGTLIQQSELANPAKPYWQDRDGLGFIVSGSYKWDKWLFKAQYGKDESGTGLIANRVYSALGEAATQVPHVSQWGVGAEYFFSKSTRVHLEVGQFDTKQYAEFDDTITSIGIRYDF

SEQ ID NO: 12557 - protein, 296 aa, Gluconacetobacter diazotrophicus
MRFLSLLCPPVERAAVMRPPYTTHLQRVPLMRKSLLALSLLAATSAPVLAADYSDGDIHKNDYKWMQFNLMGAFDELPGKSSHDYLEMEFGGRSGIFDLYGYVDVFNLATNKSSDKVGDPKIFMKFAPRMSLDAFTGVDMSFGPVQEVYVASLFEWDGTDFKTNAFSVNNQKIGLGSDVMVPWFGKVGLNLYGTYDGNRKDWNGFQISTNWFKPFYFFENGSFISYQGYIDYQFGLKDEYSTASNGGAMFNGIYWHSDRFAVGYGLKGYKDVYGIKDTDGFKSTGFGHYVAVTYKF

SEQ ID NO: 12558 - protein, 971 aa, Gluconacetobacter diazotrophicus
MAGICAGALAVPAYAQDVTGDDSESGIAETTDNQRIIIVTAQRQAQSLQEVPIAVSAFDSEALEAQQIENASDLQLTLPNVSFTKSNFTASSFTIRGIGDLCVGVSCDSATAIHLNSAPLFNTRLFETEYFDLERVEVLRGPQGTLFGRNATSGVVNVVTAKPDLSGFGAAAEFEYGNFNSLKAKGMVNVPVGDAIGVRVAGFWLDRDGYTENLFDGNDIDDREMYAIRGSLRFEPGANTTIDLMGYYFREDDNRLRIQKQQCQRDPTGVLGCLNSRRDFAKTNSNSTFTGTLGSSEFLAINGIPASFGLNSLYGPDAYANFEEPADVRVVNTEFTPDYFADELQLQAHLEQVFGSFTLGVTGTYQETSVDSRQDYNLGVGAIPNAAIAFPTLQAFAAGAAGPGTGAYFQPIVDALFDGSNLCVSDTNLNNLGAFGGERVCTPNGTQFDRSNQENESFSVEAILSSDFDGPFNFLVGGIYAESKVLENSYFVNSFAIDYVSSVLGSFTSLGGGLPPSYLGTSFFRNNTDDFKLESFGIFGEVYFDVSDRLSITGGLRYNDDTKSIRARSTLASFLVPYGTDPFETPFGADFDADPGTPCTAGSPVGPIGSVAGCEAFQEREVSFNEITGRFVVDFEVTPDNHLYASYSRGYKSGGINPPLQPIFQVADSFGSESIDAFEIGSKNTFGGGSLQLNATAFYYKYSDLQLSRIIARTSVNDTIDANIWGVELEGIISPSYNWLINMNFSYLNAEVAGDQFFSNPRDPGGGDPDAVIIKDITNGALCAVTGAGANAFVAAVNPGLGLQGPTAFPEDGGIASTGAFSICSVLEDQAAAIGEVFGGVEVLSPGVEINLKGNKLPQAPTTKASVGVQYTAEFGGGATLVPRFDVAFTGEQYGNVFNGNVNRIEPFVQANAQIQFNDASERFYIRGFVQNIFDSDSVTGLYVTDASSGLFTNIFTLDPRRYGVAIGAKF

SEQ ID NO: 12559 - protein, 713 aa, Gluconacetobacter diazotrophicus
MTSLFRSAYLLTACSAVALLAPVSAQEADEDTITVVGIRQAYQGDFDPLEVPQAELTLDAEVLRNANALDLNDALDLSASVARQNNFGGLWNAFALRGFVGDANLPSNYLVNGFNAGRGFAGPRDLAGIESVEVLKGPRAALLGRGEPGGTINLVTKRPTFDPESEIRLSAGSFDTYRADADVDLVVADNIGLRLVGFYEDAESFRDTIETTKLGVYPSVAVQLTPRSKVVYDLEYTDQEVPFDRGVVAVENELGVIPIETFLGEPGNGPMDAEVIGHQFELQTDFSSNWSGLFGVNYRDTSLEGFDTAATLSGSRQFLFVDGENMSRERRFRDYDATYFVVRGEIAGEFSTGNLEHRILIGADMDEFENDQVFLRARGGGIQDGESPTDPTVAERLQVINIFDPVYGQFDLPTPSPLTDRMETQESVGIFIQDQISLTDRLDIRIGARYDDFSSKLNNRAADSVTEVSDTRVSPQFGIVYQVTDAVSLYAAYGENFRPLSGGLDPNTSVSTEAGVKFELRDGALVGTATVFLVEQENISTVDENFNATAIGEAQSTGFEFDLNGEIKEGLDLWFSYAYVDAQTENDFNDPDFGVTISAGQRLLNIPEHQLAVQLVKDFAVHGLPLRVGGGVTHVGDRLGQFGDFFGQGLGDFELPAYTVARAFAEYDLTEAVSLRADVDNLFDEEYYSNSYSQLWVEPGAPRNFRVSASFKF

SEQ ID NO: 12560 - protein, 559 aa, Gluconacetobacter diazotrophicus
MSAYSRIRFLLMFGTALSAGVPSWAMAASQDDEVAAMRREMRQMLGEIRQLQARVARDESGAKAARHGAPAGRVRVARAAPPPWTGPEPVIGTPPAVPDRTLLTFGSSSGPRSDAGSRLITPEGPPSSWSDFRAATARDETMHIGGMAIGFPEGRPTIASDDGAYAFSLGLTAQEDIGGFVGTAPKRGEGKGNFNPLTENARRIRLYFSWRYKDWVANVTPEFGNATADGSVSLFEANLNYTGLRHTILTVGYFQPRMEEESAERASSFEFMERPTIVDLVRNLAGGVARFSVGGEHAEKRWLAAAYFTGQKYGDRSKDTTITDSQTGAVARIAGRPYVSKDIDVHVGAGATSAFKVNQSSTGRNYTFSDNVEMPLGETSLLTSGALTNVAQIWAAGPQVGFRWRNFLLKSEYYHIGVERGAPPAARRPCRRWASTVVRRGNYTLFGKGRAYNAKTAAFTTPGVIYDFDPLHDQWGAMEVSGRWSVTDLGDVPDQGGKGINGNQQTVWEGGVNWYPTRHVKLMLDYDHFIVSRSKGVSGGVNLLGRSGNAVMGRVQASF

SEQ ID NO: 12561 - protein, 816 aa, Gluconacetobacter diazotrophicus
MRRTTILLSATTALVTMAGPAAPSRAHAQSVSDTTATPTPPAPSTVMRKVARTASASPATDGDKDEQVIVTGTRDPHQTARSSVSPIQVVTAAQLAATGQADVRDALIQLAPSVARSIRVNGSANMTDAISLRGLTPNQTLVLVNGKRRHTTAVLSNNAGPQQGATPVDIDMIPVSAVDHIEILQDGAAAQYGSDAIAGVVNIILKHDTHGLEAQSLNGGRYAGDGFTSGESLNWGTSLAGRGFFDLNAEYKYQDHTFRATPDSRTGRNDFMDIGDPRQQRETIGYNMEYAITDDVKLYSFATYGHRNGESYQDYRVPTASLPMYPYGFSPQETLDENDYSVTVGFKGRKFNWDWDLSTTYGGDSERMGLFDSINTAMLQNFGSSPTRFHLMSFSNTQWTTDAGVRRAFDVPLLAAPLNLALGAQYRYDSYHIGAGDMGSYYGTGASAFHGLSPNNASDSNRDVTAGYIDVSTQLLPKWQVDLAGRFEHYTDAGDTETGKVSSRYDVNRYFGLRGTVASGFRAPTLAEEHWSNMSVAATTATGYIPVDSAGARLLGAKPLKPERSTSFSAGFVVNPIDNLHVTVDAYQIDLRDRIMAAGVYNGASAIEALALNGFAIPAGVTANAVTAQYYANAASTRTRGLDITANYLTRLGRYGRINWDVAANFNQTTIRHVAEDGNGNSLLNAQQEAYLTSYTPRNRVIFGGVWHYGDLDFTVHEIRYGHATSQLEYYTGPLAYSNTQFMRFLNPPRYETNLVIGYQVSPRWHVALGANNVGNARQKKIPEQFRYLGAYAYDVNIEQIGYNGGFYYFQVNFKL

SEQ ID NO: 12562 - protein, 772 aa, Gluconacetobacter diazotrophicus
MSRKDRKGGQPFTMAGVGLVLLSSVSQAAESKSTTKPRPVLSGPQQHASAPKSKPAAPATPVPTAQHILVTGRTVSGATADYNKKTAYLGPLGNRSILDTPMSIQSVPHDVMVNQQTRNLNDLMGYMSSVQLEVRGDPNTSRPQSRGFEADVIANTRLDGLNIVSTTPYAAEMFEDVQVLNGVAGALYGAQNPAGTFAFSAKRPTDTPINRLTVGVDSIGTLMENADVSGRIGKNKWFGYRINLLHGDGTTYVQNSWMRRNLVSADFDIHFDPDTVLELDASHYTYVQRGTTPGFNLAYNATSLPPAPDLSKPNLGQDYAGYNMETNLFMAKIKHTINRDWSFTLGGNYEDSIRQVFSNTNTLTTGPVGEYTQTIAAAVTANDFRSGANLAYVNGHFHTGFITHDIVAGTNGYMMGNYNPTQGETIALGKSNMYSPSVLSGSQPYYHGRYESAYIRNQAMILGDTLHLDRHWSIVGTLTWNWLSQDNRSTKSRTVKDGNTTYSYTTPLGWTSKHIDGAFSPMASLVYKPAENQTAYFTYGRAIQAGVQAPASAANANQMTQPFRSEEYEVGYKISYQKMLFSVAGFRMNRPYAYQDANGYFGTFGMQTNYGVEVQAQGRITPDLSVLAGMTWLDAELGGTGNAATNNKEVVGAPPVQANILLDYRLPIPHGAFASGLAVNANVHYTGRRAATITNSAYADAYATLDLGIRYPFFAAHHPWAARFGVTNVANTQYWSSLYPASNNGSLNNDTGASSIYAGLPRMFHFTLEADF

SEQ ID NO: 12563 - protein, 1197 aa, Gluconacetobacter diazotrophicus
MRVSVSSLAILCALRLALPHQASAQTVVVTSPLTGASNFNAGGADGTSGAGGTGTGVGGGTGGSSSGNNAAGGSVGGSSAGYGGTGFGGGGGGGAGGQIGNQGNGAGGGGGLDGSVSNGSAGGGAGGGVGTTVTAGSWTNNSSVSGAYGGNGGNGAPVMNSGGGGGGGAGVYASGSGSGSVTLINNAGAAIRGGFGGEYAGFGVNTTGIGGGGGGGTGVAGSNFTLTNAGTIAGGGGGYGYTGGSGGNGVGGTNFNLSNSGNVTGGNGYNGSLGGTGVAGSGFTLTNSGTIAGGLGGGSGGSGVAGSGFTLTNSGTITGGNGNYFTPPPTGGNGGTGVTGSGFSLTNTATVTGGNGSSGFDFDSGNGGNGGSGVAGSSFTLANSGAITGGNGGNGGDGGDGGDGGNDSYGQDSHNSNGNGGHGGGGVTGSGFTLTNTGTITGGDGGSGDGDGKGIDGSGGVGVTSTGGSTIVTSGQISGGVSAAGVQADAVDLSGGGNTLKLESGYGFTGNVVSTSGTTNGGDTLELGGTANGTFNLSQIVTTTPTSWTGTVQYSGFDRFLVTDSAVWTLTGSTNAVSIAASMQINNGATLQFDNGAAGISLAGTFTDNGILTIGGSAAAASLAGTGTANLAGILTLTNAADRFSGTIQGTGGLTIAGGNETLTGANTYSGGTTIEAGTLTVGSNTALGTGVLDMAQGTALAFGTNGLTLGNAIVLNGDPTVEIDSGTDTLAGTISDGATPGDLVKTGAGTLVLAGNSTYSGGTEVAAGTLQVDGAIASPVTVDTAGTLAGAGTIGTTTVSGTLAPGDAGVGTLHVNGNLTMAAGSTYQVDVTPAAALGHVAVTGAATLQGGTVAVTAGAGNWTTTRYTILTAGGGVTGQFAGVLTNLAFLTPTLAYDSDDVFLSLRRNTLDFAGVATTRNEVAAGNGLSGTTSGALYDALVQTDAATARHALNSLSGELHASARTALVQDSYYVRDAAVERLRGVECAPGAASGMKTAAGGKPTDGACQPDRASVWMQDYGSFGHNGGNGNAAGMGHSVGGFVLGADAPVLGWQVGGLVGYGHSSFDSGAVSSYGHSSNVSLGLYAGTHWGRLALRTGATYSWNMLSTTRNVGFTGFSNRLNTDYDGGTAQAFGDLGYRLDAGPAMIEPFANVAYVNLHTNGYIEHGGPAALAGRAMDTGVTYLFGPGIWWCIIFT

SEQ ID NO: 12564 - protein, 486 aa, Gluconacetobacter diazotrophicus
MPVITLPLSPRCRAYVLAVLTAIAFWGTGLPSALAQSETSKSAFTPTDEAVSFPLGGAGQIPIGPLVTSLYGNPHLLGDWGGIQPWLMKRGIFVNVGVNEEFMGNITGGRTRDHVLAGQVAGEVDIDWRKLAGIPDFWTHMLVVNGHGNNFSHTLGDYVANPEQIYGARGNVVAHLVSLYADKSFLHDRIILSFGWMPTGSFFNFDYLACSFMNVAICGNFAPGKYVPGGRDWPSGNLGGIVRFRPTERTYIMAGAFGVTQAGYNGGISGWSWGQKMSGVSTQAELGWSPSFGRDDLLGHYKIGAYYDNSRYPNLYEDINGNSFQATGLPRRYESGQWSSWLMFDQMLVRNGKGVANGLIAIGGLGYAQGNIVAMRDHEWIGLLESGTPWNRPMDQAGIMFQNIDMSHTLRLQQQSSAALGVPFLSNQWGTVYGVQNWERVYEAFYSVHLLRATSLQFDFQYLQHPGATTTFGGAAVVGGQFTTNF

SEQ ID NO: 12565 - protein, 1184 aa, Gluconacetobacter diazotrophicus
MRCNLIFFLMCCPCLLRAAQFSGVVRAADQLVPGATVTARNGGAKVLAFTDESGHYALDLTPGTWEIEIRMFEFAPATGKVTVGDTALVRDWVLNMPKLAERGVKPAPAAATEATTVAKTPAAPAAPGGGARGNRGMRNPDGTFAGRGGRGPAQPGFQSAAVRATPEGQAAAADTQVQTADLGAENDDAMALNGSMSGGLEQSSDDEARRQRAMGGGRGSPGGPGGGPGGPGGAVSAAQGMQNGMGLPPGMSASLTNDSLGLGGFGASAINGGFGVGAAGAGPDGGGGRGGPAGFGAGPGFGGPGGGGPGGGGGGGRGGAGGRLGQNQQGRGQGGRGRGAFNGQFASFGNRRRTTPPISGSIALTVRNSAFNAAPYSLNGQTAQKPYSANNNLNANIGGPLRIPKIVNWQRAQYTISFGGSINRNGRSMVGSVPTLAERNGDFSQAVVANQPVTIYDPLSGSPFPGNVIPEARFNSASAGLLPYFPNATYATIVQNYRFVITDPSHSRNIGVRFNAPLNNKDRLNFNFQKQNSSSNSHQLYGFLDSGTSNGLSFSTGWSHSFRPRLNNSANISISRSRNENDPFFAYTQNIAAQLGITGTSQDPINYGPPSLSFTNFSGLSDGTPNLNRNQTVTFSDSVTWVLKRKHNFTFGFTYNRLQQNSTNYQDARGSFSFSGLTTSALDAAGQPVKGTGFDFADFLLGLPQSSSVRFGSSNNYFRSWSSSAYVQDDYRVNAKLTINLGLRYEYFAPYTELRGHLASLDVSPGFTAVAVVTSGQNGPYSGSLPSSIVRHQPKDLSPRIGVAWRPFPKRNTVVRSGYSVFYSGSSYAQIASSMAAQPPFATSASLTTSLAAPLTIQDGFATSPTTLTNTYAIDPNFRIAYAQTWNLTIQHTLPHGLVLDTEYIGTKGTHLGILENPNRSISGIANGGLQISNATSFNYQTQGGDSSYNAGQLRLTRRLSRSVSANALYTFAKGIDDASTFSGTGGTLVQFLDNRHLERGLSSFDQRHNIVTGFQLSSPVGVRGLLRNGGWKTKLLRSWNLQGNFTATTGTPLTAKVSGNLANTGGLAGGGSLRAEATGLPIQLPGDAYFNTLAFTTPAAGQFGNAGRMTIPGLFRTSLNANMNRSFRFGESRRTLSFAISASNVFNHVTITGVGTTVNSSNYGLPTSASATRAVSLNTRFSF

SEQ ID NO: 12566 - protein, 424 aa, Rhizobium leguminosarum bv. trifolii
MASRRFSKGITSLVLLSSLASPSFAGGLERGGYNIDLLFDNSRFAVQSGATYVMPQRKLKNVKDTDATDGLGTNGIGGGSTTADDTEDYWVPYLGVKVGLGDSIDCMGDFSTPFGAHTNPGADWLGVNDNIETKISTRNYGATCSYRFDMGPGQLRLIGGGFYQTVDGFKTRLVAPITGAAALVYDGTGRLDLADQAMGWRAGIAYEIEEYAFRASLVYNSKVKYDDLTGTVDLTEVPKAVSPTNPYLGVVTPVYGSAEAPDSVELKLQSGIAPDWLAFGSVKWTNWSVLQSIAFCPKATKGVVACSASSQLTSLDLFYRDGWTVSGGVGHKFNEQWAGALSLTWDRGTSQGYGAQTDTWTLGAGVSYTPVENVEWRLAGALGIMTGGESGTYVYNGRTYGNDVSYSFGDDLLAALSTSVKVKF

SEQ ID NO: 12567 - protein, 278 aa, Rhizobium leguminosarum bv. trifolii
MKRSLSGIFAALLIATNAYSADLAPAEPIPEQPPEVTVSEATGWYLRGDVGYAFTDLRGARYFQGSNANEVDFDDADLDDAWTIGGGVGYQINSYLRTDLTFDYLTEADFRGSTVGQCGFPLVDCTSTDRSSLTAYTLLANAYVDLGTYGYVTPYVGAGIGGSYVKWKNLRNVACADDGSFCDDEVTHGGKGNWRFTYALMAGASVDVTCNFKADVGYRYLHIDGGNMFGYAENGGPGRDKGLSAHEVRVGGRYLFGGCAQASYEPPPEIPLQQPVYK

SEQ ID NO: 12568 - protein, 733 aa, Rhizobium leguminosarum bv. trifolii
MHIRIWSFMLLCIICGSINAQNNDIKIKVFTEHEKTPLLGATVLFEGLEKGAITNTEGIATFSEIPNGSHKLMISYVGFKTIETTIILPSPTELIFYMEEAKGELNTVVIEATRSSRDIRRIPTRIEVIGGEELGEKNMMNPTNISMVLRESTGIQMQQTSLSSGNQNIRIQGLDGRYTQLLRDGFPLYGGFSSGLSIMQIPPLDLHQFEIIKGSSSTLYGGGAIAGLVNLVSKTPDYEPELDIMFTQTHALGSTANVFYSKRNEKYGVSLYASGNYQKVYDPEDDGFSNLPETTSVAFNPKFYYYPSEDTTFWIGLNGSYDDRIGGDVEKIENGENGIHQYTEENISKRISSQAVYTTKLDSVRVFTMKNSFSFFDRELNVPDMQFKGKQLNSFSEVTLQHNYGKNDWTLGANLYTTNFNEDESAALRRDQNDLTFGAFVNSTFDFSENWILETGLRTDFAKGWGIFVLPRVSLLYKNDSGFSSRLGGGLGYKTPDIFTEEAEFINFENVLGIDQNSLKAERSYGLNLDFNYKTRLFDDTIGFSINQLFYLTAIDNGLLLNLNDDNFFQYENADGIILSKGAETNIKFSYGHFKWFLNYALIDATLNYLPGNPQKPLTAKHNGGSVIMYETSKWRFGYETYYTGSQFLSNETKTRDFVSMGFLGMRNFDWGGIYANFENFTDRRQSRFSPLVAPPHENPTFPEIYAPTDGFILSVGIIIKPFGNHSEHHDDD

SEQ ID NO: 12569 - protein, 683 aa, Rhizobium leguminosarum bv. trifolii
MRLTANFWATTRRKVQSGKFTDDLLNSAKTVTVINQDLIKDMGAQSFTDALRATPGITLGTGEGGNPYGDRPFIRGYDAQSSTFINGMRDVGSQSRETFNIEQIEVLKGPSSVYNGRGAVGGSINIVTKKAQAEDFINADVAIGTDALKRASLDVNHVIADEAAVRVNLMAHDANTPGRDEVSGNRWGIAPSVTFGLTTPTKVTLEYYHFENHDIPDYGIPYDQATGRPADVDPNNFYGLLSRDFRDNNDDTASVLISHDFNNDMQFTSTSVYSRNTNYYIVTNPDDTTGNVANGYVWRNTKSRHSVTKTLATQLQLAGEAKLAGFTNRFAIGTEFSNERTSNLSYTVDTGNGRNAGCNDVLLANYNCTLLSKPNPHDPWVGSVTLGTDATVTETDTRSVYAFNTIELNESWMINGGVRWDDYSTAAQNSTSSLSNDDDFLNYQLSVLYKPAVNGSIYAAWGTSSNPPGTSNGDGSDRLGSNNEDLKPEDTESYELGTKWDFFSGRLSLNGSVFQIEKNNARVATSADRNSPQENVGEQKVKGFEIGFSGDITEHWHGFGGYTYLDASLESNGFNAAYDGNRFPNTAKNSISLFTTYDITEQLNVGTGAYYMGQVYGNTANTLSIPSYWRFDVVSSYKMNDFLTLRLNVQNLTDERYYDKAYTAHFANMAPGRLVMLSADMHF

SEQ ID NO: 12570 - protein, 211 aa, Rhizobium leguminosarum bv. trifolii
MRVLIAGLMASAFAIAGVSVAQAADAVDQVPEAPVAQDAPVKPAGNWEGFYLGGAGTYNMGDFGSDRHTYGFGGQVFTGYNWQQGQIVYGVESDLGYSGDDVSSGGVKNKYGWNGSVRGRVGYDMNPFLLYGTAGLALGNIKVSDGTSDESKTAYGYTVGAGVEAFVTNNITTRLEYRYTDYQSKDYDLDSGSFSRGYDENSVKLGIGVKF

SEQ ID NO: 12571 - protein, 689 aa, Rhizobium leguminosarum bv. trifolii
MIVRRRPARPTSARRDFGSRELSTPHNRISLRPSASALIAGAATAAALLLPQGAAAGGIGKQRPDPAYDWSGFYVGAHAGYVRGHAGATLQDATSVAQNSNGAGGITAGAQAGYNFVTGSNLLLGVEADISFPSYLPQNAVLSEFDNGTANTLQHLDYYGTVRARLGVIAGRWLGYVTGGLAFEHERYLTDPDAGRVMNARIGWAAGAGVEYGFAPNWSVRIEYLYSQYQNASVDLPTGASYATSLNLQTVRVGVNRKIDWFSTGSTDAFPSLAAVADPESDRWEIHGQTTFIGQGYPSFRAPYSGTNSLFPGAQFKNTWSTSLFANVRLWDGGELYFNPEFLQGYGLSDTVGAGGFPNGEAQKSGFAYPHFSPSRFYLRQTFGLGGEQEQLASSGSQLSGKADISRLTLQVGRFSVIDVFDGNSYAHDPRRDFMNWSIWASGAFDYAADKLGLGYGATAELNQKQWAIRAGYFLVDAESNSNNYDMKLLRRGEYVAELETRYSLFGLPGKLRTLGFINSTYSGSYRETLNDPSLNLDITQTRRGRIKYGYALNLEQAVTDDIGVFGRWSWNDGKNEIMAFTDIDSSLSGGVSIRGQRWGRPDDVIGIAGALNGLSRDHRDFLAAGGLGPLIGDGALNYRRERVFESYYALALNSSWTATADYQLIANPAYNADRGPVSVFSGRVHGEF

SEQ ID NO: 12572 - protein, 662 aa, Rhizobium leguminosarum bv. trifolii
MARTTLVGVFTGLVVAGGMTPTSASERLVLEDTVVASDKLEQARDQLPASLSVIDARTLHTTPVDSLEQLVRRTPGFTFQPFGQSGTQLPVVRGLTSNATAFSNSLLMLVDGVPVLRGQGFDNDLVGVERVEILRGPQSALYGRNAEAGVLSVFTRQPGDADYARVETGLGSRDKRLVSADLSTALIEGTLYAGAAGQWTSQDGYLDDDFAGGQADDRERQSGRLTLRWTPDALTDATLRYSTLKYRDQAAQWGSRTGRDRAVNSGLAGRNHSSGDTWSLDLRRQLGGDLELRSITARSVFDDRLRQDTDFQPSDLMHLARDYHFETLSQELRLSGSHGQGRWLLGAYADREDHDLDYQQKLPMGLSRTQAGLGGNTAALFGQWLQQLSGAWSLTLGGRYEYARAWIDPAGNRNQSDSWQHFTPKVALQYALSEDAQAYVSYSQGMRAGGFNAFASSAGNPAYDPEQVRSLEVGLKGLTADQRLRYSAALYRMQVRDMQVQQLVQQGLVYITNAAAATSTGLDLDLEYLLGERWTLTAALGLNRTRFERFREGSNDYEDNRNPFAPDFTGHLGLRYDADAGWYVQGALSAVGKVYLDAANTYRRPGYGLVDLSAGYRFGQYTVSTYVDNLLDKRYDAQGLLNGAVTVYSPPREVGMRVSFEL

SEQ ID NO: 12573 - protein, 113 aa, Leptospirillum sp. Group II '5-way CG'
MFLKFCFSSASQSFRSPILGVNAKIGYQNYFNDFIGLAYYGIIKYNYAKASSEKVQQLSYGGGIDLLVDFITTYSNKNSPTGIQTKRNFSSSFGIFGLGGFLKTHQRYRLSFD

SEQ ID NO: 12574 - protein, 695 aa, Leptospirillum sp. Group II '5-way CG'
MPFFAQAAFAEEAAKAGPTVEAGTLPTATVLGTRSRTSYDTPVATTATKIPAPLREIPQSVNVVPRAVIQDQGALSLNDTLRNVPGVSASLGDAQRDQVTIRGFSAINDQYVDGLRDDALYFRDLSNVERIEVLKGPAAVLYGRGSSGGIINRVTKKPLATPMAEVGVLLGTEGQKRAEFDLNTSINDDAVRARLTGAVEDSGGFRNDYFLRRQAISPSFLFNLSPDTKLTLQFDYLHDTRIADQGVPSYRGRPVNVPIETRYGSANAGDGNVETTVKSVTGTLDHRINDQWSFHSVVRNYEYALGRNNYVTVSRVTGGAVPTVTLGVNQRNRSDRGTVWQNELTQQAETFGIRHTLLYGIELGYQDKSDRVAAASGSFTYNLFNPVPVVLPTVPANATPSNYGLTHNETYAMYAQDLIKFSPQWTVLAGLRYEVLKQSRDDLTPKNQDLSRTDKPVSPRLGIVYHPVEALSLYASYSRSFQPLADSFTYYTNSSALAPQSTTNYEIGAKYDVSASASVSAALFDMKQTNLTSVDPATQLAVPIGTQRTRGLELSFAGEVVKTWSVIASYAYLNGVLTNPFDKSNGVSVSGNQPSLTPRHSGSLWVKHDLPNGFYVAGGLRAEGARFASQYNVTTLPGYMTVDLGAGYRSKHVDVTLNLQNLFNRAYYVSAHGGAENYNLPGAPRMALLGVRYKM

SEQ ID NO: 12575 - protein, 594 aa, Rhodobacterales bacterium HTCC2083
MDGFDRVAADINSELETLTAAKGLNDQPNANIGTKTEDASDQLLLSTNEHSSLGVSNGREDKPSSSGLIDGGKSEHRLLGVSDGKEEEDRFLGLSDGREDKPSSSGSSDGGKSEYSLLGVSDGKEEEDRFLGLSDGREDKPSSLRLSDGGKSEHSLLGVSDGKEEEDRFLGLSDGSDDKHGLLALSDGRENKNDSLKLKDGDDKRSFLRLKSGEKDEDSFLKLIDSDDDYDSGIEEDLEYSKPLKKIDAITTIPLPQAVEEVKKSVAAIAPTTNQQIQTVQKVTKDSIFTRLDSIAVVKINEDNNVAIAAGDEESPVKRGLWMRTMYGVNNQGRVNNINGYRGINKGGTVGFDVEIDNNIIGIAYSNVHSVFKFKNNNNNDKEIIKSHIVSIYGQKELPKNFVLQGLVSASKNFIKNKTTYLFNNTKFKSNVKHRNHSYNAEALLNYNYLATNNIVITPNIGLRYGKSRDGVYNETGISIQEIALATKENNILSGIIGAKTKIPLKNNNLGLTLHSSIEHNFNEKTQRVNRTIQIQGNKFTQNHIIPKQAKTAYNLGGGIIGSVKNTIISLDYNYYLNKRYHSHQGSIKLKVNL

SEQ ID NO: 12576 - protein, 1015 aa, Rhodobacterales bacterium HTCC2083
MLRLTGLASTAALVLAVGPGWAQVITGNDTEIVDGNDPGGTGAGTQPSPWTINTNLIVGDQNGDDAALVIRNGGIVSNDIGVLGVDPGAAGTVTVTGTGSAWTNSDDLYVGHRGVGVLNIEDGGVVDNIFGRIGYFSGASGTVTVTGTGSTWTNAQDLYIGDSGTGTLTISNGGTVSSTAGLISNDTTAIGEVIVTGTNSIWSNSSYISVGEAGAGTLTISNGGSVTASEGYVGYSSNGNGVVSVTDTGSSWINSGALFVGEFGSGSMSVENGGTVSASEVIIADDSGATGTVRIAGSAANGRGVLETGYIERGGGDADLVFDGGILSATGNEANFLRGFNAGEVTIDAGGAFIDTNGFAVGIATDLQGAGGLTKKGSGTLTLSGTSSFTGVTTVEAGTLQAGSAGAFVQNGAYAVNGGIFDLGGFDLTMAQLSGSGGEIVIGSAELTLDQANNTTYGGILSGSGDFTMLGSGTLRLTGNSSGFAGTTTVSDGRLIVNGSLGGILMMTGGTLAGSGHIGTVTAGAGVTIAPGNSIGTLTIGGNLTLDPSSTYEVEVDPAGTASDLISVTGTAFLNGASVTHVGMNGDYQPFSTYTILTAAGGINGTFGAVTSDYAFLAAELSYDLNNVYLEIERNNVRFSDMARTRNQMAAAEAAENLGTGNDIYDAIVTLPDDEPLIQASYDALSGEIHGSIKTALITQSLVVRQAANERLRSAFSDASAGVIPIQAFWPGGPELIAANPSDAPVFWSTAFGGASETRTDGNAATLNHQTGGLLAGVDAMFDDVRLGLMAGYSNSQFDPRHRSSSGSSDDYHLGLYAGTQWGGLAFRTGLAHTWHEIETNRSVAIGSFEDRLEASYNAGTLQAFAELGYRFDTAAATFEPFVNLAHIGIRTAGFTEGGGAAALDSSSRMTNTTITTLGLHAEMEVRLGETNATLRGMSGWRHAAGDIVPVSTHAFAGGDAFTVAGVPVAENAFVLDAGLDFDLTESAILGIAYSGQIADNAQQHGAKATLSVKF

SEQ ID NO: 12577 - protein, 470 aa, Rhodobacterales bacterium Y4I
MRKYQLNISTTFKSALFASTALAGAVLAGPAFAGEPVENRVQKLEATILELQRELQTVKDDQAIAAAKPAPESPVIFKGGPAFEAADGSWSFKVRGRIEADAAFYNKSGGNSPIDFNNGTELRRARIGVDGKVLNDWLYRLEADFAKASRNDSASSEIDVKDAYIAFTGIENTRITVGQHKTPNSLEQLVSSTDLVFTERPLAVEAFNHRLTAGGDFKAGVSVGYTGENYTLTTGLFGANFAASSDSSALGAANDEGWGVHGRGTFAPIQEKGKVLHLGASGYWRDAGGQNGFGGTSVRFRSGPEVSAVDNTRLVDTGNLAADTYTSAGAELGGIYGPFHAQAEYLVASVDQTAGLPSLDFDGGYVQLGYVLTGESRNYKNGLFSRVKPANPFSLKGGGAGAWEIATRFSTIDLNDDALRGGSQDNYTAALNWYPNEYIRVGVDYVRFDAERNGITTEGDAVVSRIGVAW

SEQ ID NO: 12578 - protein, 383 aa, Rhodobacterales bacterium Y4I
MKRMTYVKALMCLLFPSAALVTRAQHPVAGDLKCKLTGRMLMDGGVYLKNDNLFGNGTEFNDLRLGVKATYQNWSMKMEVGYVGNKVSIKDAFAAYTSGKHIIQVGQFYEPFTLDMLCSTYDLRFHQSPGIVLALTNSRRMGTSYTYNGKHYYASGGFFTDSDLGNVKNVSQGYAIDGRLVYRPVNEEGKLLHIGAAVVYRTPDSALPGDEDENTFIYKSPGVSTIDNRNLIYAKVDHAKYQLKQGLELMIAHQRFFLQGEYIRTMVKREQNFTNYTGHGGYVQCSWLLTGRQYGYDEALACPGRPVGRALELCGRFNMLDMNNEEAGVWGGAQKDFSLGMNYYMNKHIGMKLAYSWVMPGKHIKEISDKNFSVLQLRFQMIL

SEQ ID NO: 12579 - protein, 381 aa, Rhodobacterales bacterium Y4I
MKRYLATSAALALASGSAMASGLDRTGQPIGIIFEEGSYAEFSVATSSVDLSGNDRATTTVGTAGNPFQSATGDVGDRFNMFGAGYKRDINEQLSFAVIFDQPWGVDVNYPVGSSLLLGGTTAVADSNAITALVRYKFNDNFSVHGGIRYQEIDGAINLAGGAYSSIGSQYNVKVNKDGAFGWVAGVAYEIPEIALRAALTYSSEIEHDFNLNETFANGVSVGTSTKTKTPQSVNLDLQTGIAEDTLLFGGIRWAEHSVTNLVVPGLSGQAGRTVDLIDLDDSVTYTLGVGRKFNENWSGSLAVIYADVDGDNLVSPLAPTHGYEAIRLGVQYTQDKMKISAGIRYTRLGDAIAAPGGAVGVANFRDNDAVSFGLKVGYSF

SEQ ID NO: 12580 - protein, 98 aa, Rhodobacterales bacterium Y4I
MILRQPTEQTEGAVGYQYEGPTEGSGGDVHKWNVYAGGSLIPDTLLGNIIIEQSSRDAWRTDQSLNPDSDVLEERDELNIFSSLKWLATDQQDIDLDL

SEQ ID NO: 12581 - protein, 489 aa, Campylobacterales bacterium GD 1
MKKTIISTLVIGLVSGCSNTNLLKDNLASEQSVINLSKSSNEAKSRNIEFLSGAYLSERKVPKHDIKFSGKYVEFESKSPIELIDVLDGLSKQYNIQYVFSDELEDENSEENKKSSGSSSAKKIKYSGPLAGFFDYLSSAYNMHFEFGHNNLVKAYHYKNQVFNLQQYFDDNKFSSSMQIGGTSGTSSGLKGTADTAIESNSWEKIDEFLSASLGETGKFTIFEDYSLVTVKARPDKFLLLHTFFDKLINESKMQIAVDYRVVSLSEERLNQLAAKFGIENAGKYSITSDMVDAISLSQVGGGLGASYRSASARLDAVVNELSQEVMHEGHFIGIPNRVMPLNVTTNSKYISSIETTKDTNTDEETRTVKVSDLVTGFSMMVMPKILDDGRIQISSGFSRKQLVSIGTAQGITLPTVDENESMNTVTMNPGEVRLAMLFKDNYIQNSNGVQLLGGGTENKKSARYIAVLVGASSYKTNDLASNRVNIYD

SEQ ID NO: 12582 - protein, 363 aa, Campylobacterales bacterium GD 1
MQTKLSVALAMAMALAGPACAQSSVTLYGIIDTGVSYYNNAAHGGSFTGMPTLTGEVPSRWGLRGTEDLGGGYQAFFVLENGFQPGTGALNYGGRLFGRQANVGVNSPFGALTLGRQMNMTMIVLTNADVIGPSIHSMADFDSYLPNSRSDNAIGYKGTFHGVTLGATYSFGRDAAGPAGPSATGCAGQVPGDIVACRQYTAMLAYDASNFGLAASHDVMRGGGGALAPLNNPAYTDTRDIVAGYVKIGPAKLGAGWIRRNLAAAAHLQADIVFAGGTYYATPYLALDLQGVRYLQRRENSEGTNATLLVGRANYFLSKRTTVYTSVGYMFNSTLAANVVAAGGTVGTGMNQVGVMAGIQQKF

SEQ ID NO: 12583 - protein, 727 aa, Campylobacterales bacterium GD 1
MQNSFVAGRPTFARGQRRTPSLLSAGLLASVGLTLSTLSSSGWAQVAASDTAATLPAVSVSATKDTSVAQADTVSAGALGSRKQVDTPFSTHVVTSDEAQDLFATTANDLYKYDPAVSVTSENAISENSMFTVRGMPIDTLNSIKVDGQTFPSWDTDLSLEPFEQVELLKGLSGFMYGFGSPGGIVNYVLKRPTDTPYRSVTVGYRSAGVFTEAVDLGGRFGNDDRFGYRLNLVNEDGNTAEDHGHIRRQVASLAFDFRITPDLTWSADAFYQKRRTNGTLFGLMFGGDAGGIPDASKVTHALTQPQNYYQTEMASFGTGLDYRISENWHASLKYRFAKENRTNSDSLLFVTDPAGNYSNTLYAAMTRYFYQNVDGMVQGHFNTGSIKHDVVVGAGFETQTAEYSNSTGWNEGYFLGYGNLYNSTLLTNDEVSIGSDLYRQQRTTQAAVYASDTVQLTSRLSALVGVRYTQYREHVYDPSGAVSSQYDADPVTPTFALMFKTDPYSTLYASYVESLEQGGAASNTNLNYPDTFGPLRSKQYEVGFKTDHAKWGANLALFRVDQGYNYTNVDNIFVQDGTKRYQGLDASGWLALTSEWRVMGGVMWLDTKAVDVNDPTVEGKRIYGAPRFTVTGRIEYNPSYLRPLTLAFGGKYVGNQAVDAQNTQFVPAYTTFDLSGRYETKIAGKDVTFRAGINNLFNRRYWTTAWGYYVAPSPTRTAVASATLQF

SEQ ID NO: 12584 - protein, 400 aa, Campylobacterales bacterium GD 1
MKRVLLTVAMLSVFFSAMFAFFPDVPKDHWAYEYVWKLWQRGIFIGYPDGEFKGDRYITRYEAATAVSRLLDFIEQKMLAGASGDLAQVVGNLSDKYMALEEKVNGLTGILDTLASQIGTTQANLTETERELLEKIDAVKEEIEMEFDKEISLNREVVNNIGLKLGNLSRDYERYKENVDAKISEVNEKLAALEKDLGNKIADLEGIVNLHEKDIINIYNKISSVNEELNNKIAATEEKLSRKDEEISAMVELHEKDIINLYNKVAALNEDLNKKILDTKAELSAKIESQEKTLNMVYTKLLDTESKLNDEISALKEKDAEIQKTVDLHEQDIVNLYGKTSSLEEDLNMKYNETNEKIDQVKAELEDKIESVKAYNRNLSILTGAFFGILGLILIAISGK

SEQ ID NO: 12585 - protein, 245 aa, Campylobacterales bacterium GD 1
MKKKLLIFLLGVSVLAEANTQTIGVGAYYKNSVYHSKNQVNALPIINLEYNRFYLKGYKPGFIFYKESDFNFSAIVDPIGGYSDFAIRKSQFKDGYKNLESRNTQVMGGIALDFKIDKNIDGHSEVVFGNHGTKVNIKLNRAYKVNDRVTFIPAITFNYYNSKYMDYYIGIKEKDVKNNSKIEKTYKGKDTIAGGVSATLDMAMTEQTSFLVFGGIDVYDKKIKNSDIVRTNNQYYVGAGLRYSF

SEQ ID NO: 12586 - protein, 244 aa, Campylobacterales bacterium GD 1
MLRTIIHSSIVIMASSVAALAADLPNRAAPPTVPYLPPSPAFSWTGVYLGGQIGYQFGRDSITAPGLFSVGHSPNGVVGGAHIGFNYQVSQFIVGFEGDVNGSSYSGSVFNPVFRTQLTSRIPVDGSLRGRIGAAWDRVLVYATGGAAFASIKHGYIGSSLVPGSATLTNDRVGWTVGGGVEYAMTDNWSVRVDYRYTDYGNISDFPGTITVPRIHHETNNRVQAGFSYKFDTSPPTVPIVAKY

SEQ ID NO: 12587 - protein, 365 aa, Campylobacterales bacterium GD 1
MLDRKASVIVMLALAHAGAASAQSSVTLFGVLDSGVSYVSNEGGHGNAKLDDGIFTPSVVGLRGSEDLGGGTHAIFGLVSQISTGNGSIVGNALFARTAFVGLQQERYGTLTFGNQYEFMADTLFFSGVDAALGVGGLYNLRNGPFQKLALPDNPTGAFDWDRLGGSQRVANAAKYVSPTLGGLKFGALYGFGGVPGSIGANSTVSAGADYSTGTFGAAAAFTNEKYGARPGSPATSVLDWGAGVRYRLDAVDLSALFTTVRNAASGGAVWMSEFGGAWKLTAATTVGADYMYMKGNAALDDNHAHQVTATIRYSLSKRTIVYASGVWQRANVGAHAQIGGVMDPDGASSGATQAIARIGVNTVF

SEQ ID NO: 12588 - protein, 409 aa, Campylobacterales bacterium GD 1
MKIRLLAGVATLALCAASGASAQSALSGWYLAGDVGYHTTDGVKGTSSVNATDGQPLKWTFSADDDWAGFGRLGYRFTPNWRVEGEYGYRSGDISGVRGSAARPQPQGLCTAGIERTTAAPTCGKPEGELKATTLMANVIYDFMPGSSWRPFVGAGVGTAWVHNKVYGQLSGVPTGAAQFQNTSFDDVDQALAWQGLLGVAWDFAPNWSLDLTGRYLQTDDLQWGSVTSNVGGAGHFGPVTDVGTFEGKYKDTSLTLGIRYTFGSPPPPPPPPPPPPPPPPPPEPPAPPPPPPPAAAYEAREFVVYFPFDQYVLTPEAQAVVSQAADYAKGGNATKIVVVGHTDTSGSPKYNAKLSERRAKAVADGLVGAGVAATTLAVDWKGESEPAVATGDGVKEPLNRRSTISINF

SEQ ID NO: 12589 - protein, 913 aa, Campylobacterales bacterium GD 1
MKTINNLFFVVAMFLVTSVAFSQGTITGKVVEADGPLPGASVVVKGTSNGTSTDFDGKFKLNVKSATGTIEVSFVGFGTKSIPFNVTGGTQDLGTITLVSDNSLDEVVIVGVVDIAKERETPVAVSTIKAEEIVERLGNQELPELLNATPSVYATKSGGGFGDSRINIRGFDQVNTAVLVNGVPVNDMENGAVYWSNWTGLADVASAIQVQRGLGSSKLAISSVGGTLNIVTKTTERNEGGFVGTTLGNDNYLKTIASYSTGRMDNGFAFTGLFSRTAGDGYINGTAFEGYNYFLGFGWTDEDRTHDVQFTVTGAPQVHNQRTTSFFNAATIAQYLQFGDKYNFNHGTLNGEEFNWRRNFYHKPVLSLNWDWNINDNMKLSTVGYASFGRGGGTGDIGRLPGFNFASSSIFRNQQNGEVLWDRIVQYNSGQAVTFSDGNVYQRTDQENGLFINDSRDNGLSRRASINSHNWFGLLANLNTQLNENLTLDVGIDARTYKGFHYRRLDNLLGADAYRDNDNVNSPNRVLTNTYSSDFGSIVNVFKDIDDEDKIDYYNIGYVRWLGLFGQLEYKKDAVSAFVQFSGSNQGFSREDFFLVTPAEGQRTDWENILGGTIKGGLNYNIDENHNVFGNVGYYSKQPLFDAVYLDNTNDVNEDYRNEKVFGAELGYGYKSEKLNVSLNLYRTSWKDRYISIFGTFQDPSMPTDPNATVQGRTNLVGLEQIHSGVELEFTYRPLDFLTFNGMASVGNWEYGGTLSGPAFNVNDQNQQVGENTLYLDDVKVGNAAQTTMRLAMIVEPVENLKFDIAGFRADNLYADIRAEDFDEEDNRGSLQLPAYNLFDGGVSYKWFVGEEKDKTINFRLNVNNLFNTTYLAESQTNIFADPGDDTYDGINTANKAFFGFGRTWNFSVRYNF

SEQ ID NO: 12590 - protein, 836 aa, Campylobacterales bacterium GD 1
MKKHHTLNALTLAVCTALSGSVIAQDAATADSEAKSKEKFEQIVVTAAPGGATMQEASVSVSAFDEEDILKLAPRSTAEVFRALPGIRAESSGGGGNANITIRGIPLATGGSKFLQIHEDGLPVLEYGDINFGNADNFLRYDWSVANVEAVRGGSASTFASNSPGGVINLISNTGEVGGGAIGTSFGVDYEEFRLDFRYGGEINDDLYYHIAGFARGGEGPRETGYNGDQGGQIKFNITKMLDNGHIRFFYKNLDDKVSTYLPSPVLVKGDGEYGPVPGYDASSQALNSAYNTNISTFDSYGNPENRDVRDGIESKVNSFGVEVDLEVAENLFLLNKFRISDISGGFIAPFTDGFPAGPGDVSNFASALCSGATDGDGNALNCDSTSVVLANGPGAGETYTGQAFTNLQFDTRINDLGNMINDFSLRKEFDNGIDLTVGYYYSNQDIATSWSSWQTFIQTLDGDNSQLLTITDADGVELVSDGLLSASFLSWEWDLNYVTKAPYMNVGFELSDNILIDASVRHDTTEASGELISSCCGGNADFDLNGNGVIEQIEDASATNSGFISGGVINLNRAGAASQIVDYSANNTSYSIGGSYLLSDSQTFFARYSKGGRAIADRLLQIGGTLNADGSLTSTTSGYDTTKQFEIGYKYGTSDLMINATLFDTVTEDTQAEVTSGLTFMREYEATGLEFEGRWNATDNFVMSGNLTWTDAEISDDVNNPALEGNTPRRQADWIWTITPEYVTDTWSVGASLQGSTEYYVQDNNDLKQEGYTLVNLFATYWVNDQFSVSLNMNNATDEFIITESEEGSAEVGSYVRARPLNGRTTVLSLKYMFD

SEQ ID NO: 12591 - protein, 186 aa, Campylobacterales bacterium GD 1
MKKIILSTAIAFFTLLNVSAQDDTSTSSNTTFGVKAGFNSFIARASADGASASANASGFYFGVFADIEVADKFNIQPELQYISISEGGGSGNVLAIPIMGKYKVADKFSLLAGPQFDLILDDSEGLKKLGLGLGLGMAYDISDDFFLDMRYSFGLSNRLDDNDEEFGDIDVNVKFNYFQVGLGYKF

SEQ ID NO: 12592 - protein, 413 aa, Campylobacterales bacterium GD 1
MKKRSLAATVVAMGLVLIPGVHAKTLEDVLKEKGVITEEDYKEVTRSKALNYKPGKGFTLTSADEKFQLSLGGRLQTRYTFTDADDNGTSRDSNKFEVKRMKFWLNGYAYTKDLTYLLQVDFVQGGSSKLLDHAYLNYRFVDEAQVLAGQTKVPFGRQWLNSSGSQQFVDRSTASDMFRPGYEAGVKVHGAVAGGIATYELGYYGGAGQSTFRTSNDNAYAARITANPFGKMAYAEGDLDQSEKPLLSVGANYYRNTLQKSTATAFETNNVTLAGSTGWLGKGIGTFANGEKIDINGYGVDAAFKWLGASTQAEYLLGQADGHTSDKTLRAHGFYAQAGYCIIPRKLELAFRYSFVDPNRDKANDQQVDTQGAISYYFNKHNLKLQGDVTNSHDQSKGRTDDMIYRLQAQVIF

SEQ ID NO: 12593 - protein, 802 aa, Campylobacterales bacterium GD 1
MKKLLLLVAMLTAFSSIAQVVTVVDLETNEPLVNVAVYNKSKSKSAVSDIEGQVDLKTFSAQEVIYFQSISYATFKIIKSNISKDNFIKLQQQSDYFNPIILSASKFEQRAQDIPQKIIAVNREEIAFNNPQTSADLLQQSGQVFVQKSQQGGGSPMIRGFSTNRLLITVDGIRMNTAIFRSGNLQNVISIDPLSIDRSEVILGPGSVVYGSDAIGGVMNFYTLKPQFQKDSVQITGSGLLRYASANNENTGHLNFNIGGDKWASATSITVNFFDDLRMGTHGPDDYLRESYVVRRDGEDITVNNDNSLIQRPTGYDQLNVLQKFRYQPTQNFEFGLGVIYSGTGDFPRYDSLDRFRESGEPRNAEWSYGPQKWLMTNFNVTHRGDGKWYDKAVLTQAYQQFEESRITRDFQDSERFVNEEQVDAISTSLDFERRDRESNALFYGGEFIHNRVRSSGYIQNIDTNVFSANATRYPDGSSWRSLAAYASYQWKVSSQMIVNTGLRYNHIWIDADFTANNAFFNFPFEEATVNTGALTGGIGATFVTDNKWELRSNLSTAFRAPNIDDLGKLFDPSPGTVIVPNPDLEAEYSYNSEIGFKKTWSNKLTLDASVYFTHLKDALVAQNDELNGQSIIQYQGEQSQVQSIQNGEKANIYGLELGLNYKLNDQFSLIGHYNLTKGEQTEVDGNKIAVRHVAPAFGDIQLNYEKKSLKLGLFAQFNGQFDFEDLDPSQQSRPYLYALNASGNPYAPSWYTLNIRSRYNFNDALSLNVTLENMTDQRYRTYSSGVSAAGRNLILGARYQF

SEQ ID NO: 12594 - protein, 679 aa, Candidatus Pelagibacter sp. HTCC7211
MKNLNEPAIIVGYRFLIAMCLWIWAGVGTLCAQKTDSDSITGKVHQIPDVTVSGKKTMNKISSNVPVQRLGKDMMEDLGIQNMADAVRRFAGTDVRDYGGTGGLKTVSVRNMGAAHTAISYDGVAVSNCQAGQIDIGRFSLDNVESLSLSVGQNEDMLQSARLYASAGVLNIETSRPEFLEDRKWQLLFQVKGGSFGLVNPYFRYGQQFGEKTVLSVDGDYLRSDGQYPFLLKNGKYTQTEKRNNSEVDSWHTEWNLMHEFKEDKKLNVKAYYYQSERGLPGAVILYNPVSNERLWDKNAFVQAKYQDKIAEKWSLQVLAKYNYAWNKYQDKGAQYEGGVSTDHYTQHEYYASGAVLYRPFQGFSVSLAQDLAVNTLDSNLPDCPFPTRVTSLTALHARYQLGSVQMDASLINTYVKEHVETGDKPEDLKKLSPSFSINWRPLSEQDFFLRAMYKSTFRTPTFNDLYYYRLGNRSLRPEKAKEYNIGVTWGAKKNSVWDYLTFTGDVYFNQVTDKIVAFPSTYVWRMANYGKTHIWGADITLSMGIPLGELFKAHVSGSYTWQKAVDLTDPNAKNYKDQLPYTPEHNGNGSVILETPWIKLGYSLIGVGKRYYFSQNIPENEIEGYVEQTLTLSRQFSFKTCRLRLQADLINFMNEQYEVIKYYPMPGRSWKITAAIHF

SEQ ID NO: 12595 - protein, 1102 aa, Beta proteobacterium KB13
MRVTIFLLFFCVFSTIAGTVNSQNAKVSIHKTNVPLEEILNEIEHQTDYLFMYSNNIDVKERTSIRVSEKPVSEVLKKLLGNKIAYEMEGMHIILSDKRENQTAIAQQANKIQVKGNVTDMAGEPVIGASILEKGTTNGIVTDFNGDFSLNVNPGAVLVVSYIGYSAQEVKVIPGKVLKIKIKEDAELLDEVVVVGYGTQKKVNLTGAVETVDADVIENRPIRSATDALQGTVSGLTVTSGTGKPGEFASFKIRGNTSVNSAGALVIIDGMPGDINTVNPQDIETISVLKDAASAAIYGARAAEGVVLVTTKKGTSEKVKVEYTGNFSFNTPTRLPESNTGLDHALLSNVAFTNAGLAVPFSQKAIDAIKDPNTIAIPNGKEWTYTSDMDWIDLMMDHSFQQTHNLTISKASDRLKYLFSIGWLDQNGMFSEYGPDNYDRINLRSNISVELIKDKLSLDSRISYSRGVNLYHAAEGSWSIPYITFIQAGPNMPVYDPNGNYSRHRMQLNPIQALKEGGEGRTRNQRIEGVFTLEYKPVKGLSLRAVGGANILDGQKKEWRRAYGKYGVDGLISTAFGQKSPNSVTQNNSHRQYLTGQLIAEYKGVFGKHDINVLGGWSAEENLYEDLQGKRTNIVGNELPALNLGDTDGWSNAADENEWALLSGFMRASYAFAAKYLVEVNFRADASSRFSKKNRWGVFPSASVGWRITEEKFMQNQHIFDNLKLRASWGQLGNQNGLGLYDHIASYNINGYYPFKSELGQWAVISKLPSESRTWETVEVKNIAVDMAFLRNRLTVTGEYFIKKNKDMLVSIEIPSIIGIDVPTGNYGELKVKGWEVTVGWQDKIKDFSYGARFNLSDQKDKLVDYGVEYNGFVAGVNQKVQGYSLGSIFGYRTDGYFTSEEEVKNSAAFNKAITGVGDIKYIDKDGDGKISAPNDLEYLGTTTPRYTFGLNLTAAWKGFDLGVLLQGVGKRNFYLSSEVMNPYYATWNNFSYKMHNDYWTPENPNAAFPRYYAGANHNYQISDHWLQNAAYVRLKNLQLGYTISPKLTKSWGIQRLRVYFSGDNLCEYSKLNDNFDPELSDINGYVYPIMRNFSFGINVTL

SEQ ID NO: 12596 - protein, 323 aa, Beta proteobacterium KB13
MNKVLLSAAVASTLSLASYGFADGPIDSTIYGKVNISVVNTDNGSTDQWKLNSNASRLGVKGKTEIADGLYAVYKAEFEIAVDDGDAKNGQTFTQRNIMAGIRGGFGTVWAGKHDTPTKLAQNKIDLFNDLEGDIKHTFEGENRVSNIIAYTSPNINGFATTVAMIPGEGADVDGDGNDDTGLTDGISYSVSYSKDNLYVAVAGDQDVDSQDLLRIVAQYKLDALKLGVMYQQNEDNLGTKDESGYFVSAAYKLNKKTTLKAQYGSIEDDADGDKEDSLSLGADYKLAKGTKLYVFYTDNTDSSVGEADSEATAYGLGMEHKF

SEQ ID NO: 12597 - protein, 1011 aa, Beta proteobacterium KB13
MKTYRTVSTLPARSLLGCALAVSLLATTPAMAQSSNATLRGQVSAGQAGTTVTATNVASGAVRRATTGADGSYALVGLPPGTYKVDAGPGTEQTVTLSVASSVSLDLGGSGANAAAPAGDATTLDAVQVTATTLQEVKTSEVGTNISLKQINTVPQLTRNFLEFADTVPGMQFETDANGNSRIRGGAQASSAVNVYIDGVGQKSYLFGGVSGQQQSAGNPFPQLAIGEYKVITSNYKAEFDQVGSAAIVASTKSGGNEFHGEIFGRTTNTDFRARQADERAGAPNADGNKRQTHQDEYGMAFSGPIVKDKAHFFLSYEGKGFEVSANPVSVPDNFSSLRDDLPAGVQSRLGSVTRPFNEDLYFGKIDWDIGANDRLELTAKYRDEESRDSVGDRNTAIAAKINLNTEERYDLRWQHFGENYVNEARVSYEDVLFNPTAYTIGSQSVYTRAIAEDDVLINDDATSGLAIQRKGQKGPSFQNDLTLNNIEWHGNHVIKMGVKYKEVELTQSENSAANPSFYYAVNDGQGTQPIPYQVRFNLPFAGAAPSVTTTSKQLGLYLQDDWDVNDKLQLNIGVRWDGEKIPSYLDNVTPPEVIAALNGPGTDPAVSATYAEQLAKGGVNINDYISNGRNRKQDNNNFAPRLGFSYDFRGDESLVLFGGAGRSYDRNLFDIMGLEQVKSALSQYTIRFVESPGCTPAAGTCTNFNPAFLSNPDSLGGLVDARVRNGEIDLLNNDLKTPYSDQYSIGLRTRVGDWSNSATVSYIHSKDGLILTLGNRYPNGDFFQAGAQPWTQPPPGFGNLIIGNNGVETKTAQLLLSTDKAYTKESGWGLTAAYTFSRARGNRGNDDQYGFDAATIANYTFLDLNSVPRHRLVVTGIYDLFWGISASAKLTLATVPPRNEAVSYDLYGGPPSDNIRIVSVDAPGGKFLAGGDIFGTRQLDLSLSKDMHITDTVTVQVRGDLINALNFRNYDQYSIDWGNNGVYNPRASINQYGAMTTPPRTLFMSARIIW

SEQ ID NO: 12598 - protein, 416 aa, Beta proteobacterium KB13
MQYKKNKKRYYYLALGIFFLNGLSLKALEIAVKPFGYLGLLYNQGAQKNPHSYVGALARLGVDFSYSNGWSFGIGAIGAWNIYNKQRLANLYISLGNFFGSSKNVKPYLSAGDVSDAYVQYTNQRFKIALGRFNTDFVDFDWIGGNIQGVSVAFKQNSMRYFGIFMDSMLYNGHQINKEQGNRIATSLNALASYDPVSKRLYVGGEVFVLGAEYRHENLKVVPFILTDTRLPLSTQNVLVQVGGKLEYDASLAKGFTSHTLVHGMYQYGNTDAATSVKNAGLFLIDQTFKYKIFNFGTGFYIVPARNNKGYLWTFNDRTKFYGRGINAPGVPAIYFANSSISGYVFLGLKTKRVRLDAMVAFGDYQEYSLMSSFRVWTYRSLSFDMGGGYVYAYNSKATRKSLGNSSFVFFGKFLF

SEQ ID NO: 12599 - protein, 197 aa, Beta proteobacterium KB13
MFFAATTTALTMSVASASFAGNLSEPIIAPSPAAMAAPVYSTGTDWTGFYVGGSLGYAEGSEDDSTVFEDDGATYGIHAGYDYDFGNFVLGAELELSGFDVSDGGNDIDSVSRAKLRAGYDAGAFLPYLTVGVASLDIGGGLDANDTGSFYGVGMDYMLNDRIRLGGEVLQHEFGNFDNTGLDFEATTASVRVAFQF

SEQ ID NO: 12600 - protein, 753 aa, Beta proteobacterium KB13
MNNKIIIMVAGVISTSYHGIALAENTQPQNKQQDDVVNFSQLKVSGAQKQTPLVKALEKPGAFSAVGTENKLQSMDKIIRSMPGTYTQMDASQGTINVNIRGLSGFGRVNMMVDGVTQSYYGISPSKYTHGMQPSNDFGSLIDPNFIVEVEVEKGQLNGSNSINALAGSSNFRTIGIDDVIFKNNLWGLRSKGSWGDNGLGYNGMVSVAGKTLLNEDDGYLGGLIAVSGHNIPGSYKNGDGFDTDEFATDPTFKQKPQSQLAKLKYKPNDSHELEFSGRFLQNKLTSRKINSEDYYLKYKYTPINELIDVELLASHGYNTQKFQGDPIGGALKNAESENKSDSINLSNTSHFSYGDADFKWQLGSKLMKTKYQKITQPVEDPNTIIYNPFSPSGTQDIASLYTQFEAKYDIYTATFDLNYLNYRVKGYKPACDATEKCFPQEASTLDLRESGINPGILISAQIIPEFQPFVSYAHSMRAPNSQEVFFSQNGGQSMNPFLKGEKSKTWQIGFNSFKPDFIVEGDQFNLKALWFHTHIKDYITSKSFMLCRATSQEEFDWCLINDDVWNKENPDIFQRADMYVNDPRDVNLRGYELQANYDAGVFYSMVSYTQESGKQPVSINSTSVFSAGDFTQLPEYYVTLDTGVRLFDEKLTIGSAITWTGPSKRISPIPDGDMNGDAMTEKYEKQPTIVDLYADYEINKNFKLMMTINNLTNENYTDVLNRANSGAIMEERGRNNETGRGRSYMLGGQVRF

SEQ ID NO: 12601 - protein, 879 aa, Nitrosococcus oceani AFC27
MPKHTLLVAALAVALAAPLSAAAETSADASGEASTLAAVRVTGSNIKRTDTEASNPVQVIGRQQLEQTGKATVADVLRSISANTGNASNETTNNGWASGSAGIGLRGLSQKNTLVLLNGRRLANYGFPAGGLSDTFVDLNALPLVAVERIEVLKDGASAVYGSDAVAGVVNIITRQNFEGAEIGGSFGGADQGGLHEQNLKFVGGLGDLDTDGYNILFSLQGYNRERLDQDERNLTRSGIYTDKPGGRWNGWSAKGARYLVNGVSVPMLDANGNCPTGTTRVASAPIDGLAGDTCGFNQAPFTTLIPSTKRYQAYANGTFRLNDNVEAFGEVLYSQIKSAAWFGSSPFFTLESGRFALNANSGLAEPVSSLLPANNPYNPYGRAIPVEYTFFDLGGTIKTNRSTAYRGVFGLRGTTAKWDWEVAAFGARSSERESVSGGFANRWALADALATGSYNLLNPAATPQSVRDSINIATLRPAESKLQGIDAKISGSLGHTWAGEIGFAAGAEWRREKLDSNNPWQIDAGLQVRPAIAEVHGKRQVSAAYAEVNVPLASTLELSAAARADHYDDFGDAFSPKIGLRWQPLDVLLVRASASKGFRAPSLSENSNSTSIAYGSVVDPRDPDVPGSRQNPTFFTVGNNELKPERTRSVNFGVVLSPWANTNLSVDYYRIQLDNLVGTNNTQTLVNDNVAGAVQRDERGKLQAVYNRYQNLSELKTSGIDVELRQRIPTAALGDFTVSSAYTHVRDYRRPTVVGGPLVDYAGSNLGATLPKDKATTTLDWKYGDFNAAVTWYYTSSYRQEASTAAKAVQQRVGSYSQYDLYLAYTGIDKLTVYAKVQNLADKTPPYDASFPGIRAPYDFSQYDLRGRYFTLGFDYRF

SEQ ID NO: 12602 - protein, 847 aa, Nitrosococcus oceani AFC27
MKIFRANSLTLAIGIALGSTSVAVQAADEASAEQEVETISILGTRVSNRTATESAVPVDIISAESLTRGGFTELGQSLQASVPSFNFSRTQVSDGSDLFRPATLRGLQPDQTLVLINGKRRHNQAIFGLNGTVGAGAAGTDMNAIPLIALKDVQVLRDGAAAQYGSDAIAGVINLSLRDSTDVTSGYIQGGSTGEGDGDNYSLGLNTGFDLGDDGGFINLSFEYRDADGTNRAQRDMGGSSTVPNGSALSDEVRWSQGNADSEFKSMFYNAMMSVGEFELYSFGGYSNRTALGNGFWRNFDEAAKVVPQVYPDGFLPRIFNEAQDTSIAAGLRGDINDDWQFDLSAVYGQNRYDFDSRNSINASYAAEYLYNNPGATDAEIAANSGPTSGYSGGFRFDQTTLNVDISGIVDTGWDSPIYVAFGSEYRSENYEIVAGELASYSCGSSNANNSFPSVMDPEVFAGCGFQAYPGLRPDAAGEADRSSYAFYLDLETNLLDDWMLGAALRFEDFSDSGNDLVGKLSSRFDVTDSFAIRGAVSTGFRAPSLQQSAYTAYTTNLGPGGVLSSSFTATAGSDFPSALGVDSLKLETSKNLSLGFVLNPTDDLSVTLDAYRIEIEDRITLGSLLSAEDVDFSSEAVAALAATGAEQANYFSNSVNSTTQGVDLIVTHQAELFGGDLNTTFAGNLNETKIDSVNAPEGIPEDVALDDLQRSFLTDGQPKERATLTFDYSKNDWQAMVRANYFGETDVTYFGNEHIGLPGFLSPTGSFKPTSTVEAAVLVDINLEYHFTDSLSVSAGVNNIFDVTPDELGADEPLDFITNQAFQYPVRALPYGFDGITYTAKVNFTF

SEQ ID NO: 12603 - protein, 286 aa, Nitrosococcus oceani AFC27
MIAITGATGQLGHYVIESLMKTVPASQIVAIVRNPAKAQALAAQGITVRQADYGDEAALTSALQGVEKLLLISSSEVGQRAPQHRNVINAAKAAGVKFIAYTSLLHADTSPLGLADEHIETEKMLADSGIVYTLLRNGWYSENYLASAPAALEHGVFIGAAGDGKIASATRADYAAAAARVISEAGHEGKVYELAGDSAWTLTQLAAELTKQSGKQVTYQNLSEADFAAALKSVGLPDGLADMLADSDVGASKGGLFDDSKTLSKLIGHPTTTLAESVSHLFNVNN

SEQ ID NO: 12604 - protein, 707 aa, Nitrosococcus oceani AFC27
MKFKSMLPAAVLAALSPAGQAHAQERGVDGAGATLAPILVDAQKAPALTQPLDTGSHLGLSPLETPASVEQINRATLDTRGDNSIIDAVSRAAGISASPHPGNGNSELAARGFVGASSVTQLYDGMRPYGAIGVTFPFDTWSVDHIDVLRGPASVIYGEGAIGGVVNIVPKKPTRTPIRNELQVGGGTEGTARAAFGSGGAINDKLSYRFDVSGNRSSNWVDRGDSRNLSVSGALRYDVTPDLYVTASYAQGFMHPMQYFGVPLVDGARDRALDKKNYNVGDADIAFRDSWATVSANWQPSDALNVTSTLYRMKSNRHWKDAEYYTYLPSSAQARRSSYTEIFHDQEQYGNVTTATVGSALFGMRNTFSAGVEFNHTTFQHDNNSPYAGTSTVDPFNVDPGSFLNTAGTFPKYRSQSNQYALFAENRLEITPRWSVIGGLRYDHASVNRDDLVNGGAFTKVFANTGWRLGTVYDVRPGLAVYGQYSVAADPVSSLLSLNASKANFTLATGRQIEIGVKQSFLDGKAEWTLAAYRIVKRNLLTADPVNPNQSIQVGQQSSRGLEATVGAEIAKDWRVDANVSILRAKYDDFQQSSGGTTVSRAGNVPVSVPQRLANLWISWRFAPDWTGIAGVKYVGKRFADTANQLVMPSYTTVDLGLAWKPRKDTTITARAYNVFNRRYVQSAYYNETQYLLGNDRRVEVLANYRF

SEQ ID NO: 12605 - protein, 225 aa, Nitrosococcus oceani AFC27
MKWDWIFFDADETLFTFDSFTGLQRMFLDYSVTFTAEDFQDYQAVNKPLWVDYQNGAITSLQLQHGRFESWAERLNVEPGKLNEAFINAMAEICTPLPGAVSLLNAIRGNAKIGIITNGFSALQQVRLERTGLRDYFDLLVISEEVGVAKPNKKIFDYALEQAGNPDRSRVLMVGDTAESDILGGINAGLATCWLNAHHREQPEGIAPTWTVSSLHELEQLLCKH

SEQ ID NO: 12606 - protein, 1108 aa, Nitrosococcus oceani AFC27
MRLQLTWKSAVALFLSCLAAAMVPPRLWAQTSGSIIGTVTDPSGAAVANAKVTIKDIDRNVTFSTTTNESGNYEQTALPPGRYEVNIEKSGFNQFTRQNAIVTVAQSTRVDAPLKVGDITQQVVITEIPPDLQTDRAEVDTSLDTHQLTQLPVVNRNFTNLTLLAPGAQLNTFQHAAAENPQQSTLVNTNGQQFSGTNYLLDGMNNNDSVLGIVMVNPPLDSVAETSIATSNYEPEFTQAGGAVVRVETKSGTNELHGSAFEFLQNNVFEARDPFTQGLHVPGTPDPDHRGIPELRWNQFGASLGGPAIKNKLFWFGDYQGTYRRIGASQTVRVPTAAERMGDLSDLGVPIFDPTTGNADGAGRTQFAGNVIPANRISAPSSQLLNALPLPNLSPSNPADPNYATSAVEQFDTQQFDIKVDHYLTDKLRYFGRYSYLGATLSAPGPFGLYGGPAFSQWGVTGTSDARNQNLVGEATYTFNPTLLADFRFGYSRYRVLANPLDINQQLATQVGIPGLNIEGRPDTFGLPNLNINGNGGFQMGYRCNCPLDEREFLFDYVSGWTKTYGNHTFRFGGTFEHAGNLRLPSDDHRAGLYDFDPSVTSLAPSTGGLGLATFLLGDPSHFRRFGQVSTNQEDRQNRMFFFVQDKWRITPKLTLTYGLRWDTWFPDYSLHSGQGGRYEVTNNTVYIPGVGGVSQSGNAKTQWHNFSPRLAVAYALSDKTVIRTGYGRSYFQGTFGWTFNNIAADIYPSIVTQDLTSQSKFAPVFPLTSAPPSISFPAIPSNGMLPLPDGIGDSYIPANQPISSVDQWNFAVERVLPSNLSLSVGYVGNVGRHLNGGFQLNSAIPGPGPLNPRRPLFNRFGLTQGIFDKCDCTSSNYNALQVRAEKRFSGSYSLLASYTFSRSLDFGAFGTPTDQYNARLDYGPSDFNRAHVFTLAHTVMLPFGKGRMYFKNAAGIIRGVVEGWQFNGITTIGSGLPFSPGLSNNASLNSDMSLRPNIVGDPMSGISQNRNQWFNPAAYAVPAPFLFGNASRNSLRGPNLFDAGFSLAKSFAVTERFNLQFRWEVFNVFNRTNLALPSNNVDTGTAGLITEVASPMRNMQFGARLAW

SEQ ID NO: 12607 - protein, 738 aa, Nitrosococcus oceani AFC27
MSIMRTISPGNSSIHPVRGRLSFLIALSLGCGSAAAAEQTMTVNATASSESAESAWGPSATIAAKRSATGTKTDTPIEKNPQSVSVVTRQEMDIHQPASVKEALGYTPGVMVGNRGASNVIDALSIRGFSETNTNQYLNGLKLQADNYSEFAIDPYFLERAELLRGPVSVLYGKSNPGGVLAMVSKRPTAETLREVQFKMGTDNLFSTGFDFGGALDDSGEFSYRLTGLARSADAQQQMNKEKRYTIAPSFSWQPNEKTNFTFLSYFQNEPETGYYGWLPREGTVVPIIDANGNQHKLPTDFDEGEASNKISRNTKMVGYSVDHAFNDSWTVRQNLRYSEMRTNYLSIYGNGLNTADNTINRGYAHSQEQLNQFAVDTQAQAKFATGELDHTLLAGVDYQRSRNDIDAIFGTATALSALDPQYGNDRPTALYSPYQYLNKQQQTGLYAQDQMEWDRWVLTLGGRYDYLMMSAFDRNGSEKKTHDQAFTWRGGLNYVFDNGIAPYFSYSESFIPNTGTTLTGDTFQPSRAKQYEAGVKFVPKDRPIVITGAVYQLTKNNNLMGDPTAPLFSVQGGEIRSRGFEFEAKAAVNANVNLTASYSYTAAKYTEDNYLRGKTPVQVPKHMASLWGDYTFNQTALSGLTLGTGLRYVGASKGLYRPNSGDINNGDNQNQNFDVAGYTLVDAAVKYDLARFGLPGSSIGVNVNNLFDREYVASCYREHACYWGAERQIVGTATFRF

SEQ ID NO: 12608 - protein, 1015 aa, Nitrosococcus oceani AFC27
MWRCVRRDTLVLHASSPTHTLRMFRRHRYVLVVLFLIGAATLAFSDAAAQSAGIIEGQVVDTGDGSPLPGANVVVEGTSIGTSTDPDGRFRLTSVPAGPQTLTVSFVSYKSSSTTVDVEAGQAQTVNVELASEVLEGEEVVVRGLRRSQFRSINQKRQSLNIVDALAADRIGNLPEKNIAEAVQRLPGIVLRNDRTEGRFVSIRGGAANLNNVTLNGNTLASTAGSRATALDLLPAEMVSNVEVTKAVTPDMPGNAIGGSIDISTLSAFDREGAFAFGSVRALSHDQQVPDLGETAFPFRANVTAGTKVGPDDAFGLLISASGSRRDFTTSGLKGEGWGEFSGEGSIDLRPDFGGAVVPEAQEQIVERNRRRRFAVNASLDWRPNKNVEVYLRPYYTFTDEKKLDNELEYNMVYDPEDYPGDPRPTTTESGARFARGFGSVDLSDTDEEESLWGGNLGVEHQFDGAVTLSASGSYSRGVLDRRQEDAEFETPETTRASGVADMGNFLFDYYPENPDYVGNGANYTANEVDLEYNENIENTYAAQADLRVPFSSAGVSGYVETGGQFQARDKSIDAADTGYDYVGGGSLTLADFEAPRVQTVQVGNGLMPFANTQAMVADFLGDLCNPSTEQRFAGERRCRASNAVYERVGAEDLAIADIEDDSENAEAIYAGFAMASVEVGALTALGGLRVEHTSTETDRFQLREDEEFDPEEDVVRQTFENAYTNVLPSLHLTLQATEALQLRAAWSNTIGRPEYDDLGAFSEVEIVEEGGNLLASVNEGNPTLDPFTAMNFDLAAEYYFPNGGLASIGGFHKRIDNAIYTFSSEQRNVQDPFGQGRTFDRISRSQLRNADLGTVTGVEIAYQQPFTFLPEPFNALGLNANTTLTTSDVDVPEYEDSPARPDYSFFQQSDLVYNIIPYVQTGGFEARVAINYQGEYLEGIDGSSPLEDEYVGDRTTVDINATYQFQSVLGEPELLLQVQNITNEPEVFQTGRAKNLGFHYRSGRTVTVGLSTEF

SEQ ID NO: 12609 - protein, 1020 aa, Nitrosococcus oceani AFC27
MLFLFGLMLSVPLYAQQSIKGKVTSQEDGEPLPGVSILIQGTTTGAVTDIDGNYSISVPNSESVLVFSFIGFESQTRRVGNNSEINVTLAYSSSELDEVIVTAFGISQEKKSLGYSAQSIDAEEITTAKQPNIVNALQGQVAGVQVTNSGGAPGQSARIIIRGINSLDPNADNQPLFVVDGVPVDNSTVESGGTPRGMSNRIADINPNDIETMSVLKGAAATALYGVRAANGAVIVTTKKGKSGQIRIDFNSSVGFDNLVKKPKLQDQYGQGFSGERDDSSFWPSWGANIAEENDPNYVYQNNWDRAFNTGTRYENNLSVSGGGEKATFYGSFGRLDQEGIIPFSTWDRTTAKLSGTVTASEKFNFSGSMNFSNSGGNRVPHDRFLERMMYWSETTDVRDYINEDGTMKTYGNTNPIYDARFATYEDNVNRLIGNINMNYSPADWITLSYRLGTDFYSDSRTEITPGPMGIDGEQALSSTGFMEETRITSRDLNSNFYVTLKKQWGEDWNTQLRVGNDIFERKYDRVSASGSNFVIPGFYNLSNTSQIFASQGKSIRRLVGFYGDLMVDYKNFLFLNVTGRNDISSTLPKDNNSFFYPSINLGYVFSENFDMPSWITFGKLRASYAQVGKDTNPHILGATFVSPSVFPLNGQVGFSKNSTFGDPALKPEKTTSIEFGTQMAFFNNRANLDITYYKSNASDQIIPVPISDATGFSSYITNAGEIENRGFEIVLGGTPIQTDYFKWDVTANLTTNKNEVKNIREGIDQIVVGSQFGYAGATVTMILKEGEPYGDIYGSSYVRPDANPDATMLDRGLTQLIGSNGFPVRTGSQLVLGNAVPKFFGGLRNHFTYKGLELSFLIDFRAGLEQYDQFGNFLSAFGKQEDSERRNDTVVFPGVLEDGSTNTKEVWLGQGIGPDGVDYGAGYWRNYYRGASENFVNDASFIKLRNITLAYNFQPSLLERTPFRTARLSVAANNIILSTPWDGFDPESFSAGAGGNAIGFTGLGFPGVQSVFFNLNLGL

SEQ ID NO: 12610 - protein, 780 aa, Nitrosococcus oceani AFC27
MNTSSRLGGALAWAVLLPAFTAVPAAYAGPVATVAANSQTVSLEGAKALLDQSRGRAADLQARPALWDWTAPVTAQAPTPPPAPTPAEPAPADQPADETTDILDEVSVTATRRLTRQRDITATTYSVKREDFAAQGAQTATDALQIIPGFIGQPSLGGVRNAGGNFLRGFNDQRFLVLRDGLAQTFPQNGRSAVAQFLLDDLERIEVVTGGATLRYGSGSVGGVINLITETPKGLPKLTLEYQAGSYGFSRYLGKYGGGDDTFSYNFAFSSLVAFNNYPFKYTIPSSAQYYGPTVNQNSQVTTPNIDPSIYPNGTNSFGYGGPGDPDNSGAVDLFGFMKPELGPPITIQGIADSSYNAQDNYTAKLVFKPDPTNRLTLRANQANRNFDDQGPGANSFNNCITGFSADPNGTISGDRFVPLDRNGNEVACTGGQFAVGTATTQFQFGFPNAFNASTDGRVTFPTGVPYPAAEAAVGNILFFQKRNTANTDISFNWDYELTPTTSVNSYVYYLRQLFTTFRPSPYFINTNIFGIDPTGAGNLNRIDFQGATQPYSDGQKFEAQTALNWQLSPGQNLQFGVNFVEDRVNQQQSRGSSFFTRAIARTSIFLIDDISFSEQLKANIGLRWTSSSQFGEVLSPGVGVRYSPTNWISLRSNWSQVFNAPNIADLYVISGLFIDNPDLRPETGITYDVGIDLTPAPNLGFRFTYFSTYLNDTFTAITFVNPDADNPDSPTFQSPIVQQIQNIAGQRARASRRRLTGRLPTNCACGRHGRTRMRAISAW

SEQ ID NO: 12611 - protein, 203 aa, Nitrosococcus oceani AFC27
MKKSFSFFIGTLLVFLFSSPLAHAAAPYASLSAGLGFLTNSSADDGVVKVEDVWGFNTGYLVNGAVGLDGDMYRVEAAIGYQSNSIDTLLGIEIPGDWNWRVSILSFMANGYLDIESEGSTVTPYLTAGAGIANVSFNDGITSDDDTVFAYQLGAGIGFEVSEDTTVDVGYRYFATSDVDPGGYGVDYSMASHNAVVGVRFAF

SEQ ID NO: 12612 - protein, 665 aa, Nitrosococcus oceani AFC27
MPGYVAKRSATGTKTDTALAETPQSISVVGEQQVREQAATSVQEALRYTAGVAAEAYGPSTRGDYPRIRGSDAAIFLDGLRLKDPDVFNEPRPDPYTLSRFEVLRGPASTLYGSSPVGGLINLVSKRPLDVPYTEAGIRFGNYGWKEAFTDSTGRLSEDGQFLYRFVGIGRLADAQTDFVANDRYVLNPSVTWRPSADTTWTLIGLHQKDAFGASDAFLPREGSLYAGPNGFIPLNRFTGDPNFNRYETETSSITSLFEHRFDDSLILRQNLRYSHIDGTYQSAYGNVYTLTPSADLPNAPFLDPARRTVDRFTYRVSSVKDRITTDTNLQGRFDTGPISHVVLGGVDFRQQWDSTRTGFGTDPRPFDLYAPVYVGVTPPDLGVPTALSQSQTGLYLQDQIKFGQWIVLATLRHDWVNSATRGAESTSGEATTGRVGLMYAFENGLTPYVSYATSFTPIFGANVCAGGACRPIEGEQIEGGFKYNPTPWFAVNAAIYDTTERNRLAPDPSGLPISIQTGKVKIQGGDIEAIATINGDTNIIASYAYTDARYAAGANAGARVETQPLHLASLWVTHRFTLSEVPGAFLVGGGVRYIGESFDGSLNSFNTPAVTLADALIGWEDAHWRAQLNVSNIADTRYLSTCLARGDCFVGTRRTILGSLTYKF

SEQ ID NO: 12613 - protein, 136 aa, Nitrosococcus oceani AFC27
MTAQIAAYGRLVDDPQVKQTSKGTPMTLARMAVSLPCSQAQDGQATLWLSVIAFGKQADFLAKHQKGDVASVSGTMQVSQWTGQNGETRQGYQVIADSVISARAARPGGNRRKTTGTQGNQPPAGGDDPYGDGIPF

SEQ ID NO: 12614 - protein, 457 aa, Nitrosococcus oceani AFC27
MRAFARCWQFRAVMTPTASFRAALQVLLSGSALLLAPLAHAQQDDAAPSSATEPPPASEPTPTPVPEAAMPEPETKPQAKKEERAWYDRIRIRGYTQFRYNRLPSFRVNDELVNDQGDRFLGKNTGFGIRRARLVLFGDVHDRVSIYLQPDFASVIGDQYNVTIMRDWYADIFLDAKKEFRLRVGQSKVPYGFENLQSSQNRLALDRNDAINSGLKDERDLGVFFYWAPDEIRKRFKFLVDNNLKGSGDYGVVGLGVFNGQTANRAERNDTPHGVVRVTWPFLFGSQYVEAGVGGYYGRFNLNASPRDGAPYALARGSDMVDARAIVSLVIYPQPLGLLAEFNLGRGPSLGEGPVEGLLIDSRRLRGGYAQLMYKLDGVLGVSLIPYIRGTLYDGGKKFETNAPLYDVRELEMGAEWQLNKALELTGTYLISDRTSSRYPYIQEQGHVTRIQLQVNY

SEQ ID NO: 12615 - protein, 246 aa, Nitrosococcus oceani AFC27
HRDSVVGFRFGYAMFETLSAGFSLDRSLSRSLQDSYLKNNHNLGAGFYAQWNAPFRGGEWYVRPAVAFNQYSVVVQRPLLTNTEAGTGYSCMKGRDASLEAGQRFNADHSVLLGWHLGVRHSSVLRTAYSEQNAAFPFSYSAINNRRTSAYVGADVAVPLTARLKWMAGLEIDRRLYGDDPVYGGHADYIGGFAHQMVMKRVIGTISSGVEYRLSPTMFLGATFDVSRRALGDRTWSGTLSLGGRF

SEQ ID NO: 12616 - protein, 768 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYPVEGAGKETNIRGSARGIPDPSKHKYHNFLGKIAYQINDNHRIGASLNGQQGHNYTVEESYNLTASSWREADDVNRRRNANLFYEWMPDSNWLSSLKADFDYQKTKVAAINYKGLFPTNYTTWETEYHKKEVGEIYNRSMDTRFKRFTLRLDSHPLQLGGGRHRLSFKTFASRRDFENLNRDDYYFSGRVVRTTSSIQHPVKTTNYGFSLSDQIQWNDVFSSRAGIRYDHTKMTPHELNAECHACDKTPPAANTYKGWSGFVGLAAQLNQAWRVGYDITSGYRVPNASEMYFTYNHGSGNWLPNPNLKAERSTTHTLSLQGRSEKGMLDANLYQSNYRNFLSEEQKLTTSGTPGCTEENAYYSICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPVKNLTLRAGVYNLFNRKYTTWDSLRGLYSYSTTNAVDRDGKGLDRYRAPGRNYAVSLEWKF

SEQ ID NO: 12617 - protein, 768 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYAVEGEGSGANIRGSARGIPDSSKHKYHSFLGKIAYQINDNHRIGASLNGQQGHNYTVEESYNLTASSWREADDVNRRRNANLFYEWMPDSNWLSSLKADFDYQKTKVAAVNNKGSFPMDYSTWTRNYNQKDLDEIYNRSMDTRFKRFTLRLDSHPLQLGGGRHRLSFKTFVSRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWHVGYDITSGYRVPNASEVYFTYNHGSGNWLPNPNLKAERSTTHTLSLQGRSEKGMLDANLYQSNYRNFLSEEQKLTTSGTPGCTEENVYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKAKDAQYTVYENKGWGTPLQKKVKDYPWLNKSAYVFDMYGFYKPAKNLTLRAGVYNVFNRKYTTWDSLRGLYSYSTTNSVDRDGKGLDRYRAPSRNYAVSLEWKF

SEQ ID NO: 12618 - protein, 769 aa, Neisseria meningitidis
ADEAATETTPVKAEVKAVRVKGQRNAPAAVERVNLNRIKQEMIRDNKDLVRYSTDVGLSDSGRHQKGFAIRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTVEESYNLLASYWREADDVNRRRNTNLFYEWTPESDRLSMVKADVDYQKTKVSAVNYKGSFPTNYTTWETEYHKKEVGEIYNRSMDTTFKRITLRMDSHPLQLGGGGRHRLSFKTFAGQRDFENLNRDDYYFSGRVVRTTNSIQHPVKTTNYGFSLSDQIQWNDVFSSRAGIRYDHTKMTPQELNADCHACDKTPPAANTYKGWSGFVGLAAQLSQTWRLGYDVTSGFRVPNASEVYFTYNHGAGTWLPSPNLKAERSTTHTLSLQGRGEKGTLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNLFNRKYTTWDSLRGLYSYSTTNAVDRDGKGLDRYRAPGRNYAVSLEWKF

SEQ ID NO: 12619 - protein, 768 aa, Neisseria meningitidis
ADEAASETTPVKAEIKAVRVKGQRNVPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYAVEGEGSGANIRGSARGIPDSSKHKYHSFLGKIAYQINDNHRIGASLNGQQGHNYTVEESYNLTASSWREADDVNRRRNANLFYEWMPDSNWLSSLKADFDYQKTKVAAVNNKGSFPMDYSTWTRNYNQKDLDEIYNRSMDTRFKRFTLRLDSHPLQLGGGRHRLSFKTFVSRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNVFNRKYTTWDSLRGLYSYSTTNAVDRDGKGLDRYRAPGRNYAVSLEWKF

SEQ ID NO: 12620 - protein, 769 aa, Neisseria meningitidis
ADEAATETTPVKAEVKAVRVKGQRNAPAAVERVNLNRIKQEMIRDNKDLVRYSTDVGLSDSGRHQKGFAIRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTVEESYNLLASYWREADDVNRRRNTNLFYEWTPESDRLSMVKADVDYQKTKVSAVNYKGSFPTNYTTWETEYHKKEVGEIYNRSMDTTFKRITLRMDSHPLQLGGGGRHRLSFKTFAGQRDFENLNRDDYYFSGRVVRTTNSIQHPVKTTNYGFSLSDQIQWNDVFSSRAGIRYDHTKMTPQELNADCHACDKTPPAANTYKGWSGFVGLAAQLSQTWRLGYDVTSGFRVPNASEVYFTYNHGSGTWKPNPNLKAERSTTHTLSLQGRGDKGTLDANLYQSNYRNFLSEEQNLTVSGTPGCTEEDAYYYRCSDPYKEKLDWQMQNIDKARIRGLELTGRLNVDKVASFVPEGWKLFGSLGYAKSKLSGDNSLLSTQPLKVIAGIDYESPSEKWGVFSRLTYLGAKKAKDAQYTVYENKGWGTPLQKKVQDYPWLNKSAYVFDMYGFYKPAKNLTLRAGVYNMFNRKYTTWDSLRGLYSYSTTNAVEKDGRGLDRYRAPGRNYAVSLEWKF

SEQ ID NO: 12621 - protein, 769 aa, Neisseria meningitidis
ADEAATETTPVKAEVKAVRVKGQRNAPAAVERVNLNRIKQEMIRDNKDLVRYSTDVGLSDSGRHQKGFAIRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTVEESYNLLASYWREADDVNRRRNTNLFYEWTPESDRLSMVKADVDYQKTKVSAVNYKGSFPTNYTTWETEYHKKEVGEIYNRSMDTTFKRITLRMDSHPLQLGGGGRHRLSFKTFAGQRDFENLNRDDYYFSGRVVRTTNSIQHPVKTTNYGFSLSDQIQWNDVFSSRAGIRYDHTKMTPQELNADCHACDKTPPAANTYKGWSGFVGLAAQLSQTWRLGYDVTSGFRVPNASEVYFTYNHGSGTWKPNPNLKAERSTTHTLSLQGRGDKGTLDANLYQSNYRNFLSEEQNLTVSGTPGCTEEDAYYYRCSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNLFNRKYTTWDSLRGLYSYSTTNAVDRDGKGLDRYRAPGRNYAVSLEWKF

SEQ ID NO: 12622 - protein, 769 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYAVEGEGSGANIRGSARGIPDSSKHKYHNFLGKIAYQINDNHRIGASLNGQQGHNYTVEESYNLTASSWREADDVNRRRNANLFYEWMPDSNWLSSLKADFDYQKTKVAAINYKGLFPTNYTTWENEYHKKEVGEIYNRSMDTRFKRFTLRLDSHPLQLGGGGRHRLSFKTFASRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYSICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPVKNLTLRAGVYNLFNRKYTTWDSLRGLYSYSTTNAVDRDGKGLDRYRAPGRNYAVSLEWKF

SEQ ID NO: 12623 - protein, 768 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYAVEGEGSGANIRGSARGIPDSSKHKYHSFLGKIAYQINDNHRIGASLNGQQGHNYTVEESYNLTASSWREADDVNRRRNANLFYEWMPDSNWLSSLKADFDYQKTKVAAVNNKGSFPMDYSTWTRNYNQKDLDEIYNRSMDTRFKRFTLRLDSHPLQLGGGRHRLSFKTFVSRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNVFNRKYTTWDSLRGLYSYSTTNAVDRDGKGLDRYRAPGRNYAVSLEWKF

SEQ ID NO: 12624 - protein, 769 aa, Neisseria meningitidis
ADEAASETTPVKAEIKAVRVKGQRNVPAAVERVNLNRIKQEMIRDNKDLVRYSTDVGLSDSGRHQKGFAIRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTIEESYNLLASYWREADDVNRRRNTNLFYEWTPESDRLSMVKADVDYQKTKVSAVNYKGSFPIEDSSTLTRNYNQKDLDEIYNRSMDTRFKRITLRLDSHPLQLGGGRHRLLFKTFASQREFENLNRDDYYFSGQISRTTSSIQHPVKTTNYGFSLSDQIQWNDVFSSRAGIRYDHTKMTPQELNADCHACDKTPPAPNTYSGWSGFAGLAAQLNQAWRVGYDITSGYRVPNASEVYFTYNHGAGTWLPSPNLKAERSTTHTLSLQGRGEKGTLDANLYQSNYRNFLSEEQKLTTSGDVSCTQMNYYYGMCSNPYSEKLEWQMQNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNLFNRKYTTWDSLRGLYSYSTTNAVDRDGKGLDRYRAPGRNYAVSLEWKF

SEQ ID NO: 12625 - protein, 765 aa, Neisseria meningitidis
ADEAATETTPVKAEIKAVRVKGQRNVPAAVERVNLNRIKQEMIRDNKDLVRYSTDVGLSDSGRHQKGFAIRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTVEESYNLLASYWREADDVNRRRNTNLFYEWTPESDRLSMVKADVDYQKTKVSAVNYKGSFPIEDSSTLTRNYNQKDLDEIYNRSMDTRFKRITLRLDSHPLQLGGGRHRLSFKTFASRRDFENLNRDDYYFSGRILRTSSTIQHPVKTNNYGFSLSDQIQWNDVFSSRAGIRYDYTKMTPQQLNAECHACDKTPPAANTYKGWSGFVGLAAQLNQAWRVGYDITSGYRVPNASEVYFTYNHGSGNWLPNPNLKAERSTTHTLSLQGRSEKGTLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTEYEGYRFIKKVKDYPWLNKSAYVFDMYGFYKPVKNLTLRAGVYNLFNRKYTTWDSLRGLYSYSTTNAVDRDGKGLDRYRAPGRNYAVSLEWKF

SEQ ID NO: 12626 - protein, 769 aa, Neisseria meningitidis
ADEAASETTPVKAEIKAVRVKGQRNVPAAVERVNLNRIKQEMIRDNKDLVRYSTDVGLSDSGRHQKGFAIRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGNRGYPVEGAGKETNIRGSARGIPDPSKHKYHSFLGKIAYQINDNHRIGASLNGQQGHNYTIEESYNLLASYWREADDVNRRRNTNLFYEWTPESDRLSMVKADVDYQKTKVSAVNYKGSFPIEDSSTLTRNYNQKDLDEIYNRSMDTRFKRITLRLDSHPLQLGGGRHRLSFKTFASRRDFENLNRDDYYFSGQISRTTSSIQHPVKTTNYGFSLSDQIQWNDVFSSRAGIRYDHTKMTPQELNADCHACDKTPPAPNTYSGWSGFAGLAAQLNQAWRVGYDITSGYRVPNASEVYFTYNHGAGTWLPSPNLKAERSTTHTLSLQGRGEKGTLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNLFNRKYTTWDSLRGLYSYSTTNAVDRDGKGLDRYRAPGRNYAVSLEWKF

SEQ ID NO: 12627 - protein, 769 aa, Neisseria meningitidis
ADEAATETTPVKAEVKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTVEESYNLLASYWREADDVNRRRNTNLFYEWTPESDRLSMVKADVDYQKTKVSAVNYKGSFPIEDSSTLTRNYNQKDLDEIYNRSMDTRFKRITLRLDSHPLQLGGGRHRLSFKTFASRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGTLDANLYQSNYRNFLSEEQKLTTSGDVSCTQMNYYYGMCSNPYSEKLEWQMQNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPVKNLTLRAGVYNVFNRKYTTWDSLRGLYSYSTSNSVDRDGKGLDRYRAPSRNYAVSLEWKF

SEQ ID NO: 12628 - protein, 768 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYAVEGEGSGANIRGSARGIPDSSKHKYHSFLGKIAYQINDNHRIGASLNGQQGHNYTVEESYNLTASSWREADDVNRRRNANLFYEWMPDSNWLSSLKADFDYQKTKVAAVNNKGSFPMDYSTWTRNYNQKDLDEIYNRSMDTRFKRFTLRLDSHPLQLGGGRHRLSFKTFVSRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNLFNRKYTTWDSLRGLYSYSTTNAVDRDGKGLDRYRAPGRNYAVSLEWKF

SEQ ID NO: 12629 - protein, 768 aa, Neisseria meningitidis
ADEAATETTPVKAEVKAVRVKGQRNAPAAVERVNLNRIKQEMIRDNKDLVRYSTDVGLSDSGRHQKGFAIRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTVEESYNLLASYWREADDVNRRRNTNLFYEWTPESDRLSMVKADVDYQKTKVSAVNYKGSFPTNYTTWETEYHKKEVGEIYNRSMDTTFKRITLRMDSHPLQLGGGRHRLSFKTFAGQRDFENLNRDDYYFSGRVVRTTNSIQHPVKTTNYGFSLSDQIQWNDVFSSRAGIRYDHTKMTPQELNADCHACDKTPPAANTYKGWSGFVGLAAQLSQTWRLGYDVTSGFRVPNASEVYFTYNHGSGTWKPNPNLKAERSTTHTLSLQGRGDKGTLDANLYQSNYRNFLSEEQNLTVSGTPGCTEEDAYYYRCSDPYKEKLDWQMQNIDKARIRGLELTGRLNVDKVASFVPEGWKLFGSLGYAKSKLSGDNSLLSTQPLKVIAGIDYESPSEKWGVFSRLTYLGAKKAKDAQYTVYENKGWGTPLQKKVQDYPWLNKSAYVFDMYGFYKPAKNLTLRAGVYNMFNRKYTTWDSLRGLYSYSTTNAVEKDGRGLDRYRAPGRNYAVSLEWKF

SEQ ID NO: 12630 - protein, 769 aa, Neisseria meningitidis
ADEAASETTPVKAEIKAVRVKGQRNVPAAVERVNLNRIKQEMIRDNKDLVRYSTDVGLSDSGRHQKGFAIRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGNRGYPVEGAGKETNIRGSARGIPDPSKHKYHSFLGKIAYQINDNHRIGASLNGQQGHNYTIEESYNLLASYWREADDVNRRRNTNLFYEWTPESDRLSMVKADVDYQKTKVSAVNYKGSFPIEDSSTLTRNYNQKDLDEIYNRSMDTRFKRITLRLDSHPLQLGGGRHRLSFKTFASRRDFENLNRDDYYFSGQISRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNLFNRKYTTWDSLRGLYSYSTTNAVDRDGKGLDRYRAPGRNYAVSLEWKF

SEQ ID NO: 12631 - protein, 768 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYAVEGEGSGANIRGSARGIPDSSKHKYHSFLGKIAYQINDNHRIGASLNGQQGHNYTVEESYNLTASSWREADDVNRRRNANLFYEWMPDSNWLSSLKADFDYQKTKVAAVNNKGSFPMDYSTWTRNYNQKDLDEIYNRSMDTRFKRFTLRLDSHPLQLGGGRHRLSFKTFVSRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWHVGYDITSGYRVPNASEVYFTYNHGSGNWLPNPNLKAERSTTHTLSLQGRSEKGMLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKAKDAQYTVYENKGWGTPLQKKVKDYPWLNKSAYVFDMYGFYKPAKNLTLRAGVYNVFNRKYTTWDSLRGLYSYSTTNSVDRDGKGLDRYRAPSRNYAVSLEWKF

SEQ ID NO: 12632 - protein, 768 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYPVEGAGKETNIRGSARGIPDPSKHKYHNFLGKIAYQINDNHRIGASLNGQQGHNYTVEESYNLTASSWREADDVNRRRNANLFYEWMPDSNWLSSLKADFDYQKTKVAAINYKGLFPTNYTTWETEYHKKEVGEIYNRSMDTRFKRFTLRLDSHPLQLGGGRHRLSFKTFASRRDFENLNRDDYYFSGRVVRTTSSIQHPVKTTNYGFSLSDQIQWNDVFSTRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYSICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPVKNLTLRAGVYNLFNRKYTTWDSLRGLYSCSTTNAVDRDGKGLDRYRAPGRNYAVSLEWKF

SEQ ID NO: 12633 - protein, 362 aa, Neisseria meningitidis
AAVADVSLYGEIKAGVEGRNIQLQLTEQPSKAQGQTNNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINA

SEQ ID NO: 12634 - protein, 768 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYAVEGEGSGANIRGSARGIPDSSKHKYHSFLGKIAYQINDNHRIGASLNGQQGHNYTVEESYNLTASSWREADDVNRRRNANLFYEWMPDSNWLSSLKADFDYQKTKVAAVNNKGSFPMDYSTWTRNYNQKDLDEIYNRSMDTRFKRFTMRLDSHPLQLGGGRHRLSFKTFVSRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWHVGYDITSGYRVPNASEVYFTYNHGSGNWLPNPNLKAERSTTHTLSLQGRSEKGMLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKAKDAQYTVYENKGWGTPLQKKVKDYPWLNKSAYVFDMYGFYKPAKNLTLRAGVYNVFNRKYTTWDSLRGLYSYSTTNSVDRDGKGLDRYRAPSRNYAVSLEWKF

SEQ ID NO: 12635 - protein, 768 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYPVEGAGKETNIRGSARGIPDPSKHKYHNFLGKIAYQINDNHRIGASLNGQQGHNYTVEESYNLTASSWREADDVNRRRNANLFYEWMPDSNWLSSLKADFDYQKTKVAAINYKGLFPTNYTTWETEYHKKEVGEIYNRSMDTRFKRFTLRLDSHPLQLGGGRHRLSFKTFASRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYSICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPVKNLTLRAGVYNLFNRKYTTWDSLRGLYSYSTTNAVDRDGKGLDRYRAPGRNYAVSLEWKF

SEQ ID NO: 12636 - protein, 768 aa, Neisseria meningitidis
ADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYPVEGAGKETNIRGSARGIPDPSKHKYHNFLGKIAYQINDNHRIGASLNGQQGHNYTVEESYNLTASSWREADDVNRRRNANLFYEWMPDSNWLSSLKADFDYQKTKVAAINYKGLFPTNYTTWETEYHIKEVGEIYNRSMDTRFKRFTLRLDSHPLQLGGGRHRLSFKTFASRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYSICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPVKNLTLRAGVYNLFNRKYTTWDSLRGLYSYSTTNAVDRDGKGLDRYRAPGRNYAVSLEWKF

SEQ ID NO: 12637 - protein, 677 aa, Bordetella pertussis
DWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGAVPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 12638 - protein, 685 aa, Bordetella pertussis
DWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQVERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGGVPGGAVPGGFDPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVQLTLTGGADAQGDIVATELPPIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPGPQPPQPPQPQPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 12639 - protein, 682 aa, Bordetella pertussis
DWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGFGPGGFGPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 12640 - protein, 344 aa, Aeromonas hydrophila
MMKMAPSLIAIAMAAMGATAAHAADDIYFGAGAGAAHFNGLNKIGGGGYAGTEDAAAANAFVGYNFTENFGTEFGYQYAGRGNTDGLRYENQGATLSGIARLPLGGDFSAFAEGGAYWAHTDGLGTSDTKVSPLAGLGVTYKVNDALDLQARYRYMWDVADLHAGDAPDDVRYKSNQSVATLEAVYHPFRTSYVAPAPAPVVEEAPAPAPQVVEKNFALNSDVLFAFGKDSLKPEGVAALNGLYQQIVEFQPKDGNAVVVGYTDRIGSDAYNQKLSEARARTVANFLVSKGMAASKVAVEGRGEANPVTGTKCNGVKAKAQLISCLAPDRRVEVRVSGVQEVQK

SEQ ID NO: 12641 - protein, 667 aa, Aliivibrio salmonicida
MKTRFKRGSAVSLTALSLAFGAMLPAFAEDTLKIEETIIVTSSARAVDAMAQAAATPGGTDVITHEDYADRFLVSMRDTLAFSPGVYTQPRYGQEVRISIRGSGISRGFHMRGLTLLQDGAPINLADDNGDFQELEPIFFDHLEVYRGANALRFGSGTLGGAVNGVTPTGETAPGVYVRGDVGSFETYRGLVSGGMERGKLDAWGAVSADTSHGDRDHVRRDSVRFQGNVGYDVTDAVETRFYLSLNDIDQELPGALTLSDAVNNPRKGNFFGGQARDIKSVRVQNQTRIALGEGDLAIGVWVNDKDLYHPIFQVLDYSYLDKGVWARYDWARGPFALTVGAEAREGETDARRFVNNNGKRGALVFQADQDAWTANVYAEGRYSVTDQLTLIAGAIYAEGGREQQLNLNNGLPADVLGSAEFDELSPKFGALFEVSPDIQLYANYSRSAEFPGFSELAQIAAFVPVDAQTAWTAEIGTRGRAGIASWDVSLYSADIDGEMLQFTVNPDIPAATFNADETAHRGIEAGLELAFTDWLSLRQVYQYSDFRFEGDAEFGDNALPVVPEHVYRAELRFTGDRFTVAPNLEWVPEGAWADYNNTTRTDGYTLLGITGSYKATDKIDIFLDARNLAGDKAAGDISAVITATSASAIYYPVERRAVFGGIRARF

SEQ ID NO: 12642 - protein, 349 aa, Aliivibrio salmonicida
MKKTLLALAVPALLMAGSASAATVYTAEDGSTIDVYSRLGFNITDRNDDGDSVGNFDARIGLGGSQVVNDKVSVIGWAEYQVNAAEARGNGDWSPRYVWAGIDASEAGKVTFGRVASGIIMLSDIGDVFAASDVVLGRQLQLVDNSSAQTFRQDGTIQYQNSFGAFDMSVAYILGNTDSDQDGSYNAVGRYTFDLGDAGTLAPVLAYQANSTGDNAINPDADYTFWGAGLQYKLNALTLGAMYNQDEIEGVYSDKSTDKSYELTAVYNINDDWTARVGYRSLENSGGDEAEYKDTTFEVQYHLTERSSIYTSYVMRDGDNGNVTTAGPVMTDWNNAEEDYYHLGLRYEF

SEQ ID NO: 12643 - protein, 417 aa, Aliivibrio salmonicida
MNKKRLFSKTLLAATITLATQQATAAGFQLNAQSATGLGRAFAGDAVIADNASVMSRNAAAMALFDSSQFSAGVNYIKTDIDVSDITYAGAVPVDDANNSSGTPVPNIYYVHRLNDQWAFGAGIYSNFGTTNNFSDSFGAGSGGGMGPDATVFGGTTEIKSINYALTVSYRVNEQFSLGGGLDIIQGSGKLKRETGLPIPTLGTALDVEADGVGLGWNLGAVYELNERNRFGFSYHYSPEIEAEGDMYMNDMTGTGGNAIQGHTLLMPLPSMAEFSGYHEIKDTKFAVHYSVQWIGWSAFDELNTKEGVNLNSYEWQDGMHYAIGGTYFLNDAWTLRAGYMYDTAAQDKLTSISVPDSDRQWLSGGFSYHFEKKHTVDFGFTYLMGDDVDVNESNGALTATTHADAILAGVQYSYSF

SEQ ID NO: 12644 - protein, 950 aa, Aliivibrio salmonicida
MNNNKKTYGVGLKLSYLSVCLCSALATHALAAEEEDKQAADESIERVSVVGSNIKRAVDSGSLPVTMLTEEDIENTMAMSGDDLLRQIPQMGEVNFGASTGNGGVNDARGDVASINLRGLGTGNTLTLLNGRRVVTHPGTQTENFVPVTTVNSNALPISGLRSLEVLRDGAAAIYGSDAVAGVVNYKLKDDYEGHKVSFSYGGSEGTSLREGTMSYLGGISLNEGKTHLTGSLSYFDREGMMASERDYAKSHDLREYPTLPEGFIGDTQLDNRTTTTPWGEFRSGSLKTFHIQPDSMDGCVQDLGNGICADKGSLSRDLRFDRGTTRSLVSDVDRLNFYGYATHDLSDSLEFFSEITYYKANSERRREQAGNLTAQRFTIDENAYYNPFGESVDVRRYRPIDAGPRIINVENTSYRILGGFKGNFGDWDWDSAIFYTAAETNDVANRVQASKFQAAVNSTNPDLAYNIFNGGDINNPNAGDGTLNSQAVIDQFMVDVHRDGKTSLASIDFKVSNGQLWSLPSGDIGLAMGVEYRRETFEDIRDPLLNGSNPFVDAVTGEELSGSDVLGSSHTPNSDAARNVASVYAELLIPLLDSYSQYLELQIAGRYENFSDVGSAAKPKVALYWEPIDWLSIRASYAGGFRAPGLPQVSAEGVPRSNGLYDPVLDETYGIIDIRSGSTDLKPEESVNSSVGFVFNPTSNFTFTADYWQIEQENIVGILPGSSHLLYDSLLRSQGSSNPAVLRDDSTMEVIQINNDYLNLNIRNIEGVDFSFLYSLETDIGEWDFSANVAHLIKFYQDADPISAELIAAQEAGNPAVPADRTVAGAGDLIKENGRPEWRGRAEVNWRLDQIGAGVSYNYISDVIDTSATYTNDNEEVIKLPVDNFETINVYADYRFKGAHFLDNSKLRLGVRNITDEQPPLADELAHGYFGSLHSNRGRYFYMNFSKSF

SEQ ID NO: 12645 - protein, 343 aa, Aliivibrio salmonicida
MKKTLLALAIAATATSVNAAEIYSNDDTKVSLKGEIDVYLTQSEVDKSATETVKKEADVSTWAKIQLDAEQKLNVQFTAFASFEIETGETAAEDEVAQFDDAHVGFKTDTWGMAFGEVGDLAESADAIQKDDITNEGNYMGSTGGHHRESAGHGAVFKGQFVEGLTIVADINTESTDGVDNTYGISADYAFSNFSIGASYITGDAAKDVDYSLAGVSASAEFGGLYLAATYAQFEGNKGYGYWKITDVSGKYGNGETMGVAAAYQIDAVRLYTTYAVATTDEKATAGSTSKISDLDSTNLVVGVDYAFRDNILFLAEYQTADFETGTTTLDADGVTIGAYYTF

SEQ ID NO: 12646 - protein, 428 aa, Aliivibrio salmonicida
MKKPILAAILSATLAAPALSHAETLKDWLMQSQVSGNIRSYYFNQLYGGSSLPDKYAYSLGGMLRVQTAPVYGISAAVAFYTANDLGANDTGGGQSHLDPLLMGDRTSLNVLGQAYLQYQDPWVQLRVGNLLLNTPWMNPSDAFMIPSTFQAVAIRVTPIKNLQIIGIREFRFKNRIQADYHRQTLLNFNDHYSYLPDNSIGTLAFGLKGRLMGVHATAWFYRFYGLTNMFYGTLGYTTPTLVGHFRPFADFQYDREWANGAQLAGPVNSTVYGGMAGIQGDFDGVTGQIFAAYDQIPSRAVTLANGQTLYNGGFISPYTQQYSADPLYTSIMDYGLVDASASGHAWKFGFLLHPLRQVRIKYSYSMYDTAPYLPNVDANYLDVTYSPGGFWKGLSLRNRLALDHSNPYGGYHGTFIDDRLMLQYRFS

SEQ ID NO: 12647 - protein, 211 aa, Aliivibrio salmonicida
MKKYLFLLMAATSTATIAAPYVGLEYGLTNMSHDYSTTFSNDNVSLTPDDSSSAFGGFVGYRFNEFGLEFGYKKFESDDSRSQMLVSDKPGYTKEREWDADLDATQFTFKPVYFYNINEKVQLKTGLGLTYTQYKFDSSANTEYENDLTDHEFTQDYVAGDSKSESVFGGIASVGIEYMVIPNLALGASASYQVDSIANSTSFMLSSAYYF

SEQ ID NO: 12648 - protein, 250 aa, Aliivibrio salmonicida
MINIITRRPQEEQFLSTAEVGFNNLAFGEEESVGTDLRYGISGKEGNVDYRLSLSRTTTGDFYDAEGDLIPTDNRTLDNTESLGLLAKLGIDIDEAQRLEFNFTYNSDDRDIEILPVPNSDPNGKTLATRRTIGFSGATDPEIRSLSTYLTYTHDNLFLDSQVDVQAYYRNSFQSGIPSDARNDFFFDAIVLTRAEEEAFGGQLQIDTPLAENANLLWGADFEFQKNGASVTEEADPVAFDQDGIFRTIN

SEQ ID NO: 12649 - protein, 765 aa, Aliivibrio salmonicida
MSYLCRSAILRRTLLSLAIASVLPGLAHADEAFDLGRDDVVATTPLPGIDLPRDQVPANIRTLDDEQLRKLGGQSLAEKLQRGLPSVNVNEIQGNPYQADLNYRGFTASPLLGTPQGLSVFLDGVRVNEAFGDVVHWDLIPSTAIADMLLVPGSNPLYGLNTLGGALALQTKRGDTHPGGSAELYRGSFGRKGGALEHGGKHEELSWYLAAEGMEEDGWRDHSPSDVRQLFGKFAWTTDTTDVALTLAHADNDLIGNGLIPESMHHRSRQAIFTHPDQTENRSHLMALSASHWLSDSDRFSGTVYLRRTRTATLNGDGNDEYEDEYEQWEDDGFVGEAPESGVLNRTRTAQRAFGLALQWTHYVGAHQFAVGLAHDNTRASFHQSEQGGELTDSRGISTTEEEEQANSLLGRTRTSSLYATDTWSLTDDLQLTGSLRYNRTRVVNADRMGDALDGDFTYRKLNPALGFAWQLQPAVTLYGGFTQGNRAPTPIELGCADPDNPCSLPNAMAADPFLKQVVTRTLEIGVRGELAGGTRWNATAFRSMNHDDLLFVGTGGSMGYFTNFGRTRRQGIELGLAGQQGPIDWRLDYTYLHATFRSAACLLAENNSTAGEGGCPDDEIRVSSGDYLPGLPKHHLKLGLDWNIDERLRLGTSVLAYSSQYVRGNENNRHRANDEFEGRGRLPGYAVVNLTADYRLARDWTLFGRVDNLFDKRYATGGALAENPFVGAGNAFESDPDEWRHEQFIAPGAPRAGWLGVRYRWDAL

SEQ ID NO: 12650 - protein, 1087 aa, Aliivibrio salmonicida
MNKNVKRCALVAGAFAMVSMGNVYQVQASELHASEVLQQAKRQIKGKVVDAAGETVIGANVLEKGTTNGVITDIDGNFVLNVSSGATLEISYIGYVTQTIKVTNQTSLHIVLKEDSETLDEVVVVGYGTMKKSDLSGASVSVGEDAIKGSVITNLDQSLQGRAAGVSAVSTSGAPGSSSSIRVRGQATINSNAEPLYVIDGVIVQGGGASGADFGLGDALGNGSVSTISPLSTINPADIVSMEILKDASATAIYGAQGANGVILITTKRGKAGEAKFTYDGMLAVQRQTKRLDMMNLREFANYYNEFVQVGELDVNGYYADPSILGKGTNWQDAVFQTALQHQHQVSAEGGTEKIKYYVSASYMDQDGTLIGSNFNRYSFRVNLDSQLKSWLKLGLSATYSSTDEDLKLADGEQGIINYSLKTVPDIPIYDIDGNYATIVREGYTNPNPIAMAMMDQVLLNRQKLTGNIFFEVTPIKNLVWHAELGYDISASKGERYKPMVDFGSWKRDSNYSSIQKNSSTFWQLKNYVTYSGMIDKHNFTAMLGQECWASNYDNISVTNTSLPSDAVHNPALGTATPVIGSGFGSSAMASFFTRLTYNYDNRYYGTYTYRYDGSSNFGPDNRWAGFHALAGSWRFSNEEFFKPLSGVISNGKLRLGWGQTGNANIGGYLWGTSIVKMSSSLGTGYRPKNIPNTSIKWESQEQWNVGLDLGFIQDRINLVVDWYKKVSNDMLMALQLPSYMGTQGNTSSRLDPPYGNYGSIENAGVEISLNTHPLIGKFQWDSDFQISFNKNKLKALSGTANAQIVGYGQWNDVVSVSNVGESLYNFYGYVCDGVYQDYEDLQKSPKPEQYPSNGVFNRKNTVWVGDIKYKDISGPDGKPDGVINEYDKTNLGSPMPKFTFGWTNTFRYKDFDLSIFINGSYGNKVMNYLGMQLTHMNSAWENQLNSVTGRARLEPIDPDKVYPAGQYWYDDVTNVRVSNPEAVIPRASIQDPNDNDRISDRYVEDGSYIRLKNITLGYTFPSKLIKKFGINNLRLYANIQNLLTITGYDGYDPEIGASTQSTNVYGLDYGRYPSPTVYSFGLNVSF

SEQ ID NO: 12651 - protein, 694 aa, Aliivibrio salmonicida
MHITGKKVTHTLTPPAPVTPKHILTAITMAFSSTLTSMHVQAAGEINLPTVSVTANPLGVSSDDMVVPVSTLSGRELSLQRESTLGETLKSIPGVSSTYFGPNASRPIIRGLDGERVRMMQNGVGILDASSLSFDHAVPLDPLVIEQIDVVRGPAALLYGGSAVGGVVNAIDHRIPKEAINGVTGRSEVRFGGAENQKNGAVVVDAGNGVLTVHADAYKRKTDDLDIPGYAMSRRKSEQSGEARERKGRLVNSGSDADGGAIGASIALENGYVGMSYSTFNNKYGTVADPDVLIDMKSDRWDFASELRDLGRMISKVKVRMAYTDYKHQELEDGEVGTTFKNRGVEGSIEATHGNIGPLNGVVGIQFHNSRFQAMGEEAFVPSNRTNTRAVYLYEELPLDALKLTFGGRVEHAKIDSRGGDEFGPSQSKSFTPYSFAGGALFKLDEQWSVTANLSHNERAPSYFELYADGEHVATGQYEVGSSDLDKERSNGIDAQLRWKRHHHAFQIGAYYTRFNNFIGLFNSGELVNEDGIPGQADSVITEARFTGAKATFRGIEAEGKFRIYDKTGSLDLNLRGDYVRATNRDTGDPLPRISPLKLGFGLDYRFNRFGSRLDILRAFKQDRTDENELVTDGYTLVNATVTYKLPTSQHFQLEAFAKAYNLLDQTIRDHTSMLKDIAPMGGRSVLVGLRGDF

SEQ ID NO: 12652 - protein, 376 aa, Aliivibrio salmonicida
MKKTALALLASAFVASSASAVELFNLDSTGTKAEFIGSARLKWTSTSTKDTYQNGAAIRNHVNKPVQNNGSRFGFRLTQQLGSGFYALGRAEWRLRGADERGVSSSQHDLDHIYAHQLYAGLGHKQYGEVTYGNQTVITDEVKQTDIPNTLSLSDGLLVSGARRSVQYVYKGIEGLKVGAYYGGHSQRSNTNMDLSQDRKDVWGFGSIYNHKFDDVQSVQVATGFSRERFERIGSAPAYDRNAYSVGAAYTYDKTTFGVDLERRKTEDQSVQGNERTEKEVRTLVYHRLTDDWRAYGMYAYKTNRLERAIGRDNNERKHQFMVGTEYYLPKVVDQLKTKLFVEWQATRTKHPEAKVARGVNKSRDYTTVVGFRAYW

SEQ ID NO: 12653 - protein, 718 aa, Aliivibrio salmonicida
MTLNLQFCIPILCLFLLFFGELHAQTRTNGKITKPIPKTETTPADPKNETTQDPTNLKPNSQPGTEESKPEETAEEDRFKDLDNKNGIVVTGSRGERRLKDSAVATEVISRKRIEQTGARNLGEVLDTQIGINVTPFFGGSQVQMLGLDSKYVLFLVDGQRVAGRLNNTIDLTRFKVQNIERIEIVKGSSSSLYGADAIGGVINIITKQAEKPEHYQFRTSYGNGRQMNFGSQGEKNMIADVGFKNDFVATNFFGGFNQAGAYDLDPRTPATTGNSFQDNNLGGNMTFNPDGQFKVKTGINYLNRNQAGIDSRSTGGVFDRSNMTNDFLALGALEYTYGKRNMVSLRGNFSRWENHYKLDQRNSNELDVKEITNEFSSQGVAQIDHEIHKDHMITAGFESFSEELQTDRLERRNAYRTRRAAFLQDEWVVWRQGIVWRLVPGVRHDVDSQFGGQTTPKIATKVDITSNLVFRASYGKGFRPPSFRELYLRFENPGVGYVVEGNDKLRPEKSTTVNADIEYSPFKYWTLSLSVFRNDITDLIQYTFGTRTSEFANFQLKNVQRAYTRGVEAGSRVRFWKYFALELGYNQTDTRDLTTDRPLEGRALHQGTMNFFVNAPGGWEFALRAKRLDKRPFYSTTNEFTTGTSTALIDQQTRSVEENNKVVYGKPFTLLNVRMEKKFFEGRMSLFLGVDNVLDQYELTYNPIRPRFYYGGLQATF

SEQ ID NO: 12654 - protein, 404 aa, Aliivibrio salmonicida
MKRFIIIAMLTAIMPLAAMAQHEEDTENGVVSLAGREGFTIETKKGDFVFKPYLLVQTSANLNWYDDEGLDKAYNQDNIANSGFSVPYAVLGFTGKAFDKVSFNLSINAAASGGALLQQAWFDVQLKKQFAIRVGKFKTPFSHAYLTTLGETLLPSLPVSLTAPVILPYSLNAVTPNIGTGFDLGVEIHGLVADKFGYEIGLFNGTGAAVNTATKTFSDDWHIPSLLYAGRFTYMPKGVMPATQGNPNRLNEDKIMFGISTSINVESENESTNDYRAGLEFAMLKNKLYLGAEVYYMNVGFTKRQKISESYNYLGGYVQGGYFVAPRLQAAARYDFFNRNGMDTNGFLNMPAVGMNYFFKNCNLKLQAMYQYIARKGHDTQLDRDNDDLGLAVHSASILLQYTF

SEQ ID NO: 12655 - protein, 698 aa, Aliivibrio salmonicida
MFSKSPLALVIGAVLASPAVLAETVKTDEHMVVEGRDYGYKADTNTTAMRMEATQLETPGQVSVIDEQIIDEQRATTLGDVLKNDASVSAGGTSRNRERFSLRGFSVQSSSGFLKNGQQHWSHYRQPIELLERVEVLKGPSGLLYGISAPGGLINMVSKKPTYDTQVSLSQDIGSNDHTRTTLDVSGALNDAETLRGRAILSKESYGSWRTYGDGTEPQTERFVGGVFVDYDVTEDVTVSVHYDKTNDEGSVDSGALYTLDGNRVGSDKHIWDAQWSQIENDVENVGFDIAANLTDTWSLKTGFNYQDFERIDMESYPSFKNMNPDGTGTVTQGGNYRHDKWRFRTAYVDLTTTADLAGTEHQLLFGANWLGYSYYRGMDRFSSGEYAPDATVPAPSVGPTSLGKMSTYDTWGFYIQDLITINDEWQVLAGARFDRKVSEGVAEENVAPKLGVIYHPASNGSIYVSYSESFEPQGVVSSGSRNYTNDGELLDAATGVSYEVGTKWELMDERLFVSGAVFDITQENISMDVEDTSSGDWTKTQGGEQVHRGAELAAQGFISEKFSMSGSAMYLDAEITNHETYEGNRPVDVPEFAASVWSTYAATNEVDVNLGLIYEGSRYGDSANTFKKDGYARVDMGAAYTLKYDDSLDFVARLTVENVFDKEYLAGGGSTSSKHQFAEDVVIGEGRNYMATLQVKY

SEQ ID NO: 12656 - protein, 338 aa, Aliivibrio salmonicida
MNAKIIASLAFTSMFSLSTLLSPAHAEEQEKALNFGIISTESQQNLKPQWTPFLQDMEKKLGVKVNAFFAPDYAGIIQGMRFNKVDIAWYGNLSAMEAVDRANGQVFAQTVAADGSPGYWSVLIVNKDSPINNLNDLLAKRKDLTFGNGDPNSTSGFLVPGYYVFAKNNISASDFKRTVNAGHETNALAVANKQVDVATNNTENLDKLKTSAPEKLKELKVIWKSPLIPGDPIVWRKNLSETTKDKIYDFFMNYGKTPEEKAVLERLGWAPFRASSDLQLVPIRQLALFKEMQGVKSNKGLNEQDKLAKTTEIQAQLDDLDRLNNALSAMSSVSKAVQ

SEQ ID NO: 12657 - protein, 715 aa, Aliivibrio salmonicida
MKPTFIISLLLFSFIATCTTLAQHSTYHISGRVTDTEGEPLPGATISIKGKGTGAVTSVDGTYTLQLPGTGTYLITASYVGYQPQEKRLTVGKEKRLSFRLSEDQFDLGTVVVTGTRTPKLLKDAPIITRVITADDIKKVDATNVGQLLQSELPGIEFSYSMDQQVSINMQGFGGNSVLFLVDGERLAGETLNNVDYNRLNLDNVERVEIVKGAASTLYGSSAVGGVINIITRDSEDPWNLNVNSRFGEHNDQRYGGTFSFKAGKFNSQTNVQHTMSDSYDVPEGDVTTIFGNRTWNVKERLVYRPIEQLKLTARGGYYFRERDKTGDSKDRYRDFSGGLKANYDFNIMSNLEVAYTFDQYDKSDYLTPYKYDVRDYSNVQHSVRALYNYTFNDKNILTVGGDYMRDYLLSYQFTNNGSYTMHSADAFGQFDWNPTEHFNVISGVRFDYFSQSNVRHISPHIGLMYKIANCSLRGSYSQGFRSPTLKEMYMNFDMANAMMIYGNPDLKSETSHNFSLSAEYTKNRYNFTVSGYYNLVNDRIDLTSFRDTDGRWAQLYINTEKVDIAGVDINASAKYPCGLGIRVSYGYLHEFMRDGQMKFSSTRPHSATARIEYGKSWDNYQFNLSLNGRALSKVETNKYVGNNPDEGTTGVTYPGYTMWNLTLTQGIWKGVSLNMAVNNIFNYVPSYYDANSPYTRGSNFSIGLALDVDRFFRK

SEQ ID NO: 12658 - protein, 352 aa, Aliivibrio salmonicida
MNKKLLAAAIAAATFGTQAVAVELYNNDGTTFSMGGHVSVNLNGSEQGDTDVGTNSPRINISATQDLGNGFTADARGEWALNYLDGGEESFKTRLGYLGVTHEVYGRAVGGTQWSPYYDVAGIADMPIAFANDFIYDDHGNLGTGRADKMLSYRNAIELGEAGVINFGLGWQGANDDYTRNDAGVITGGAKYDDRVQAALSYSIMGAKIGYSYSGGDFQHPAYAGKHTAESHVVSASYGAYGQGLFLAAVYGSNENMNFSAKGDRLEESDAYEAIIAYALANSLNLSVNYEMVEGKEFKSSKTETAREEMALQAEYNFTPKFVGYAGYQFDLNDDNGRETDDKWALGARYYL

SEQ ID NO: 12659 - protein, 236 aa, Aliivibrio salmonicida
MKKLLLSALLLSNLVAFSTTNIQLLYGTFDGNSYVYDTKNGAKTTFTLEHYSAFEYGDIYGFIDYSVADDEFKYHNSKTDTYGEFSPRLNLSKITSTNLSFSIIKQVYLAYQYNASNTYNANLIGLGSDLSVYGFDVFGLNAYKKYQNIGEETYQLSPYYKTKKISDIFFIDGFIDWTEYDFLTQNQFLFDMKRPLKVENLFIGAEWHYYKQKPLNLNFNSRVESNTLQAMIKYSW

SEQ ID NO: 12660 - protein, 732 aa, Aliivibrio salmonicida
MNVSTEYSKFNVTLLATAIASSFLFPISAMANDDSASDDVETISIFGQAYRNTATKTSLEPEETPQGITVLDGEVLEQRSVKSLNEALRYVPGVTTEQKGGAVTMYDTFNIRGFDVNQSYYDGLVLQYLNGWNLQPQIDPIAIQQIEVFKGPTSVLYGSMPPGGMVNMIAKTPQKEKSTDVKVATGTGNLVEASIDTTGQFGDSDFSYRFIALARQKDGQVDYTEEERYVIAPSVDWQVSDRTLINFNMYYQNDPSMGMNSAMPASGMIYDNPNGSTDPSTFVGDKNWSTFEREFFMAGYKINHEFNNNWSFLQNFRYMNASLYQENTYHIQNAYTQDFDPSTGVLDRSIYSTDENSIGYTIDNQLSGRVMVGSVEHNLLFGIDYQKLDGDSRYKEFGKTSQFGDFNIFNPNNNMIDRGQLSNTADYKDEIGIEQTGVYFQDQVRIERLVLIAGGRYDKFTSDSDYRGKYEDKGVWYDYSKNDKASQSQFSYRVGALYELESGFSPFISYATSFEPVAGLDAQGNSYKPELGEQVEVGVKYESSDYTKVASASLFNITKSDAMMADPTDAYNPQLQIGEIRSRGIELQGQWMISDSWDIAANYTYIDMEITEDDTYNSEGKTPIYVPTHAASLWSNYYIYDGILTGTRISGGLRYVGEMEMDAANTDKVPDYTLADVSIGYELDGISESLTGATAQLSATNLFNTEYYSCYDSANCWYGAEQTVELSINYNF

SEQ ID NO: 12661 - protein, 747 aa, Escherichia coli
  misc_feature (254)..(254): Xaa can be any naturally occurring amino acid
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTXRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 12662 - protein, 968 aa, Escherichia coli
MHSWKKKLVVSQLALACTLAITSQANAANYDTWTYIDNPVTALDWDHMDKAGTVDGNYVNYSGFVYYNNTNGDFDQSFNGDTVNGTISTYYLNHDYADSTANQLDISNSVIHGSITSMLPGGYYDRFDADGNNLGGYDFYTDAVVDTHWRDGDVFTLNIANTTIDDDYEALYFTDSYKDGDVTKHTNETFDTSEGVAVNLDVESNINISNNSRVAGIALSQGNTYNETYTTESHTWDNNISVKDSTVTSGSNYILDSNTYGKTGHFGNSDEPSDYAGPGDVAMSFTASGSDYAMKNNVFLSNSTLMGDVAFTSTWNSNFDPNGHDSNGDGVKDTNGGWTDDSLNVDELNLTLDNGSKWVGQAIYNVAETSAMYDVATNSLTPDATYENNDWKRVVDDKVFQSGVFNVALNNGSEWDTTGRSIVDTLTVNNGSQVNVSESKLTSDTIDLTNGSSLNIGEDGYVDTDHLTINSYSTVALTESTGWGADYNLYANTITVTNGGVLDVNVDQFDTEAFRTDKLELTSGNIADHNGNVVSGVFDIHSSDYVLNADLVNDRTWDTSKSNYGYGIVAMNSDGHLTINGNGDVDNGTELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSVSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 12663 - protein, 360 aa, Escherichia coli
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRNEVTEANGDGFGFSTTYEYEGFGVGATYAKSDRTNNQVIYGNNGLNASGQNAEVWAAGLKYDANNIYLATTYSETQNMTVFGNNHIANKAQNFEAVAQYQFDFGLRPSVAYLHSKGKDLGVWGDQDLVEYVDVGATYYFNKNMSTFVDYKINLIDKSDFTKASGVATDDIVAVGMVYQF

SEQ ID NO: 12664 - protein, 836 aa, Escherichia coli
MASTVEYGETVDGVVLEKDIQLVYGTANNTKINPGGEQHIKEFGVSNNTEINGGYQYIEMNGAAEYSVLNDGYQIVQMGGAANQTTLNNGVLQVYGAANDTTIKGGRLIVEKDGGAVFVAIEKGGLLEVKEGGFAFAVDQKAGGAIKTTTRAMEVFGTNRLGQFDIKNGIANNMLLENGGSLRVEENDFAYNTTVDSGGLLEVMDGGTVTGVDKKAGGKLIVSTNALEVSGPNSKGQFSIKDGVSKNYELDDGSGLIVMEDTQAIDTILDKHATMQSLGKDTGTKVQANAVYDLGRSYQNGSITYSSKAISENMVINNGRANVWAGTMVNVSVRGNDGILEVMKPQINYAPAMLVGKVVVSEGASFRTHGAVDTSKADVSLENSVWTIIADITTTNQNTLLNLANLAMSDANVIMMDEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTAMWSSAINTRNNVTTDAGAGFEQTLTGLTLGIDSRFSREESSTIRGLIFGYSHSDIGFDRGGKGNIDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTSGVYQAGIRSSFTPTLSGHLSVSYGNGAGVESPWNTQAGVVWTF

SEQ ID NO: 12665 - protein, 365 aa, Escherichia coli
MKKLTVAISAVAASILMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRNGADNYTKGNGDGFGFSATYEYEGFGVGAAYAKSDRTDTQVNAGKLLPEVFASGKNAEVWAAGLKYDANNVYLATTYSETQNMTVFADRFVANKAQNFEAVAQYQFDFGLRPSVAYLQSKGKDLGVWGDQDLVKYVDVGATYYFNKNMSTFVDYKINLLDENNFTKALGVSTDDIVAVGMVYQF

SEQ ID NO: 12666 - protein, 199 aa, Escherichia coli
MRKVCAAILSAAICLAVSGAPAWASEHQSTLSAGYLHARTNAPGSDNLNGINVKYRYEFTDALGLITSFSYANAEDEKKTHYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 12667 - protein, 448 aa, Escherichia coli
MVMSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGKTPQGQALAATANGIDSNTKIAHLNGNQWGFGWNAGILYELDKNNRYALTYRSEVKIDFKGNYSSDLNRVFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 12668 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 12669 - protein, 632 aa, Escherichia coli
MRIHQLREIFMLTLKQLALSTGLLTFATLTLANGACAEGFNQFVGVGDSNLDSGYFRYHSTGIPDNDVAIVAAVAQGAKGGFAGNGLMSTTILAGKFGLSAAPIGGGGTNYAIGHSYAAIEVSVLVSAVQQMKNYLNSVNGVANPNALYVIKSGDNDLIKVQDELDKDPTWLDTRSTYLSDQAVALASEIKVLQSAGARTIIVPNSSYYAWSAVLGGELAPENIAGYQRSLDYETTLWSLLETKGVNFIPADMNSVIKYVVKNPTLFGFTEASVVPKASTVPSALIAILTPAAQQDDLYIDQAHLTTAGQTIVADYEYSLLVAPSQMSLITEGGVQGGLARTATIQRQIDLSEQHRGPNGINVWTSAGANYREIDNNAGFATASGTPINGSIGVDYQTSSGLIVGAAITASDQKQDFSTGGHYDQTDEAISLYTAFKAGSVWANAVATYGAFQNDISRPVQLGIFTDVNSSDPDGQSLAFALSMGNDFEFGSVTTGPVIGLVLQRVKLNSFTETGTTGLTALSFADIKRYSAVSQLGWSVSMDVDAWRPFAEAKWNHEWSERDDTVTASITTADAPSYSMDAVPAASDWATISVGTSYKLNSRVMLQGSFSVLAFASEVTSYGGELGLSISF

SEQ ID NO: 12670 - protein, 729 aa, Escherichia coli
  misc_feature (35)..(35): Xaa can be any naturally occurring amino acid
MLSTQFNRDNQYQAITKPSLLAGCIALALLPSAAXAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 12671 - protein, 773 aa, Escherichia coli
MQGKNTIVTTGDYSIGLLSQTSGNLNTDTIIRVNSDGSVTPSFSDGDDTFIVTAGNHAVGVLACASPGSARACVSSLDEESTADTGSNENNAIAKLDMAKGEITTHGTESYAAYANGTVVKAGDTLDYTNASVTLTDVDITTHGDNAHAIAARQGTVSFNQGEIYTTGPDAAIAKIYNGGTVTLKNTSAVAHQGSGIVLESSINGQEATVDILSGSSLRSANEILYHKNETSNVTITDSEVSSAADVFINNIKGHLTVDATNSKITGSANISTDDNTHTYLSLSDNSTWDIKADSTVSNLTVDNSTVYISRADGRDVEPTRLTITENYVGNNGVLHLRTELGDDNSATDKVVINGNTSGTTRVKVTNAGGSGAYTLNGIEIISVEGESNGEFIKDSRIFAGAYEYSLTRGNTEATNKNWYLTNFQATSGGETNSGGSSAPTVAPTPVLRLEAGSYVANLAAANTLFVMRLNDRAGEMRYIDPVTEQERSSRLWLRQIGGHNAWRDSNGQLRTTSHRYVSQLGADLLTGGFTDSDSWRLGVMAGYARDYNSTHSSVSDYRSKGSVRGYCAGLYATWFADDISKKGAYIDAWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWIHNSKDFAVSMNGVKVEQDGASNLGEIKLGVNGNLNPAASVWGNVGVQLGDNGYNDTAVMVGLKYKF

SEQ ID NO: 12672 - protein, 3710 aa, Escherichia coli
MNTIFKVIWNASLNVWVVVSELAKGRIKTKSSRNLISEGVLPKFEQSMVSKLFRKNLLALSLGSIVFLSTGPVFAADITVSTQAELSAALSNGTYDKIILGADITLIGSLTVNMTSNQVVIDGQGKFGLTVNNTTNYGLVVSSGSGTLTLQNMSKIDSANYYSMVVLNGANTAVNVIYNNIDFLGSSQLIYMGAYGAATNSIMTFGDILNDVVVNDRAQEIGEVNKLAFTGRFHVTHTGSSVTSFVSTGGANNTSTMDFASGADVKIDRTGSTGDLTSTGVNAFAYTFADGASFELIANQNVFSGTTTNRGLEIGSYNSIDGFGSGVKIVLQSRSDGSIISGNGIDNATTNAAGINNNASGDANVIYNLGTGSILKATNTGILATKNANNASSIYIRSAGDITAATGISATHNGTGTVKIKNDGTITSTTAGIAISSASIKEISVDNTDGTITATAGTGVNVLASAILNLFGGTINTSATANGITFAGTEGGHTLTDLTINLLGTGIALSNVAGVNLTLSNVTLNTLNGTALNSLTGLTLVDSLNGRNTINIEGAGIGIAATNTELNTFDAEALDINVNGAGIGIQATGGGVNLNASNLIINVANTLGTALQITDGIDNTTTIGNEIQLNAENATAINFLGSSSKTLNNKGTIKGSVIFAGVADHIINNNGTLDGTLTTGAGNDTLVLDSSSQSNDVINLGDGNNSVTIQNGATVSSIITGNGNDTFTINGMSVGSRTYLGSLDAGTGLNTLNFNASTDELAAATSLQGFTNINLVDSHITLVSDDNIGSGMVNIDSSSELLFGSTFDGILHATLGTGTGSAIVNNSANVSLEQASMFAGTWQVNQGGALTASNSNQLGSAKIGLDGTLNLDNIALFNHVLTGNGTLNVAKNLATTAFDFGSTVGGAFSGIVNLTKTTFALSADNAAALASATLKLSDDSVTTVGTTDRTLHGLDLSGGTLIFDGAVPQSQTSGVVTVTDLALNSGTVNITGSGSWDNTDPLATNVSILEQDRAGSTLELINATNVTGDVDALDLLVNGTAITSGTQGVQSAIQQGGSTVANAIHNYGLASSNSNGDSGLYVNYTLSALELLADGADALLLATESGLTANRVLNAELFGVGGLVVDAQNGALTLANGSNRYEGTTTVTAGELILGANGAFGQTSLLDIASGASANINGYSQTVGAVTNVGTVTLGSGGVLTSGLLTNGGILDLTGGALNLTAGGSSTVAGGLTGAGTLNINGGNLAVSAANSGLSGQTHIADVASVTLTDTGTLGTSAVEVLGTLNLNGANAAMTNVLSGGGVINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVGNTVKVDIADATLNLNDIALFDHVLTGNGTLNVAKNLASTAFDFGSTVGGAFSGIVNLTNTTFALSADNAAALARATLKLSDDSVTTVGTTDRTLHGLDLNGGTLIFDGSPPQSQANGVVTVTDLALNSGTVSITGVGNWENESPVTSPNVSILEQDRAGTTLELINATNVTGDVDALGLMINGTAITADSQGVQSAIQQGGTTVANAIHNYGLASSNGNGGSGLYVNYTLSALELLADGANALLLATESGLTANRVLNAELFGVGGLVVDAQNGALTLANGSNRYEGTTTVTAGELILGANGAFGQTSLLDIASGASVNINGYRQTVGAVTNTGTVTLGSGGVLTSGLLTNGGGLDLTGGTLNLTAGGASTVAGGLTGAGTLNINGGNLSVSATNSGLSGQTHIADVASVTLTGTGTLGTSAVEVLGTLNLNGANAAMTNVLSGGGVINTNAAVTLSGNNSFSGAHQIGTDGALTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVGNAVTIDIADATLNLNDIALFDHVLTGNGTLNVAKNLASTAFDFGSTVGGAFSGIVNLTNTTFALSADNAAALARATLKLSDDSVTTVGTTDRTLHGLDLNGGTLIFDGSPPQSQANGVVTVTDLALNSGTVSITGAGNWENESPVTPPNVSLLEQDRGDILLQLIDAANVTGNANDLDLVVDGTAITSGTQGVQSAIQQGGSTVANAIHNYGLASSNSNGDSGLYVNYTLSALELLADGANALLLATESGLTANRVLNAELFGVGGLVVDAQNGALTLANGNNRYEGTTTVNLGELILGADGAFGQTSLLDIANGASANINGYRQTVGAVTNTGTVTLGNGGELTSTDTLINTGMINVTDGILNLENGGASSISGGLTGNGILNIKGGDFTISIDNNGLAGQTNISDGASVTLGNGGTIIGTGNLGSSVIDVLGDLNLVADNSLANVISGDGTINTTATVTLSGNSSFSGAHQIGTNGELTVGQASNLGASSATVNLGTLTSHLILNGVSESIANVLSGVAGSTVDIIGGADTALTANNSGFLGQYALAGNSKLTVASTNNLGASSSVTLAGAGDTLSLSGFNGTFGNSVTGSGVLQVTDDAEVTLTSSNGVSNAVTIDIADATLNLDDIALFNHVLTGNGLLNVAKNDASTAFDFGATVGGAFTGTVNLNNSTFDLSGNNTTVLAQATLKLSSGNLTSVGNGVQNIGTLAMNGGTLLFDNIVDNAGIITSDGTIAANSINTTGGGEVRVNLPSNLAPSLDGLSVMELDEGEIIVTLATGAATGTGHELTLTDENGDPISAVTYQGVHNAGSTSAAATGSFNYGMTTGEDYDGLYVNYGLTALELLSTGSEALVLTAILANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGGGELVLSGGLLNVSYDNTGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILNTGSVWELTNTISGTGTLVKSGSGTVKIEGDTVSAGLTTIEEGLLQLGSSAVTQTLSLEESLQEDALLVSFASNMANLTSNVLITANGSLGGYGQVTGNVENHGNLIMPNALTGGDFGTFTIDGNYTGDEGMITFNTILAGDTSVTDRLVITGGTAGQSYVTVNNIGGVGARTFEGIKIIDVGGDSAGQFTLNGRAVGGAYEYFLYKGGASTPDDGDWYLRTQADDRRPEPASYTANLAAANNMFVTSLSDRMGETLYTDVFTGEQKTTSLWLRNEGSHNRSRDDSGELHTQDNRYVMQLGGDVAQWSRNAQDLWRVGVMAGYANSSSSTVAKVAGYRSTGSVDGYSVGIYGSWLADNADDTGAYVDSWVQYSWFDNNVSGQDLAAEKYDSKGFTASVEGGYAFKVGESVNQSYFIQPKAQVVWMGVKADDHTETNGTVISGDGNGNIQTRLGAKAFINPSDKAKVSGPAFKPFVEANWIHNTKDFGTTLDGVTVKQAGTANIAELKLGVDGQINNQLNLWGNIGQQVGNKGYSETSVVLGVKYNF

SEQ ID NO: 12673 - protein, 955 aa, Escherichia coli
MGIKQHNGNTKADRLAELKIRSPSIQLIKFGAIGLNAIIFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSGSDATINFSGTAAQRNSIFSGGSYGASAQTATAVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAQNGFYSDLVIKASRQKNSFHVLDSQNNGVNANGTANGMSISLEAGQRFNLSPTGYGFYIEPQTQLTYSHQNEMAMKASNGLNIHLNHYESLLGRASMILGYDITAGNSQLNVYVKTGAIREFSGDTEYLLNNSREKYSFKGNGWNNGVGVSAQYNKQHTFYLEADYTQGNLFDQKQVNGGYRFSF

SEQ ID NO: 12674 - protein, 700 aa, Escherichia coli
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 12675 - protein, 790 aa, Escherichia coli
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGNVSHQPYFGAEYIYSDAWTERHNQSESYVINAAGKKTNHTIYHKGKGSLGIDNYTLYMADHISWRNVSLMPGVRYDYDNYLSNHNISPRFMTEWDIFADQTSMITAGYNRYYGGNILDMGLRDIRNSWTESVSGNKTLTRYQNLKTPYNDELAMGLQQKIGKNVIARANYVYREAHDQISKSSRTDSATKTTITEYNNDGKTKTHSFSLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 12676 - protein, 1327 aa, Escherichia coli
MNRIYRVIWNCTLQVFQACSELTRRAGKTSTVNLRKSSGLTTKFSRLTLGVLLALSGSASGASLEVDNDQITNIDTDVAYDAYLVGWYGTGVLNILAGGNASLTTITTSVIGANEDSEGTVNVLGGTWRLYDSGNNARPLNVGQSGTGTLNIKQKGHVDGGYLRLGSSTGGVGTVNVEGEDSVLTTELFEIGSYGTGSLNITDKGYVTSSIVAILGYQAGSNGQVVVEKGDEWLIKNNDSSIEFQIGNQGTGEATIREGGLITAENTIIGGNATGVGTLNVQDQDSVITVRRLYNGYFGNGTLNISNNGLINNKEYSLVGVQDGSHGVVNVTDKGHWNFLGTGEAFRYIYIGDAGDGELNVSREGKVDSGIITAGMKETGTGNITVKDKNSVITNLGTNLGYDGHGEMNISNEGLVVSNGGSSLGYGETGVGNVSITTGGMWEVNKNVYTTIGVAGVGNLNISDGGKFVSQNITFLGDKASGIGTLNLMDATSSFDTVGINVGNFGSGIVNVSNGATLNSTGYGFIGGNASGKGIVNISTDSLWNLKTSSTNAQLLQVGVLGKGELNITTGGIVKARDTQIALNDKSKGDVRVDGQNSLLETFNMYVGTSGTGTLTLTNSGTLNVEGGEVYLGVFEPAVGTLNIGAAHGEAAADAGYITNATKVEFGSGEGVFVFNHTNNSDAGYQVDMLITGDDKDGKVIHDAGHTVFNAGNTYSGKTLVNDGLLTIASHTADGVTGMGSSEVTIASPGTLDILASTNSAGDYTLTNALKGDGLMRVQLSSYDKMFGFTHATGTEFAGVAQLKDSTFTLERDNTAALTHAMLQSDSENTTSVKVGEQSIGGLAMNGGTLIFDMENGGTVQMNSEGGKPGNVLTVNGNYTGNNGLMTFNATLGGDNSPTDKMNVKGDTQGNTRVRVDNIGGVGAQTVNGIELIEVGGNSAGNFALTTGTVEAGAYVYTLAKGKGNDEKNWYLTSKWDGVTPADTPDPINNPPVVDPEGPSVYRPEAGSYISNIAAANSLFSHRLHDRLGEPQYTDSLHSQGSASSMWMRHVGGHERSRAGDGQLNTQANRYVLQLGGDLAQWSSNAQDRWHLGVMAGYANQHSNTQSNRVGYKSDGRISGYSAGLYATWYQNDANKTGAYVDSWALYNWFDNSVSSDNRSADDYDSRGVTASVEGGYTFEAGTFSGSEGTLNTWYVQPQAQITWMGVKDSDHTRKDGTRIETEGDGNVQTRLGVKTYLNSHHQRDDGKQREFQPYIEANWINNSKVYAVKMNGQTVGREGARNLGEVRTGVEAKVNNNLSLWGNVGVQLGDKGYSDTQGMLGVKYSW

SEQ ID NO: 12677 - protein, 373 aa, Escherichia coli
MRKLAVAVALASTTLASPSMARDDSWYVGVGAGAMLVEDIDLDIGTFNNAGSLDHRAGYDFEGTVGYDFGGFRAEVEVGFREADIKSGRFGNPGIPQTASGAGTLFTGSTDLNGDSNALSFMVNGMLDFGDDDGLQGFVGGGAGVARVSVEPVFAGPFLDDSDTGFAWQAIAGVRAPLSSNWDVGLKYRFFNADNVDLVDQAGRDVSTRFRSHSILGTLTYNFGGAPEPVAPPPPPPPPPPPPPPPPPPPPPPVVECAPGPYIVYFDWDQSNITPEAASTLDNAISAYNRGCTGTQIMLAGHADRSGSARYNVGLSERRNDAVRSYLTARGISDGSISAQAFGETRPAVATADGVRNDQNRRVEITYGPNSGM

SEQ ID NO: 12678 - protein, 421 aa, Escherichia coli
MRKIVAMAVICLTAASGLTSAYAAQLADDEAGLRIRLKNELRRADKPSAGAGRDIYAWVQGGLLDFNSGYYSNIIGVEGGAYYVYKLGARADMSTRWYLDGDKSFGFALGAVKIKPSENSLLKLGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQLTWNAPWGSVFGSGGYLRHAMNGAVVDTDIGYPFSLSLDRNREGMQSWQLGVNYRLTPQFTLTFAPIVTRGYESSKRDVRIEGTGILGGMNYRVSEGPLQGMNFFLAADKGREKRDGSTLGDRLNYWDVKMSIQYDFMLK

SEQ ID NO: 12679 - protein, 732 aa, Escherichia coli
MSAAIAPLGLLPAALLCALSTLAPAAHAAESADATNATTLDQVSVNGTVSRAQPATTTRLPLTLQETPQSVSVIGLQRLEEQSLFSIDDVMRNVTGVNVSFYDTQRPLYFARGFQITDFQVDGLPTYSGATNQEYDTVFYDRIEVIRGANGLLTGAGIPSATVNLLRKRPGKDFDAAFGVSAGTWDFRRMQADVNAPLTEDGRFRSRVVAAWQDRDYYYDRYHDSKMSGMAVLEGDLTDSSTLTVGYQRQDNTPVGSTWGTVPFFAADGSFANLSRSTNMAPEWTRWQRETSTAFANLEQRFGQDWLLRVNAAHTKGAVQSLRVYGTGYPAADGSGVFLRANAGETQDTRDSVDVYLSGGFALFGRQHDVVIGGSWQDLQSTTYTLAQTYPDDWATCGSERCYFIPNIRHWNGDASEVTYTRTGARRQARTTQRGVYASTRLRLADPLSLIAGARLSSWETRTQAFNASGSYTGTSGRYDVSDEVTPYVGLVYDIVPDVSVYASYTEIFNPQNYRDKDNNLLAPVEGSNLEAGIKAQLFDGHAMATAAVFEAKQDNYAVRDMTQPEASLPDGSSAYIGVDGTKSRGWEVDFNGEVLPGWTINAGYTHVKVTRAPTDAIYANLPEDYLQLSTQWRLPGTWDRLSIGGGVSWQSAVRGFNIARPTGDGTGATTPVTVVQNPYALVHFNANYRISDQWTATLAVRNAFDKTYWANLDYQNYGEPRFVSVSLRWRY

SEQ ID NO: 12680 - protein, 237 aa, Rhodospirillum centenum
MSRGFKLSVLAAAVMAVAPAAQAFEAGDFVLRAGAVHVAPDDSSDSITVGGAPLLGAGVDSKVSVDTNTQLGLRATYMVTNHLGLGVLGATPFKHNINGGGDLPGDLKLGETKHLPPTLTLQYFPMASSSAFQPYAGVGVNYTVFFEEKTSSNLDTALNVASSELELDDSVGVAVEVGMDYMLSENFGLNAAIWWADINTDARVDVFDANGTKLAETDEFEVEIDPMVYMVGFTYKF

SEQ ID NO: 12681 - protein, 401 aa, Rhodospirillum centenum
MRRPNTWATKISQSVDKESVDMKMKLFAAAVAALAAGGAYAQSSVTLYGVVDAGVEYANHQPGVSGSHDVVRLNSGGMSGSRWGLRGVEDLGGGLKGVFVLESGFNVDTGTSGQNNRLFGRQAFVGMQSQFGTLTLGRHQTPFYDFGLAFDPMAISPNYSITAQAPEFQQRADNSIKYIGTFGGLTGSLLYSTGSNTAGTASVYQGISGEVPGNYHLGREMSASVMYNGGPFSVGAIYDETNVGIAAADGAKIRRTSIAGTYAFGPAKVFAGYRYAHAQGGAVLPGGVNTVDGAAKIANVSNLYWLGMGYQLTPALSLTGAAYYQDFRNTGADPWSFVVSTDYAFSKRTDAYFNVAYTKNKDGSTLGTSSASPGSLGGSGFGTTLGSYNQFGAMVGLRHKF

SEQ ID NO: 12682 - protein, 971 aa, Rhodospirillum centenum
MRGKLSLLAGVCVAAISTPVFAQSANENVGLEEIIVTAQRQAQSLQAVPIAVSAFSAENLEKQQIQNSSDLQLSLPNVTFTKTNFTSSSFTIRGIGDLCVGVSCDAATGIHLNDMPMVSSRLFETEFFDLERIEVLRGPQGTLFGRNATSGVVNIITAKPDLSGFGASGEADYGKYNSVRVKGMINVPLGETLGVRVAGMYTKRDGYTYNIGSNSRIDGRDMYALRGSLRWEPSPDTTIDLSAYYFREKDSRSRVQKQLCHRDPTGILGCLPDKLANETTNADSTLAALLTSKEFFGIAVAPSFAALGLGSIYGDDGDNFSGAVNPSDVRTVNIDYLPTYFAEEEVYQGKLQQALGNNLTLNVTAGYSRNEVRSRTDYNLATERSLVGNAGLYALAAFAQSPTLGFAFAPIAARLIPNGPTGQICQSDIDPNNVGVFGAGNKAICANTSLDFDESSQTYQQYAAEAHIDSDFDGMFNFLIGANYLRGVTTNNSYYVNSFGLDYASGLLGAAAATTGAFGANAVFRPSPFFRSNTDKGTLDSYGIFGETYFKFNDKIKLTLGLRYNHDKKFTRARTTLLSDGLSSEFAGGNAIYALVGAASLEDALNWATADFDKGTDDVQAFQERSVSFGRMTGRAVLDVQLTPDNLLYLSYSRGYKSGGINPPLSVGSVNDSFKPESVDAFEIGSKNRFGALQLNLSAFYYRYKDLQLSRITARTSVNDNIDANIYGVEAEAIMAPTRNLLVNFSASYLKTKVVGDQFFVDTRDVSAGRSDTVIIKDITLGSNCAVTGASAAAANAFVNTINSGVGLRGTTPIPGTNTTGAFSICGVLATQAAAVGSAFGGITVSSGIEKNVRGNQLPQAPEFKWSAGIQYTLELGGMTLVPRFDINYTGESYGTIFNGNINRIKGYEVMNAQIQLNGRDDRWFLRGYIQNIGNNNATTGLYVTDQSSGLFTNIFTLEPRRYGVAAGFKF

SEQ ID NO: 12683 - protein, 923 aa, Rhodospirillum centenum
MRRTRDSHNRSQLMLAAGATALMVAAGAQAQVRKFDVPAQPAVTGIPQFGQQAELQILAPQTAVQDKRVNAVRGAYTADEGLTRLLRGVGLTVVSNNGRTVVLNQSAQGADPAADPAPPQDQTIVQEVVVTGMTSRNRPLITASADITLASRADIERKAPRSTADLLELVPGIFVEGTAGELSNNYSVRGLQGGGQRFIQLQEDGLPIIYQGGGADFFFSEDATIDRMEAVKGGTSGILTVNGAGATVNFISRKPNFEKPEGMVRASGYDYGLKRGDFYYSAPIANNLAFNVGGYVQSSPGVRKNTFDYDGYRLKAMLEYRFDEGGYLRVTGKAGDMKSAYYADQPYAYSNGKPRGVPGLDTQFGNIGGDAFNRISVPVSTFVESDGFRDFRLSEGVRVKTKQLRIDFERPLNDSVEIFARARYLDLKDDFNGIFPGSGTGNAGLTSAVNYLTPGASSPINNLLTAGQAAYPATVRFGAKNLRTGVVIASNDTATLNALNGNGFLQETTLNHDYQSGHDFGANIGTRWEYQADGFQNSLTAGVQYYDVSRSQNQSAVATVVNDVRTNSDLYDIVSLDANNQVIGVLSDNGLVSYGDWGAGMRRRTDKSVSLYANDELAIGDKIHIDGGVRWESDKARYLEGNTAAVNQPVQPGVVGVVRTVGSTFDGTYTERRKTQDKIAWSIGASYLFTPHFSLYGRYANGFQTNNTDPITKIELYEAGLRFEYGRVFSGSATVFRTNFDNQFYNFIDPSDPTRQTSYLADLRTKGLEIDALVRPVDWFSVNVSGVLQDPTLNNLSLNGVAQPTYDGNRPERTPARLYTITPTIKLPNDRGEIYARYKYVGKIYADAGNGVALPSYGVTSAGVTLNLKDNLQVNLNVDNIFDVIGLTEGNPRQGQTQNASSGYFYARGIVGRTYGGSLTLRF

SEQ ID NO: 12684 - protein, 1103 aa, Rhodospirillum centenum
MRKVLSISFTLVFMLGLIAIAQAQDRVVKGVVTADGLPMPGVTILDKSNQKGTTTNVDGEYSITVGANSVLVFSFIGYDTQEVTVGNQSEINVNLEENTSELDEFVVTAFGMDKKEKSLGYATSTIVSDDLIKTGTPNVVSALYGKAPGVRIASGAGGATSAVNIQIRGINSITGKNQPLIVLDGVPIRNEEVSNNNYWGDQRLRGNGLLDINPADVENISILKGASAAALYGSEAVNGVVLITTKKGKVGRDGMQVDFNANVTMDEIAYLPRYQNVRGPGFPNHVANLGQAEDGFNYTEDGIRTVPNTTNNFGPEFDGQPMLAWDGISRPYNAQEDNYAALFNSPISSQINVAISNATEKSNFRLSLTRQDNEALSLNSKNSKNIVNLNASYNVSKRIKTDLMINYINQNTKNRPYSIDRMINNFGGMMTRFDNGAWYLDKYQTSRGYRFVTGNGQSLTPDENITGSGFLSAIADYAWRVNKNLSSEKSNRVIGSLTNHFQITNDLKLRARISTDFTNRYNENSNYSTRPLAFGPSGGFGMSTELFSILYGDLLLSYTKSITDEISVSAMAGYTARRESFRSIGRSTNGGLSTENLFDIVASTNIPNSSSDRTNRVIDAFLGTVNFDYKNIWFVEGTIRRDRVSTMNPDNNAFIYPSVNTSFAISDAITLPQFITFSKLRGSWGIVGNYPDVYRANIAYNQNSLGEQQPGGANVLYTNLSSSFGNDGIKPEQKHEFEFGLDTRFFNNRFGLDISYYNAQIRDQILPLTLPNSSGASSVLTNIGTLRNTGVEVGLNGAIVQTPDFNWNMTLNIAKNVNKVEKLANNATELLHADYDGNAAQLRSVVGRPMGDFFAHPIERDDNGNKIVQPNGLYKIDADNWIQVGNAMPDAVGGIINEVSYKNFSLYAVLDFQIGGSVMPTGINWMISRGLTEASLNNMNEERGGLAYYQNADGQGVQVDHSTAQGPNGETVYHDGMLMDGVVADGSTNSNVISQAIYYNSTYNWGGPQYSQSRYELYIQDNDYLKMRELSLSYNIPPHITDKIGASNVNISVFGRNLFFLYRNIKDLDPEVLTGGSRWTQTLTSAGTNPATRTFGVKLNARF

SEQ ID NO: 12685 - protein, 665 aa, Rhodospirillum centenum
MHRHAACLLLATLVSVGASAQNIDGDDGPVMLEPLSITARPPGSQSLEHTAQPVSILSGEELERRQANTLGETLNREPGVTGTQFGAGASRPVIRGLGGPRVRVLRDGIGTLDVSTISPDHQTSVEPFQAEQIEIMRGPATLLYGSGLSGGLVNVTTGRIPEYVPEFEANLRGQYESANNGKLGGVRVRGGFDQLALHFDGLTRDTDDYRAANGTVKNSFVETQEANLGTSWVGSRGFFGFSFGRYQTKYGIPIDPQEPDEAVFIDLDQNRWDLAGRLDDPFAGLRSISIRAGYNDYHHTEFEGPGEVGTVFKNKAWEGRLEFNHKPVGPLTGTVGVQYVHRDFKATGEEAFVQPAKQRTVSMFLFEDTDWRDWHFEVGGRVEHQAIDPSMTGDNDINHTVYSLSGGAIWNFTPGYAVGLTATRAQRPPALVELLVGGPHFATGTFEIGDTRLNAETSNNLDLSLRKTDGRLTWRANVFVNLIDNFIFAQSQDRDGDGSADRVDDEGNPGGNLLLVDYTQTDALFFGAEMEALYGLFDNANGTLDARLFGDWVRGQLSGGPDLPRISPARLGFGLDYHRGPLEANLETTQVFTQNATAPLETRTGGYTMLDLGLSYTLYVDPLETKVFLRGRNLLDETARRHNSFIKDRAPLQGRSAIVGVNIQF

SEQ ID NO: 12686 - protein, 714 aa, Rhodospirillum centenum
MPPSRRFGFLASTVLSSTVCAGLLTPSALRAQQAVALDEISVTSPSPIQPSRGAVAADAAVPIGVLPVATNTFSPVTVVTQDQIARDQPRTLGDALFDRPGISGTTYAPGAASRPIIRGLDNARVRIQENGIVNGGVSDLGEDHAVPVNPLVADRIEVIRGPATLRYGSGAIGGVVSADNNRVPTFIPANGVQGQVTSGFSSVDNGRLGAATVDAGGDGIAVHADGFKTANDSYAIPGGIQRNSYNESQGGAVGISAIGDRGFVGISFSHYDAVYAIPGGVAEQDRTRLTPNQDRVLSRGEYRPLDGPFEVIRYWAGYSVYRHNEVGIGDDGIEGVQAIFKNREAEGRLELQHVPVFTEFGKLTGALGFQSDRRVINTQLESFLPKTESRANAVYLFEELELQPGTRLQAAGRYEVDRLSSTAAQFPADYVPIDGQEPFQYARTRRFAPKSASIGALQDLPYGFVASLTGSYVERGPTGYELFSQGPHDATATFEIGNPNLKKERARTIEASIRRAEGPFRLDATGYFTRYTGFIYRNYTGLTCDDDFASCGTGTDNRQIVYQQQNATFYGAEIIGQYDLVPVGNGFAGVEAQFDFVRAQFDNGTNVPRIPPYRLGGGVYLRADGWFARVNLLHAFSHDATAVYETPTPGYDDLRAELSYTKAVDPAVYGASAITLGVQGRNLLNDDIRNSTSFKKDEILLPGRNVRLFLTARF

SEQ ID NO: 12687 - protein, 560 aa, Rhodospirillum centenum
MSRPVNLPSVKASMSASRRLLTASVAALLALTSTAPVFADGPIGGSHTYRPPARVTRAPAAAPAPVMVRAEDQVARIVMTADQTAATLELAKGKSAIVELPSEVRDLLVTNPQIADAVLRDKRRIYIVGLAEGTTDAAFFDTAGRRILSLSIRVSQPVDQLAAMLGKILPDAKITVSPIRDSVVLSGTVRTASEAESAARIAAQFVGSPEKVLNMISVAGKDQVMLQVRIVEVQRNVIKQLGVDLNAVIGQLGETQYTFGMAPGYGVNGSLLGGVTGGYKMDTTKQPVMQTPCTGPGWTAGSLCPVVARGGGNSDTATIQSTAGDPGLNSAKGMIQAFERVGLVRTLAEPNLAAVSGESGKFLVGGEFPVPTGSDTSGKVTIEFKPYGVGLGYTPVVLSGGRISLKLSTEVSELSSLGAFSMSTGTSSGSTNLTVPGLSVRRVESTVELPSGGSLMLAGLLQQTTKETIDSLPGMTSMPILGSLFRSRDFLNNQTELVVIITPYIIDPTRPQNLQTPADGLQFASDMGTVLLGRLNKVVKAPAGANAGRAYQGPVGYVIE

SEQ ID NO: 12688 - protein, 697 aa, Rhodospirillum centenum
MTSVWQSCGGRAWAGMVACPWPIPSPACFPKTLSRRPTMTTPDTFLARDWRAPRRTMSGALLGCLFSPLLLADDSPLTLDRQFVSAPSVESTTVAEMARYGSKVEIIDRQQIERAGPSSDITRVLQMYVPGLYVAPKNGPFDYGTYSLLGGRNDDTLILLDGVRLNNRLYGGLYLDTLPANAIERIEVLKGGQSLLFGTQAVSGVINIVTRSPQTRDVSGEVNLGLDSFMGTSGDARAEQILSNGLGELGLLAYVSHNVSDGYQPFRNSAYNANTRDKKRSYEVTTFGAKAIQGLGDASRLELFYQYSDANLDFARPVNNRKTTNDRIQQIATATFEQRLDEGFSYFVKGHVNDWDTRYTRIDSLDDASLKVRNHNDYWGFTDWGLQAEGKAELDGGHVLVLGTDNQWFKGQDDVLKIDNKQAQANALYTQLRPVFDALPDWHPSLGVRHEKISGGESATVGMLTSLYDLTPHWQLRGQYGSAFKLPNAEQLYANEDYEKGNPDLKPEKSLNAELGLDYKGSLLAGEFNASVSAFHRKIDDLITLDANDVWSNGQGRIKVRGIELDGRWQFSPQWTLQADMTRNLLESRNGVTLSNIPGFFARSRLGFEAPDRMWGVGGAVRYIGQIDSPKNVDYGHYSVVDADAYRYLDTAQQHRLSLLVENLFDRDYSTSMTSTSPSVDNLGRPFTTEVRYTYRF

SEQ ID NO: 12689 - protein, 723 aa, Rhodospirillum centenum
MEKRMSTQQRAAGNACPTAAFSFDPARLAQRRRWAGAFAALCGLALSPSALLAEEHSQHQDHAVELAPSVVTGVAQSSPLTIVTNPKEPRQPVPASDGADYLKTIPGFAVIRNGGSNGDPVLRGMFGSRLNILTNGGMMLGACPNRMDAPTSYISPETYDKLTVIKGPQTVLWGPGASAGTILFEREPERFGELGSRVNASLLAGSNGRFDKVLDAAAGNRLGYLRFTGNHAQSDDYEDGAGNTVPSRWKKWNGDVAVGWTPDEDTLIELTAGKGDGEARYAGRGMDGSQFKRESLGLRFVKSNVSDVLEKVEAQVYYNYADHIMDNFRLRTPDPSSMMPMPMASQVDRRTLGGRLAATWRWDDFKLVTGVDAMRNEHRARGSKYDMMTDYYTDADQFPWSKDAVFHNYGAFGELTWFAAERDRLIGGLRLDRASVKDYRQTLKSGHMGHAMANPTANDTRADTLPSGFVRYEHDLADSPTTLYAGLGHAERFPDYWELFSPKRGPNGSVNAFDKIKPEKTTQLDFGLQYNGDKLQAWASGYVGVVQDFILFSYREGMMGSSTQATNVDARIMGGELGASYQLTGNWKTDASLAYAWGKNSSDDRALPQIPPLEARFGLTYEEGDWSAGSLWRVVAPQNRIARDQGNVVGKDFDKSAGFGVFSLNGAYRVTRNVKLSAGVDNLFDKDYTEHLNKAGDAGFGFSANETVPEPGRTFWTKVDFSF

SEQ ID NO: 12690 - protein, 764 aa, Rhodospirillum centenum
MRFQVWVLGLGLVLGNPPVHAEHVPTKNELQRQEAGIRTLAQALEPPAVSVSQAPPDETAIESIGPAGSYSLDEVTVTGTLRPARTNETSTTVYTVDRKEIEDKGANSVGEAIRGVPGVQSNVFGAGADVHNNFFIRGLPNLGIGILVDGRLITNLNQEHFDLSDLPVYNTERIEVLTGSGTTLYGTNAAGGVINVITRKPTGPLEADLKVEFGGYGYSNYSASYGGKVDKFGFRAGYRQFDTNDDYYYQVQRPTTGLFTGNRPNAYQHAKFYDLNLSYDFDDRNRLRLDGYLRGSTRGIAPFSIFDPARPFLDSATGEPQFEITRLVTQANGLALTYDSDLGQARDSKLQVLAAVDRNLVEEFSGVDLGDPGTYTDISVLNFQVRHNWQFNPTNNITYGFEYQRQFGRSGENSGEITSFDTGQDLPALFALYTWKPLEPLVITAGVRATFVGNIVARGLVRDIPSSVDPSVGFRYQLLPGLALRGNYQRIYRAPNFNDLFGRTTHIGNPFLEPESGNAFDIGLDWQTGGTSLLRLTYFTADVNNLTDYLLVRNACDLNGNAPDCNDDPRSNAERFRVNYPRVNSSGLEAAFNWKIASEWSTFATTTLVDSRLVAAPDPATVNNQLVQLGSINNSEDGTFRVDVAERNALVQTQYPLVPFLTSRLGVTYEPPGGLRASLFANISGGRSVDVNHVGPFDTLHPARLTPGSLLPGYTTVDMSVRVPLTPSVALNGYVFNLFNSYYERSYGNPGPGINFRVGLSSTF

SEQ ID NO: 12691 - protein, 731 aa, Rhodospirillum centenum
MNARKNFTPSTGKRHFPIPSTLGVAITAAIAMLSGIAIPVQAATGERDDSTIVVEAKDAEAAQGLVAGGMSARSSSTGLLGKKDVMDTPFNVSNMTSSFIENKQAQTLGQVVAHDASVRVSSSQGGLLDSYYIRGFPLNEGNLSDIAMNGVYGVAPNYQLMTDYIERVEVLKGPSALLYGLSPNSSVGGVINAVTKRPTTVGNLTRLTTSWQSDSQFTQHADISRVYALDNNNLLGVRFNGNYGYGDTVWDGSDKRTQVGALGLDFSSERFRATLDLITQHLKTRAPSRPYSFAAGVTVPDAPDGNTNISQPWGFWHSKDQSVLLHTEYDLADNVTWFTDLGGSSAHVSRLSEQVPQVTNNNGDVSSAVGNYRFTTSRYTLATGVRADVETGSVTHKLSAQTSYYRDRQATGIGNGTAISSNIYNPVSSPAQNVAAPPSAYKRSSTALSGIALADTLGFWNDALQITGGLRYQQIKSDNFVPGNSAPSSSYDKNAITPMVGVVVKPWQHVSLYANYIEGLSKGDIAPANASNPGQVLAPYKSKQYEAGVKVDALGTISTLSVFQITKPSGALVNGTFVEANEQRNRGVELDVVGSPLEDLRLTGGVMLLDAELTKSVTLGAQGKRAPGTSRFQANAGVEYDLPFLRDLTLNANVIHNGKQNVNTINTQSIPSWTTVDFGARYKTRIYNAPTTFRADVLNAFDRNYWSGVTSFSTVSQGTPRTLMLSVAVDF

SEQ ID NO: 12692 - protein, 931 aa, Rhodospirillum centenum
MSIQAMRSVRTLTRLACGASLAVLAASPVWAQDAAEEAVASEDEIVVTGFRASLDEALNQKRDSISAVDVIVAEDIAKFPDQNLAESLQRIPGISIQRDAGEGRAITVRGLGAQFTRVRLNGMETIATSTDGAAANRDRAFDFNVFASELFTSLVVHKTASASLDEGSLGAVVDLNTGNPLGGKEGLTLVGSAQARYNDLTENVDPRLAGLIAWTDADRTFGVSASVAWSDYTTDELGNNSVRWAQAPFRSVDGVTCLSGSSFVANPSAGCIEVAEAFHPRIPRYGLVRHERERLGATASIQFEPSENTKISIDGLYSRFKEVRDEYWGEVLLRSEERGIDVSNYTIDEDNNLIAADLDNVYIRTERYSRESETEFYQLSGRLEQRLTDTFKINLLGGFSKSQADIPIETTLAFDDRDGTGYRYDYTNMKFPVLSFGPGIEDPSSFVLAEFRDRPSFLTNKFKTVSLDFDWDVADRFKLLGGGFYRQFDFDTVGFRRDSTYCAAFTCAPGTTGLPVTADIAELFKLGKAGQPSGNTNAWIVPDLDAGTALIDLYNRPAVLQQGEQRAVTEKTYGGWFMTEFETELAGMRLTGNAGVRYAKTEQSSSGFTSGTFVTVDRTYDDWLPSFNLNLHPTENIILRGAIAKVITRPTLGNLSPGGAVDQFNFRITSGNPFLDPFRATTFDLAAEWYFAPGALASVALFAKDIESFPISTSLQGTYADSGLPLSLLTPGTPAYDAVVGGSNPNRQFEFRTTGNGPGASLKGMELSLQLPFSVFSDSLRHFGVLGNATFVKSNVDYTIAGPLAYDPVDNRLEAQPAGVYTQPLLNLAKRAWNATVYYDDGKFSARTSAAWRSGYNDGTSGNGNVFEGYGSSFNVDASIRYAITENIELSIEGTNLTDDYRYRFTDLEANRNYENNHYGRTFLFGARVKI

SEQ ID NO: 12693 - protein, 1071 aa, Rhodospirillum centenum
MKIRTMNYGTCRTLLFAGLCLSNVCLSAAEDMNPDRNSNAVERSNIVSQARFKVSGVVKDSKGEPIIGATVTVKNAAGGVLTDIDGRFEIELSDKNAVLVISYLGFNSAEVKVAGRKSVNVEMQEDVQTLSEVVVVGYGSQKKETLTGAISGIKGDALLKSPNASISNSLAGSIPGISSVQTSGEPGADDAKIFVRGVGSLTEAGATPLILVDGVERSFFQMDPNEIESISVLKDASATAVFGVRGANGVILVTTKRGTEGKAKVSVTSSVGVQSPTRIVDVADSYTHAVMKNMLDRNNGVSEKELIFQPYDLDRFRLGDEPIMYPNVNWYDYLTKKLSIQTQHNLNISGGTKDVKYFVSLGFLYQDGFFKNFKELDYNSNYKYSRYNYRANLDMNLSKSTVLKLNIGGIVGVKNAPNNHEDFWWSLMATSAPFSSPGLVDGKKVVTDPARFPGLMNGYEMFQNFYGTGYSRQVSNTMNFDMVLTQNLDFVTKGLTLEAKGSYNTTYSYTKDVSTQTVSYIPFYYSSVKDPGLKIEDPNFNKEIVYKTSGRDGELLYKQGDTSRSRDWYFEASLRYQRKFGNHNVGALALYNQSKKYYPEDYESIPTAYVGLVGRLTYDYCSRYLAEFNIGYNGSENFAPDKRFGTFPAGSIGYVLTEEPFWKKNNYLTYMKLRASVGLVGNDNMRNNRFLYLDSYVVDKLDRDKDYKDYLDGYNFGLYNTVIANGAEEKRLANRFVTWETALKQNYGVDMNFFSDKLRLTFDYFIEKRKDILINRRTIPIYTSLNESLLPVVNMGKVDNKGYEVSLKWNDKVKDFSYWLDANMSYAKNKIVYQDEVEPNEPYMWRTGQSVDAIFGYVTERFYTEDDFDSSGKLLPELPQPGETVRPGDLKYKDLNGDHVINSDDVCKIGNPKRPLYTFGFNYGIEYKGFFASMNWTAAKEANVELAYSFQTPFDKRQVLYQFIADGTWTPETANTAKYPRLSSNNSNKQTSTTWVQDASYIKLKNATIGYNITNKKILNAIGASLISIKLTGYNLLTFDKLDFMDPEGEPNRKQSYPIMKIYNLGINVTF

SEQ ID NO: 12694 - protein, 1096 aa, Rhodospirillum centenum
MQLKFFTLAVSLAMLSAVTVRPANSQVLYGSVIGTITDSSDAVIPGATVTLTSKTTGLSKEVTSDGGGRYTIINVLPGHYDLKVVAKGFRTHMQLDTEVSPDTIARADVKMEVGQLTETVTIEATQAVLQTDKADTHSEIVTKAITSLPLGGYRNYQSLINLVPGAMPAALQNSITDTPGRALNTHINGANAQTNITRIDGAASVNVWLPHHVGYVTPEENVEVVNVTTGAANAEQGMAGASAITLVTKSGTNNIHGSAFEFHDDQHLKARNFFQAAGTDKPLSIYNNFGATVGGPIRKNRLFYFLSFDGTRQRQASPGFYTVPTAAQKAGDFSAIPTVIYDPQTGSSDGSGRLPFAGNVIPTNRLDPIALKLQSYYPSPNYAGPNLNASNYYAAGGPILSRNFFDTKINFVANDKETVWGKYGRMWATSGGKAVFGIAGGSGLGGSDPGLGDTLIQVATIGHTHTFNAHLILDGVVGYQRQGQSVLPNDYGTNYGLQFGIPNTNGPDPRQSGFPNIGISGYNGFGVPNWMPVTRTEESYTQSDNLTILHGAHEVRVGFDLVRHHLNHWQPEIGQGPRGYLGFNGGETALKGGPANNQFNAYAAFLLGLSDDTEKSLQYILATGREWQFGWYVQDRWQVGRNLTINIGLRYEFYPLMTRAGYGIESYDPSTNLVSMGGRGNVPENAGITVSHKLFAPRIGLAYRLNNQTVIRAGYGINFDPIPFSRPLRGWYPIVVNFANAPSNSYGWANTIEQGVPNVVGPNLSTGVVPLPANASERSPWAGEIHRGYIQSFNFTVERKLPLDILTSVGYVGSHSVHILADRDINAGSPGSGTTGLPQYAQFGRTIATNMWDGYLSSEYNSLQVAINRSFSKGMMVKGAYTYSKAIDYTDDDGWVSVGWNWGPVFQRNRAAAGYDRTHVFQVGWIYELPMGKGKSFAKSGVGAAILGNWQVNGVMAAYTGTPFTVTAPGTSLNAPNNTQTANQIGPVTRLGNVGPGQLYYNTTTAFAAVTAANTFGTSGRNILRNSGLWNTDLDITREFPIKERIRLQFRGEFFNLPNTSHFGSISSGSVTSGTFMQILSASGERQIRFGLRAAW

SEQ ID NO: 12695 - protein, 407 aa, Rhodospirillum centenum
MTMQPVLSVRGVDGAAARRGKAGASSGTCHSAVLGLLAGSLSLLVLPAWGEEFSRNQQATFDAISSSSSNSILASILSDLSGSEATDLLDRLSGDAHAGYVSSLMLADLDLLQAPLGNLRRNLSDPDGGLPYWIRAYRGQSRLDDDGNAGKAKQKFDGMMLGGDLPISGDWRLGAAFGYGDERLDVDSRDAKADSDSYRYALYGGRDLGLAVGALKFSGGAGYSRHEIDSRRSVDVIFFEEEFLTRRYDVTTRQAFGELAYHLDFSKPAYVEPFFGLLSLEQRSDSFQERGGEAALSAQSQRNRLLSTSTGVRGQQVFQVVGRELLLYGSFTWRQLNGDLRPEMQFSFEDGDSFKVRGNELPRNSYLVELNADYKLTPNIVLDVDYSGVFSDSSRSNSFAVNLRWKM

SEQ ID NO: 12696 - protein, 834 aa, Rhodospirillum centenum
MRAVTPPDVRLALLADQRVARLPPPGVAVLEVDHVRVALLLQGVGRLEGDVAPRVGAVHDDGLVRVGDERLHPVDLVNRNVDGARNVSRHVGLSRQGIDENRWVLPFKFVFEVVGGNGGQRIGHVLRNGGTRERRKCICAQCFKISGVRRRVFRNRRERRRYTSSTNFRRGGGSARQGSRWAPPVRRCTHSCLRMRSVRLLLPCLLALLIVAPVRAQDTSDVAFRVQMADSVVVTASRVASAAQETGRRVSVYTQRDIQSLSVNSVDQLLNVAAGLDVKSRGGFGVQSDLTMRGSTFNGVLLLLDGARINDPYTGHFLMDLPVPLSEIARVEVLHGPATALYGPDALGGVVHLITKTALRREDVREDGPAARVDSRYGKNNFYDMGAAARTAGNRTTVSAAASVQGSDGRRVSAAPPPGGSNLSSTVQTDFERRTATAAVSRDLEGATLYTRAGVDDREFGAYHFYTDFATDRAREATSTFWLQSRLSSSGATNTPWQVQLFGKQHRDRYTYNPDVGANTHISRRLRVQGQGSHTWNSVRVTGGASAGLRGVDSNRDGVHGDQSVGAFVSLRWRATPRLTVNQSTRVDYDPTYGAEPTPQLYVAYNLGPATLRAGGGRVVRAPNFLERFIDSPSNQGNADLTAETAWSGEVGVDVRLPANLSLSATGFHRTTDNAIDYLRNEAESVFEAQNLDRTTTTGLETELSFDRTLGAVGVSLDAAYTLLDASLDGQEPPSAYKYGLDAARHQLQGSASVRAGAVTLGLQGLWKDRLRDAPLATDRYGVVHGRLAYNTRLSGARTTLSVELRNAFDRQYSEIFDAPMPGRTLLVGAEVAL

SEQ ID NO: 12697 - protein, 795 aa, Rhodospirillum centenum
MKMTATRTALGLAIALGCASLAAPLHATAAAQAQVYRFQIPAQSLDSALAAFSAVTRIQVLVPGEFTQGLRSPGLSGSYPQDQALARLLQGTGLSATYIDGDSVTLERQRAAGDQSVQLGAVNIGSTQLGATTEGSGSYTTGALTIGKGEQKLKDIPQSVSVVTRQRLDDQNMNSLQDAMRQVTGTTIKSYNTGSNLNDVYMRGFPVDLVQVDGVTQPTGQGDMATAFDLAMYDRVEVLRGPSGLYQGAGEPGGTINLVRKRALGQFALSGELSAGSYDRYHSTVDVTGPLNSDGSLRGRFVTAYENNQAFVDYAQNERPMMYGRLEYDLSPATTLTLGGAYQRNKSVPAFGLPAYDSGKLLDIKRSTFVDAKWNELDERVWESFFEVDHALDDGGQFKSSLTYRDAEAPTRNFTWTDGAVDPATGASSAVAYNYYTHIKTLGLDSFVTRPFEAFGRTHELTVGGDYQHVDKDFRYGGREYFDINVFDPGSINIPKIDYAMDNGNASKSNQYGLYARTKVSATDRLDVILGSRVIWFDSDGHNANPFFNEFSDPHTSVRRKVIPYGALVAKLTPELSAYASYTTVYKPQTQMAGGNSTVAPREGKQYELGLKREFFDGRLNGSVSVFRIYDENRAQQIGQTPYYEAQAKVRSQGWETELSGNLTDNWSISTGYAFTRLESGRQGDYQGISITPKHNFNVWTRYAFADGPLEGFSVGGGVRVVSATYYTRNEVDFVQGGYSVATAQVGYRFNKHLSTTLTANNLFDRKYYERVDSAWGSNFYGEPRNLTLSLRATY

SEQ ID NO: 12698 - protein, 931 aa, Rhodospirillum centenum
MHKRLIILLSLITTIGFSQNPEKGTLVGKLLDIDLGNQSLPFANVQIKGTSKGATTDFDGLYKIENLDPGTYTVVFSFVGYTSVEVSDVEIVADKVTEVNTSLTSSAASLQEVIITIVSRKDSEVALLLEQRGAISIKESIGSQQLAKLGVSDAAVATTKISGVSNSEGSGDIYVRGLGDRYLLTTLNGLPIPSDDVEKKNIDLSLFPTRLVQNISISKSYSVNMYGDQASGNVDITSRELVGNEEYSLGFSTGINTEAIGANDFKLGAYQSDVNLGFYNNNPNNFNALTQQSWNTESVDAPVNQNFNLTAGKKFGDKFRTLVTASQKSNFEFRSGTFQEYDNNNFRDGFTDVEEFRKEVTTSALLDLSYRFNDKNKVKFTSLFVNKLSGQVFEAGRNGEGVVFDEVDPQSDLNQFIRDQNIKKTQLWVNQLIGESKIGVHNIDWAVGLNTVNADEPNRIRNEINFTDTRVELGRTGGFQQRKSNQIIDDYEVNGKINDSFKITNLKEEENDFGLKVDVGGNYRFKERDFESQFNGIQETNLNNVNPPSIDDLSSVFTLDNVENGLLSYVSQKPDSYLGKLESLGGYALFNYKMEKWNFNFGGRFESNTIKVNWNVNNFPGRIGAATKEYENFLPSLNLKYELNDNNNLRLSASKTITLPEFKEISPFEYVSPNGQVTRGNPNLEASENYNLDLKWEMFPSNGELISVAGFYKQINDPINRVLTRGAAGIFSYFNSGEQAEIYGLELDTKLDVIAKDKDLGYMVNVNFNATRMWHEQDLKEVFEIINGENRLTRTFRYNGKTKTDLQGASDWIFNANTTFETSGENPFVANISANYASEKIFALGNPDNQVNPDEFFNEEIREQGFVVLNAVLRKDINENLSVQLIGKNLLNPQIERTQTIKPLSTGVSREEVVRSYTRGAQLSIGFNYNF

SEQ ID NO: 12699 - protein, 187 aa, Rhodospirillum centenum
MKHRIIATITTLLALTFSMPAWAAGSHYVGLGAGAINLGNGLNKKAVFGSYLQIGHHFSEYFGAEVRLGATASQTSNLPAPAKRRMDFVAHYLKPQYPFTTNLTGYALIGFAVVHTTYQPTGGTKQSKNRIGYAYGLGLDYQLNDDYSAGIEWSHMLSKPKNTAATISTNFKGLEASLFTAAVRYHF

SEQ ID NO: 12700 - protein, 788 aa, Rhodospirillum centenum
MKNRSCSLALIITIALICTISPLQAQSTSNKTLDTLIVTGTRISDRTAAESSSPIDIISQESLEATGTTELATALSRMVPSLNFPRPAVSDGNDAVRPAQLRGLSPDQVLVLVNGKRYHTTALVNLNEIQGRGSAPADLNTIPIAAIERIEVLRDGASAQYGSDAIAGVINIVLKGAGKGGSITGHYGEYKVKDGKQYELSGDTGLSFAGTGKVHFAAQGGHEDQTNRAVPYNDGIIRQRYGDPKINQGAFSYNGSYSPTEGVTFYSFGMVSRRKVLSNGFYRWADDARNRPEIYPEGFLPQIYNVANDTSWVSGMKASTAWGLNIDLSYNYGNNQLTFDVRNSLNNSLGLSSPTAFYAGGLEITQHVLNADFNKSVDWGHLAYPLNLAFGVEWRGEIFNEYQGEEASYINGGVRSSAGTLLPGAQVFSGFKPSDSGGFDRNSHSMYIDLEGNLTEKFSAGVAGRYEHYSDFSNTRTGKVSLRYAFTPQVAVRATTSNGFRAPSLQQQFFQSIATDFIAGIPYEIGTFRTDNAAAVALGAEPLKAEKSKNYSLGLVVQPVDDLHVTIDAYRINIDDRIVLSENLTSTAVRHYLQANGYAGIGGGRYFTNGVDTKTTGLDAISSYHWALSNSTMDFTLGYNYNKTEVKRVADNPARLTAIDPSAVRISQAELTRITSGAPRDKAFLSGVWNIGHWSFTATGTRWGEFTVYNTPTAVPVQQRFAPKWTLDLAMSYKLQHWNFTIGGDNVTNTYPERDLIGQGTQAYLPYSRSSPFGFNGAFAYANISYNW

SEQ ID NO: 12701 - protein, 365 aa, Rhodospirillum centenum
MKLRHLALMAAFALPLVAEAQSVTLYGVVDSSVEYINHVGTARDSVVKMPNLTGTVPSRWGLRGTEDLGGGLKANFVLESGFAPDSGTSNQGGRLFGRQAWVGLSGNWGQLSFGRQYTMLFWATLDTDILGPNAYGSSSLDTYLPNARADNSVAYKGKFGGFTVGATYSFGRDTVNAGPSPSGANCAGENPADKTACREWSALLGYETNWWGVLAAYDSLRGGPGAFGGLTSSSMKDDRAAIGGYMIVDKAKIGAGWIGRHSGATGLPSPRSNMFYAGVAYDITPAITLAGEAFYLKYRNSDDKAWLGVVRASYAFSKRTSVYSSVGYIDNGGNSALSVDSGSAGVAPARGGSQLGVMAGVKHIF

SEQ ID NO: 12702 - protein, 277 aa, Rhodospirillum centenum
MKLRLTSALLGGAGCLAMIGSHTGIARETTLYIGGSIGGSFLGNSSNEGRLTEDFLITNSQSPLDGTTLPDGTPLSWETEFHDSATYSGVLGLSRYNIRVELEAASVEYDVDVHDGFRLAGVPASEIDAAALLPNSTTSTSVSVGDIIGDARGSLQTTYWMANLYIDADSPFSLLTPYFGGGVGIAYNDLTYAPSGLTIVDDDEPAFAYQFMAGASYAVLPKLNIFAELGYRGTSEIELTISETTFANQAALFDGQLDIENGGVIAEIGLRYDFSAL

SEQ ID NO: 12703 - protein, 736 aa, Rhodospirillum centenum
MRSALRAAQSVAAPVLGCACFFSTLLQVWGIPGALAAPEISPVRRLDLLAVGEAQQLLAQTQTPGGKSEDELEEVTVLGNRGYLRRNADSGTRTDTAIRDIPANIQVIPRQIIDDQGAVRIEEALRNVSGVTFASSFGGRAPEFNARGFTASLYKNGFLERNGGSFFNARTSPEVANLERLEVLKGPASVLFGQGDPGGTINLITKAPLLTPSASIRFTAGSYDFYRTTLDLGGPLTGDASLAYRLNIAYEDTHSFRDFVQKARFFVAPALTWKISPQTTLRFEGEYLSDNYPIDRGLVFVNGADVGLPVNRYLGDPTRRQVYDEKRGYLTLEHAFAENVRLRSFVRLSTSREDYRSTEVSGPLQADGRTLPLGGFEGGQYYETYTWQNDLIWKFDTGSIKHTLLVGFDWIKQTGFFYNNGFYDGNVIDIFTPVYRFDYTNRIDDSGFDGLTTANTFGAYIQDQIAFSDNLKLLLGGRFDSFDYQDDYRDDSFNSLARAQAFSPRVGLVWQPIAPVSLFATYNRSFLPQFGLNPSGTAFLPERGTLYEAGVKAELAEGRLFSTLSIYRLEKDNVLTADPFNPRFSIQVGQQSGSGVDFDIAGEILTGWNVIASWAYSDARITRDNTFAVNNRLPNAPFHTASLWTTYRLREGALSGFGVGAGLFYVGERAGDLDNTFAIPGYTRADAAVYYERERWRAAVNFKNLFNVRYFEGVQSDTRIYVGTPFTVQGTLSYQF

SEQ ID NO: 12704 - protein, 365 aa, Rhodospirillum centenum
MLSRWRYSWRILDDNEAQKMKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 12705 - protein, 961 aa, Rhodospirillum centenum
MTIVKHFRLLPLGIAVSAALISANTYAQQTDETEVIQVRGIRSSLSEAMDLKKSAPSIQDSIVAEDIGKFPDQNVAESLQRISGVMISRNNGEGSKISVRGMGPQFNAVKINNRTIATTDRGREFDFQALPSELISGADVIKASRANIAEGSLGAYVNISTARPLDSTGFNAATSANISYNDLADEYGNRVSAIISNTFADDQFGILFGFSRQKTTNRVDAAGTTHWGSFQADNQAWITGPTKDINGQDITQGTIWYPGRGTFTLDIEERERTSANVTFQWQPDEDTTHTFDALYTDLSRQAGSNGIQVPLQGSGWSDVVVSENYTLLEGKRNQKPIDVLMQERGQDSDTLALGLNSEFYRSSWKLVSDLSYSKSTATPKANTLVAHAVNPNYDDSLDIFDPNYVDGQIKGLTINDYLNVDNYGDIMSIDTSVDYGNPAAIRTHWNDIQHKELEDEIFEAKFDASYTLDSGPIRSVDMGVAYSDREKSQQVFKINHGCYNTDLWVQPEITTPEEQYLFDNTLLPYNTCGQHIDLEDSLFRTNNVNFLADESGTFPRNFVLVNDFNAYKEAIADIRQEPNWTQEYLAPAESVANTEETFALYSQLNLEGDVRDILISGNVGLRYVKTKTSSEGHRRFRDSISDVYEQNEGVIVEIVYTDPEALTVEKDYSHFLPSANLNVDFGNGVFIKGAAAKVITRPALEDTGVNSTYPLRIRADQYNTKSGNPYLEPYEATQYDLSLEYYADNGDAYSAGLFYKDIGTFISQKTVQKDTGYVAVNQDWGTFYEYSEEQTNRSGGKVSGIEVAALHYFDYLPGWLSGFGIQANYTYTDSKDDEAAKDEITRENVLSAGSGLEGFSKNAYNVIGFYEQEGFQARLAYNWRDNYLKYRSGPVIGSNGLPQHVQDYGQFDFSTSYDINETFTVSAEAINLTNEKIVEYADVRERVTQIQYSGRRFQLGVKATF

SEQ ID NO: 12706 - protein, 219 aa, Rhodospirillum centenum
MRPEKIWAYEIGYKLSRPGFRFEAAAFDYEYKDQQIVEYVGNLANVVNAAKTRVYGAEVHADYDLARNFQINAGMSYTRGRYRSFTNAERYIFSPISGITTDLNADASGNVTARTPRFSGSVGLNYRQPFLDGQLDLSGTYAYQTKIYFDPFGDTEQSGYGLLNLRAAWNDPSDHWTMAVYGKNVTDKKYRQQVTSESTGIFQVFGRPATYGVEVTLRY

SEQ ID NO: 12707 - protein, 681 aa, Rhodospirillum centenum
MTTMNPFLVQSTLPYLAPHFDQIANHHYRPAFDEGMQQKRAEIAAIALNPQMPDFNNTILALEQSGELLTRVTSVFFAMTAAHTNDELQRLDEQFSAELAELANDIYLNGELFARVDAVWQRRESLGLDSESIRLVEVIHQRFVLAGAKLAQADKAKLKVLNTEAATLTSQFNQRLLAANKSGGLVVNDIAQLAGMSEQEIALAAEAAREKGLDNKWLIPLLNTTQQPALAEMRDRATREKLFIAGWTRAEKNDANDTRAIIQRLVEIRAQQATLLGFPHYAAWKIADQMAKTPEAALNFMREIVPAARQRASDELASIQAVIDKQQGGFSAQPWDWAFYAEQVRREKFDLDEAQLKPYFELNTVLNEGVFWTANQLFGIKFVERFDIPVYHPDVRVWEIFDHNGVGLALFYGDFFARDSKSGGAWMGNFVEQSTLNKTHPVIYNVCNYQKPAAGEPALLLWDDVITLFHEFGHTLHGLFARQRYATLSGTNTPRDFVEFPSQINEHWATHPQVFARYARHYQSGAAMPDELQQKMRNASLFNKGYEMSELLSAALLDMRWHCLEENEAMQDVDDFELRALVAENMDLPAIPPRYRSSYFAHIFGGGYAAGYYAYLWTQMLADDGYQWFVEQGGLTRENGLRFREAILSRGNSEDLERLYRQWRGKAPKIMPMLQHRGLNI

SEQ ID NO: 12708 - protein, 635 aa, Rhodospirillum centenum
MPVLYLFPCLALAAPVDLEPTVVSATNTERKLRDAPASISLIAAEDLRRRPVRDLQEALRGSESLQFNGVGMSRRGISVRGMSSEHTLVLVDGQRISTSSGAIAHSDFDLGWVPVESIERIEVVRGPMSSLYGSEALGGVVNVITRRATDTWTGSGLLDGGVREDGLGGQNHQLGAYLSGPLVPGKLGLALNGESRRQQETPDADDRRLSELEGGNADSAGLNLSWTPDEAQRIELGHQRGRERRWRNSETGGPRSRYYESRDVIERERWSLAHNGQWDWGSSQLRTYRNRLERHNARSDGQSPSNPQRLTDSVVDGHLSLPAFERHLFTLGGEWRKEELEDRSVNTAGDASARHKAWFLQDEIAFGPDWSLTLGSRFDKHEAFGWESSPRLYLLHHLSDALTLRAGVGRGYKAPSLKQLSPEYAAVGGGGRFTIYGNPDLKPETNTSYELGADYQGDGWTLKGTLFENDVNDLIQTVCVARCGVRGAEVRNYENVEKARIRGIELGGGVDLPADLRWEFNYTYLDARNRTVGQRLGDRARHLANSQLRWTPDAHFSAQLRTEYVGSQVTYSSNVGYALPAYSLWHLELSRKLSENLTLRGGIENLGDQRLADDDTHFTYAEPGRTFHLGLVASF

SEQ ID NO: 12709 - protein, 207 aa, Rhodospirillum centenum
MQKTSFRNHQVKRFSSQRSTRRKPENQPTRVILFNKPYDVLPQFTDEAGRKTLKEFIPVQGVYAAGRLDRDSEGLLVLTNNGALQARLTQPGKRTGKIYYVQVEGIPTQDALEALRNGVTLNDGPTLPAGAELVDEPAWLWPRNPPIRERKSIPTSWLKITLYEGRNRQVRRMTAHVGFPTLRLIRYAMGDYSLDNLANGEWREVTD

SEQ ID NO: 12710 - protein, 747 aa, Rhodospirillum centenum
MALKTAQPMNASLRKIAVVVATAVSGMSVFAHAADTPKEETITVTAAPAAQESAWGPAATIAARQSATGTKTDTPIQKVPQSISVVTAEEMALHQPRSVKEALSYTPGVAVGTRGASNTYDYLIIRGFAADGQSQNNYLDGMKMQGNFYNDAVIDPYMIERAEIMRGPVSVLYGKSSPGGLLNMVSKRPTTEPLKEIQFKVGTDSLFQTGFDFSDAIDDDGVYSYRLTGVARSNNAQQERAEEQRYTIAPSFSWRPSDKTTFTFLSYFQNEPETGYYGWLPKEGTVDPLPNGDRLPTDFNEGAKNNTYSRNQKMVGYSFDHEFNDTFTVRQNLRFAENKTSQNSVYGYGVCSDPANVYSKQCAALAPADKGHYLARKYVVDNEKLQNLTVDTQLQSKFATGAVDHVLLTGVDFMRMRNDINSWFGYDDSVPLLDLYNPVYSDFDFGSKDPANSGAYQILNRQKQTGLYVQDQAQWDKVLVTLGGRYDWADQESYNRVANTTSKRDDTQFTWRGGVNYLFDNGVTPYFSYSESFEPASQTDAQGKLFSPSKGKQYEAGVKYVPEDRPIVLTGAVYQLTKTNNLMADPAGSFFSVEGGEIRARGFEFEAKAALSASVNIVGSYTYTDAEYTTDTNYKGNTPAQVPKHMASLWGDYTFYDGALSGLTLGTGGRLTGSSYGDPANSFKVGSYTVVDALIRYDLARVGMAGSNVALHVNNLLDREYVASCFNTYGCFWGAERQVVATATFRF

SEQ ID NO: 12711 - protein, 127 aa, Rhodospirillum centenum
MLTQRLSSFRPEQDSSGITSFLSAGWSPSISNHMGASVTAGLTAIGPLESRPNDSIGVGLAWAEINRTQPFLEAEFNANELMLQGYVQVALADWLYLQPTITVLPLVGDRDAEDDSLSGLLQLTMLF

SEQ ID NO: 12712 - protein, 723 aa, Rhodospirillum centenum
MTFKTSFVALAVFAALTQSAVAQETPDTGTNKNKDIEKITVTASRMDKSPSSIPNTVTIIDRVQLEEQFRTTKDLSTIIGNLAPSFSPSRQKMSNTGETLRGRPPLIMIDGVPQSNPLRSGGRSGQTIDPAMIERIEIIHGANAMHGLGAQGGIINYITKKPTGDNQHVVSFDATVPDSLKSNGVSFGASYAFSGESDLIDMLGSVSYRNNGVYYDANHDVIGVDTTQGESMDSQSKDFFIKLGHNFAESRLELMVNHYNMENNGDWMPVKGDITTGKPTGAIEEKQPWEAANNQVTTTSLTYTHENIAGQQLSVQLFNQDFEAVYGGGCNKTFYDPALANNSNLVQCEGPKGESWYYEQSRNSSVKWGLKTSLIAKNIADTGIDAAYGIDLFRDTTEQALVQTGLSWVPESTYDNFAPYLQLDYDLITDLTLSTGVRYEHAKLNVDDYKTLYGAGNKQIEGGEASFDETLFNIGISYKITPDIRVYTSYNQGFGMPDIGRILRDGNSFPGANPSISDSLSLAPIVTDNVEFGADYQGEYLSAKISYYRSATDYGARLALNSDGFYDVKREKSVIDGIEANITAYLTSNDDLGMNLAIQRGEYDSNDDNKTDTDLDGANISPNRINLFWTHNFDNEMSTRVQANYFMDRDFEDATGEKYAEFDGYTTVDASFSMPLYTGTLTLGVQNLFNKDYFNYYSQTMGTNDRYFKGMGRTATIGYTVAF

SEQ ID NO: 12713 - protein, 712 aa, Rhodospirillum centenum
MTRLLAAGGLAVATGGRGWAAPDTGAPAASAVTLSEISVVSAAPPVVPAAGTPGASAGYVGGVTGIGGALLTVDAASAGLIGGAALNARPVTRPGEVLEAVPGLIVTQHSGEGKANQYFLRGFNLDHGTDIAISVDGMPVNMRTHAHGQGYADLNFLIPELVGAVEYHKGPYFVRDGDFASAGSVRIDYLDTVQKNLALTTIGSFGYKRGLSIASVPVGEGNLLVAGEAQVYDGPWAVPDALRKLNGVARYSQGTALDGFAVTGMAYASRWTATNQIPERAVGAGLIGRYGTLNPTDGGDTGRFSLSGRFSATDDTGITRASAYVIRYQMNLFNDFTYFLNDPVGGDQFHQLDQRVLGGGEVLHIFQGDLFGRPLEVEVGAQTRTDSIRVGLFNTAFRRYRSTVLDDRVLESSGALYLDTRVRWTPWLRTSVGLRADGYYADVRSDTPANSGRATDGIVNPKLGLVLGPWSDTEIYVNYGGGFHSNDARGVTATVDPASPLFNITRSPFLVPSTGYELGLRNRSIAGLETSLALFRLDFASENIFQGDTGTTEPSRPTRRFGVEWTNRYALTPWLALDGDLTITNARFSRYDPAGNRVPEAPTTIASAGVTFGEPLGWFGSLRFRYFGPRPLIEDNSIRSRSTALVNGRIGYAFGNGVSVSLDVLNLTNSRSDQITYAYASRLPGEPAEGLIDRVFHPVEPTAVRLTIAGRF

SEQ ID NO: 12714 - protein, 213 aa, Rhodospirillum centenum
MTMKKLTALVLAAATLAPAVSFAHEAGDFLFRAGTATVRPNAGSENVLGLGSFDVNNNTQLGLTFGYMITDNIGVELLAATPFEHKVGTGPTGTIATVKHLPPTLMAQYYFGSKEDKLRPYLGAGLNYTFFFDEKFNSTGKDAKLSDLDLSSSWGFAAQAGMDYNLTDNWMLNASVWWMNIETDVKFKADGQQQKIDTRLDPFVFMFGVGYRF

SEQ ID NO: 12715 - protein, 566 aa, Rhodospirillum centenum
MRTSIICVSAVLAVSCGAAEAADLSRAPATKAITAWNWTGFYLGGHLGAGFGTAKVDNPFGPSIYGDTVRAPKALAGLQAGYNWQAHGSPWVLGVEVDASAIDADGTNTCLAYSGQFVSANCRVREHVVGTLTGRLGHAFGPDGRSLMYVKGGGAFLFGNFRMTTNAPDYLNQPSAELDTTRWGWTVGAGIEHALSSRWAVRAEYDYANFGHRGIDGPGGGFLQTPFNPRTLVDTAGAPTQVRQDMHLIKLGLNYYFGRGDGAFDSVARLPVKAPAGTSWSAWQFDVGARYWYSHGRYQNDLTLNTINAQQEHLVSRLTYESEGHSGEVFWRIDSPQKLFLKGFAGGGGLVAGKMNDEDWFPTDPQNATAYSNTDHNKVTGTIAYATLDVGIDLFGDAFGKLGVFAGYNFYRDRKDAFNCRQIALAIPTAFCGSSEGISISQYEDWHSLRIGANGTLAVAPNTKLLIDAAYLPYTHISALDIHHARTDVASKDSPAWGTGRGVQLEAILTYDITPTFNVGVGGRYWAMWATDVETAGFGSPVPTQLLPIRVERYGTFVQASYKFDR

SEQ ID NO: 12716 - protein, 777 aa, Rhodospirillum centenum
MSRLSRWPARVSLFALQPLAAGVLLAATGSSFAEEPRPAPAVEQEAKLGTVTVNARRREETAQSVPTPISVLSSETLETQRIYRVQDLQQLVPSTNVSYVHARQSSISIRGLGNNPASDGLEGSVGVYLDNVYLGRPGMAVFDLLDVEQLEVLRGPQGTLFGKNTTAGVLNITTRKPTFHQEGSVQSSLGEDGYWQTQGSFSGPFTDTLAGRISAYHTEDDGYVKNLHDGHDLNGGKRQGFRTQLLFKPSETFNLRWIGEYNEENSDNGILSLYSTGPTLNGVNRYESLAAQAGATLVSGKDRKVNFDADQMVKVFQGGTSVEANWTLPNDFTLTSISAYRWWDFTPRNDDGLNVPVFYSAGVSVRDKQYSQEIRLASPTGGFFDYVLGAYYFKQDLDNKSFTYYGPQADIWNLTPAGALANVNTIGNGHIDTDSYALFAQGTWHLTERLDFTAGVRGTYEEKSAWVTRDAPYGGAAVTGTAATARQGRVGAYDSGDLNQYSFAPSGLLSLSYRFTDDLLGYASLSHGEKSGGVNLTVGAAPRLGTDSLLVGTERANNAELGLKSTLFDNRLQLNTNLFWTEVHGYQANVYDEANRVQYLANAGSVRSRGLEFEATALPVRGLTVNFNGSWNDVRYTDYKDAPCPPEVSLANPAATCDLSGHQVVGASKYIANINGQYQWPLAERIEPYVTASYAFRSKAVGTIDDSDYGQIPSYGIVNLSTGVRLDQGDGVLDLSLWVKNAGDKTYFTSLWNSANGGYAGVLGTPRTVGATARYDF

SEQ ID NO: 12717 - protein, 282 aa, Rhodospirillum centenum
MDLQRQGLTRLQQHCQIDAAGQSCWAVQTAISSIDGNRDKVAGIKLGHGFTETFSAGLSLDRSLSRSLPDSYLKNKGNLGAGLYAQWNTAFHGSQWYVRPAVAFNRYNVTVQRPVLENTEAGIGTSRMKGRGASLEAGQTFKSDHGVLLGWHLGGRYNNVSRTEYSEQNAAFPTTYGEASFKRTSAYLGADATIPLTTHLKWMAAVEIDRALKNRDAVYSAQANYIGNFNHRIGIKGTIATLSSGLQYTISEKILLGLTLDVNQTAFGDIARGGTLSVGGRF

SEQ ID NO: 12718 - protein, 459 aa, Rhodospirillum centenum
MPMPTFQRLKDSAVLTSVALPKSLSLLGALGFAACAQAAPAFDSDSPWMLGDWNGTRTELANKGYDFKIDYVGEMGANLHGGYDHDRTARYSDQFAFGSHLDLQKILGWDDAEFQLTVTKRDGDNISNDRINDPRVGGFTSAQEVWGRGQTWRLTQMWYQQKFFDQKLDIKAGRFGQGEDFNSFPCDFQNLAFCGSQVGNWAGSVWYNWPVSQWALRVKYHLNAELYAQIGAYEQNPSNLDRDNGFKLSGSGTQGTLLPVELVWTPKLNGLAGEYRAGYYYSSAKASDVYKDGNGQPAALTGEAYRSSSSKHGLWLGAQQQVTSQASDHSRGLSLFANVTAHDKKTNAIDNYVQAGLVYKGLFDARAKDDIGFALARVHVNPAYRKNAQASNQARALYDYDNPSYLPPQDTEYSAELYYGVHLANWLTVRPNLQYIRHPGGVSRVDDALIGGIKIQSSF

SEQ ID NO: 12719 - protein, 907 aa, Rhodospirillum centenum
MAGVRRKVKSSVELPQLVRQTSRIAFVVATVGCFGLPSQALALQQEGGAEVEKVEQGERHIVVTATKRDQTLEEVPIAVTVVGQEELISKGIEDITNLERAAPSYAVSTSDSATGGLVLRLRGVGTTGNNIGLESSVGAFIDGFYLPRPGAALSDLYDVQQIELLKGPQGTLFGRNTSAGAMVIKTNPPRTDIVEGFVNATIGNYDLYGVQAGFNVPLVQDKIGLRIAGAYRNRGGYITNVVGDESQTRDRISIRGQLLFDLEDAGELRLLAGYNRGKDDCCMAIWTQRSPFIEANSAPFSAFAPTAGAPNVGADAVDPYLANDNTNFVNPFHGWSIAAHYDVSLPFGELSYLGYYGDSFADSCRGDYTALNVYAVGDCPEIRALNPGIDLDPLNGTSIKSTSHELRLQGESFDGALDWIIGAYYSHEKIDQKYTFFFLDQMQEAVSVGAFGQPVFNELNFAAGGANSVLDYAAPRAQQKGESFSIFTHNVIELSDRLSLIVGARYVDESKNAKLSEQVPGQHNACFGTFNSLAGYLAPGGAYHPTDGFFGAGGPGRLAAAVQTNCWIFTSPFFDPSDPNSFFQQFVGDPVTSPFLQFIPQPFDQKFGDDRLTYTLNVRYEVADRTFLYGGYSQGFKSGGFNLDVSSASGGADPTFRSEKVDAFELGLKSRFLGGRAWANIALFHTNLKDFQVLEFDGTRFNTFNTDKALSTGVEIESGFDLSDAVTLNLAGSYTDARYPSDCASFDPTDPNFTPAATSLCGTRLTNAPELVLIGGLDFNTEIGNAGMSVFGGATVRYESKRRTSTRPTELPATAGALTEDDVRAAVAAALPLPQDIQPGNTKVDLRFGFGAADGQFTIEAWARNVFDTRTRFVTFNIPLRGFGGSRARGAFVQEPRTYGVTARAKF

SEQ ID NO: 12720 - protein, 877 aa, Rhodospirillum centenum
MRDRRMKRCFFFKLFCGVVLALNYFLLPSFSPAQQGGASYQDPVLSPGSIIEGSNESGTVPLQEAPKLKKSTQNDDPPPPTTTISQVNVYAQPNNMQPTSSDIESVYGIPMNVMDTPRTVTPVNNKLMYTSGVNALGGMMNPMALLTVNPTTFGSVMDFMTDAPYVLGTQAVPYVNGIELSLTNIMMGNAGLPWNWNMIESFDILEGPANAVYGQTQGSNGIVNYVTKQPYFDKFRGYVYDTTGMYENYIWGLDIGAPINDKLAYRFSYMGVESGSWWQYVHNDEQDFYAALSARPIENYTADWYFNMEFADASPLGYSGFNRPSNQLFWNDLYYKGFLPPSQINSFPPTYPNGVPIPYPQFPGAGLEPANMRAMLIPPFASQTGYQGMTQLIQRAHIADGFDIVNNTLVWYTRHRAIQPAYFYDEAVMGDYEVDNRTEIRLQFDTPLGGGAERKFRWGKGEPKADEGGLTFSHYIDTGFEWHYQRNVDYVSTNFLNIPNEFDIMNENPLLWDARLTPAWQALVAQQVEIPVPGMPGYYFEPGNGITGTTDSQYWAFAPFMQWNIQFHPKFSLLMGARETTYVVDAVTPQGTPLDQFAQFRTTSIAPLFNVSPVYKPFPWMTVYFNYNWLYTTAAADMGGFAPVFTDNNMRLLEQYIEGGVKFNLYHNKLYLTAAGIRSRLDEGYVALPPVVTHMTAFQFNMNYQPTRHFWSRAGFAYMRGTSNFTNLPFGPPETQSYSTGYAFRHDLPLDDNGMFGYGYQPGIWPWAAFPQLVANAMVSYTFDNGFGITLSGTWMSATPIFWDYTAWIPSQDYANLQLFYQNKHWQVNLYIWNVFNSHYWIPYAAAAGASPDSASNSDWVVPGQAFWIQGTVAYRF

SEQ ID NO: 12721 - protein, 811 aa, Rhodospirillum centenum
MSVRLPASPLGLAIALALSSAAVPALAQDATNLDTVIVTGTRAADRTVLESTSPVDVLTAEDIRKAGVVNGELGSALQALLPSFNFPRQSNSGGADHVRAAQLRGLSPDQVLVLVNGKRRHHTALVNTDSKIGKGTTPVDFNSIPVSAIKRIEVLRDGAGALYGSDAVAGVINVILDNGGDGGEIEASYGANHTDLKPIGRTLTDGQTGNISAKVGTSLGEDGGFLRVGLEYKHRNGTNRAGFDQIPPWDQTPGNLALQGKRNYVLGDGKSKDINLWLNTEIPVGQTSTFYAFGTFNQRDTEGANYFRYPDGEANWKQVYPNGYRPISEGENRDVQAVAGVRGQWGEWSYDGSLDYGQNDFTYRLRDSLNASLGPTSPTRFKTADYEYAQTVGNLDLSRVFTQSDSISHTLGLGVEARHERYQTRPGDPASYAAGPYTDRPTGSQAGGGLTPQDAATLSRDVASAYASLSSQFGEKFSTDLAARYEHNDDFGGELTGKLGLRYEFTPAFALRGAISNNFRAPSLAQIGYESTSTGYNAGGQLVQGRLLSVNNPIARGLGAQNLKPEKSINTSLGFTSKIGEHFDLSLDFFQIDIDDRIALSESITGDALTDYVAANYGVSGLQSASFFVNAADTRTRGAELVSNWRQSLGDGQLLLTGTYAYTKTTLKNVLATPAQLRALNPDYVLFGIEETNTLTDATPRTRGSFSAAWSNDHWSLSTRVNRYGSATRVFNFGDGYIPRQTYQAEWQLDAEVEYRITPRWSVAIGGQNLTDNYPDRSNSDIHYFGNLPYDVLSPIGSNGAYYYGRVRYTF

SEQ ID NO: 12722 - protein, 745 aa, Rhodospirillum centenum
MPKSMGPISLVAAAVICQLGLVNVATAAENDMERMVVSATRSPTQISDLSSTVWIIDEASIREQTDSGKGIKEMLAALVPSMDVSSQGRTNFGQNIRGRAMVVLIDGVSMNTSRSISRQLDSIDPFNIARIEVLAGASAIYGGGALGGAINIVTKKAADSSDTFEAEAGFKSGFNSSDDLDYRTALAVTGGSDSLKGRFSAAWQENGQWFDGSSNPVMLDITQTGMQYTQGYDLMANMDWQLANDANLSAMAQYYRNGSDDEHGLYMGENFSGVTGDASVLETRKGLDADRSPATERTLLNLSYSQNEFLGQTLYLQGFYRKENLDFHPFPYVNETSGVYNFSASAQNTSIYGLKAVVESKPVDSLTLTWGLDWDKESFDSSQMSFDLDAANQHGGLVMRELFTTGRYVDFSVESIAAFVQSSWEMNSFLVLNAGYRYQHMENSVDDFIGYNQQVTIASGKAKGADAIKGGSTDYNIGLVNLGLVAKLSQDQQLWLAYSQGFELPDLSKYYGRGTYKADADGYLQLQNSININDTRLDGIKTDSMELGWRYLADRWQAQASIYYAVSDKVIEVNSKDLTIDVKDQDKRSYGLEAQLNFDISSDWQVGTNLHLVRSEVKDENNWIDETVTYASPSKATAFIGWRGETQKIRLQAEHSFSAESDYRFKTNDGLASELDSYTTLDLLGSIDLPVGTLSYGIENLLDKDYSTLWGQRAVYFYSPTYGPESMFDYHGRGRTFALNYQLSW

SEQ ID NO: 12723 - protein, 445 aa, Rhodospirillum centenum
MTRVHNKTSAARRLVAAAFAISALGATGTAAFAEESLAERSRLTGDWGGARTALEDKGIEIGIAYIGEVLGISGGVRPKGSTYAAFEGRLDVTINTDLEKLVGWTGGKTHIRAFQIHDANGKNAAYYTGSIADPSNIDAYATTRLFTAWYQQEFGTFASIRLGQLAADDEFLTSSTAGGLINGTFGWAALMAANLPSGGPAYPLATPGVRLQVNPTENIALLGAVFAGDPAGRNCTGDNVQRDCNRHGTTFSLDGGAFWLGEAQYNVNQAKDATGLAGSYKLGAWYHTGTTFQDQYTGVKDRSNDWGMYGVVDQMLWRGKDASTSVFVRGGWTPSDRNPVSWYIDGGVGFKGFVPGRAADTLTVGVAHAKISKDAIAFEVDTGAWPQRTGETVLELSYIAQITPWWSLQPDFQYIHKPAGGNLVRDDGSVVEEAYVFGVRTNVTF

SEQ ID NO: 12724 - protein, 879 aa, Rhodospirillum centenum
MLGKYKAVLALLLLIILVPLTLLMTLGLWVPTLAGIWLPLGTRIALDESPRITRKGLIIPDLRYLVGDCQLAHITNASLSHPSRWLLNVGTVELDSACLAKLPQTEQSPAAPKTLAQWQAMLPNTWINIDKLIFSPWQEWQGKLSLALTSDIQQLRYQGEKVKFQGQLKGQQLTVSELDVVAFENQPPVKLVGEFAMPLVPDGLPVSGHATATLNLPQEPSLVDAELDWQENSGQLIVLARDNGDPLLDLPWQITRQQLTVSDGRWSWPYAGFPLSGRLGVKVDNWQAGLENALVSGRLSVLTQGQAGKGNAVLNFGPGKLSMDNSQLPLQLTGEAKQADLILYARLPAQLSGSLSDPTLTFEPGALLRSKGRVIDSLDIDEIRWPLAGVKVTQRGVDGRLQAILQAHENELGDFVLHMDGLANDFLPDAGRWQWRYWGKGSFTPMNATWDVAGKGEWHDSTITLTDLSTGFDQLQYGTMTVEKPRLILDKPIVWVRDAQHPSFSGALSLDAGQTLFTGGSVLPPSTLKFSVDGRDPTYFLFKGDLHAGEIGPVRVNGRWDGIRLRGNAWWPKQSLTVFQPLVPPDWKMNLRDGELYAQVAFSAAPEQGFRAGGHGVLKGGSAWMPDNQVNGVDFVLPFRFADGAWHLGTRGPVTLRIAEVINLVTAKNITADLQGRYPWTEEEPLLLTDVSVDVLGGNVLMKQLRMPQHDPALLRLNNLSSSELVSAVNPKQFAMSGAFSGALPLWLNNEKWIVKDGWLANSGPMTLRLDKDTADAVVKDNMTAGSAINWLRYMEISRSSTKINLDNLGLLTMQANITGTSRVDGKSGTVNLNYHHEENIFTLWRSLRFGDNLQAWLEQNARLPGNDCPQGKECEEKQ

SEQ ID NO: 12725 - protein, 312 aa, Rhodospirillum centenum
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGEEFVNK

SEQ ID NO: 12726 - protein, 758 aa, Rhodospirillum centenum
MRSLLLGSACAATLAAASPALAQTAPQATQATDVGEVIVTATRRAERLQDVPLSVTAYSQEALTAKGIVGYEGLAVETPGVVLNRPTANFNNFTARGIATNGYGANLQSTVAVYIDELPISTIGNTTVLDPNLYDVERVEFLRGPQGTLFGSGSLSGALRILTKKPDSSAFDASVLVDYGMVGSDSLRQRYNAMVNVPLVQDKLAIRAVGFLRKEEGYVDNVGLANRKNSNDLDYAGGRVSLLWEPTDRTSVKLLVSREVSKPRDSSTVSPALGHDRRVSDRPDLFQGWLTSYNATIEHQFDGAQFTSSTTWSEFDQKFYVDLAGTFLPQGAVPGPTSIAFGLDADAYQDTFVQEARLASDPGGRWDWVVGGFFLDRRWDVDYNYRSRPDYLAFRGFTGLSDEYYQRQFNHTNSQELAGFGNVTYRFSENFWVTGGLRYGGFEAQSHVEGGYNSNYLAAALTPGFSGPLTIVPIAPVTGVKAKETGPSYKISLSYKPTPNLTTYATVSTGFRTPIVNGFAGRPSVVDPTDIIIPPGADSDDLTNYEIGLKGRWLNGRLTTNLAAYWIDWKNIQVQANRVSDSVQFATNIGQAYSRGLEFEIIALPMEGLTVGANGAFNEAEVSKLSPTEAAISGAGEGVRLASPRFQGAAYVNYGFDLTPEARANFSAVVQRVGKYPGLFPYIPGRPGVLQPTYDYTEAYTNVNATFAVAFDTWTVAAYVENLFDSRKITYVHPEAFLASRYAEQRPRTFGVRVGYDF

SEQ ID NO: 12727 - protein, 207 aa, Rhodospirillum centenum
MRKVTLAAAAVIAASVSTAQAADMGYYRSNAPYTVNQPLNAFSWAGPYLGGNLGYSWGNVTNNITKPSGFSGGVQGGYNWQSGNIVFGLEGDIQFSTADDTFAQYKFSNPWFGTGRGRIGYAMNDVLIYATGGLAFGQLKGQNVFASESHSSAGWTVGAGAEFAFAPKLSAKVEYLYMSLSTSNFFITGMPNGYNAGLVRAGINYHF

SEQ ID NO: 12728 - protein, 294 aa, Rhodospirillum centenum
MSRSRTAALAGLLVAQATSIQAAGFIEDSKAKATLRNYYFDRNYINETPQAAAREWAQGFIVNFSSGFTDGPVGFGMDAQAMMGLRLDSSSDRVGTGLLPFSASTREPARDYSELGLTAKMKISKTELQYGTVSTFLPIAFASPTRLLPQTFRGTYLRSQDIDGLSLHAGWLDRINLRDSTDYQKMRVAAPNGRFNGAAESDTFYFLGGDYAWSKNLTLKYYYAQLEDIYDKNYVGFVDNREIGPGRLTSDFRFYDSREDGASKAGKVDNRNTALMLTYQLGGHRLGAGYMQLT

SEQ ID NO: 12729 - protein, 664 aa, Coxiella burnetii
MLKKITICSLSAATLVFGTQIRLDTTVISTSGFETKLKDEVRNVIVITSEDIQNKGYKNVEEILEAEPSISFIDPGFGRTIDMRGQGINSNFSTKIMLNGVALNMLDTSHATVPINTISVDDIEQIEIIPGGGSVLYGNGTSGGVINIITKNQPRDFYTNLSTKFGSYNYKDLNFAVGGMANDDLFLKFNAKKFDEKGYRDGEKNRGYYTSGGATYQINDNQSIVLNSSYYNATTSTLNALSKAQVNSDPKQGGKKTTKDETRLDLTLDYALKYGDYVDFHIFPYYQKIKQELDDNSGFEDKKYGINLKNRMDYGNGELIYGYEYYINKGLRYRNNQGSRRGVTVKNSINVDLEKKSHSIYVMDNHHFNDWFSISSGYRFEKASYDLDRSSITNIYMPNSTRPMTTVKNIANQPDTNNHAFEITPNLKYSDTGNIYFKFERGFYSASPTQLTNSVRPQGATRGSVYKFNNLKSEIFYTYEIGAKDYFLGSYMSATAFITDKKNEIRNIMEEDHTLWRFINLDKTRRLGIELYASQYMLDNDLSLKQTYSYVDAKITSGEFNNKRIPLAAKHKLVFGADYKVIRNLNVFGDIKYFSDMLDNGYEKINSKTIVDIGAKYSFPKGFLVIAGIKNLFDKRYFTYQDKIKDQYKPANARNYYVEFKYVY

SEQ ID NO: 12730 - protein, 408 aa, Coxiella burnetii
MVFSFTLITSAIFASGGQSFYPFAFINPAELSQVKHWKVSVGYYAAFVRNKFQGSVTIPTGLSFPTFQTVTQTFSGIARSSDVSHLPGGQIAYRINDRFVVGLRYSEPYDSTISFADTFGRFANNKSSTRVNDISPEFAFSFSPKFSIGAGLDIMHLFAEANINTIPFLIPFSPLSVNEGLSKNHASGWGLGWHIGMLINPWLGNYLGLTYYSRSRYTLHGVTQFNGSFLDGTPIFIKNGIVVPQARPDTFIFSDFQALSEKFGLFLHLTYTLWSILQSITVENVAVPNPPYDSNTFTIDFKYRNAWRIGFGGRYAPSENWIFFLGTTFDQTPVPSPQYRGLFFPETNGIHLWASLTRKFTKHFSTSLMYSHSFYQKRAVDNSFAGVTSLGVNRPVVDFIGLDLTYES

SEQ ID NO: 12731 - protein, 1019 aa, Coxiella burnetii
MKNIVIKWAVFLTAFLISLEVSAQNVRVSGVVTDALGPIPGVNIMEEGTTNGTVTDVNGKYSISVSAKSTLVFSCIGYKEQKIRVGTKTVLNVNMVEESKMLDELVVVGYGVQRKSDVATSVASVKADEMRTFPAGNVADMLRGRAAGVNVTSSSGRPGSTPSITIRGSRSISADNAPLYIIDGSPSSATEFSTLSADDIESVEILKDAASQAIYGARASDGVVLVTTKRGKAGKVEVNYNGYLGIQSLWRNFDFYSPEEYMQLRREAKAHDKGIIDAREISIAEALEDEVMQRVWASGKFIDWEKEMFRNAIYHNHDVSVRGGTEKIKVSAGANYFDQQGMVVTGSGYQKFSLRLNLDFEIAKWISFGINSSYAMTKQDREDGNFNDFITSSPLAEIYDADGKYTKYINSEGNYNPLYRAEHYGREVTRDNYRLNFFMDVKPFKGFNYRLNTSVYNQTSEDGSYKDSQYPGGGGTAVLDESRTQNWLVENIVTYKVPIRNKKHQLTLTGVQSVDHNGSKSIGYSVENLPVDKDWNFISQGEFTGKPRRQFNENNLVSFMARAQYSLLDRYLLNVAVRRDGSSRFGKENKWGTFPSAAFAWRVNQESFLRDVSWIDNLKLRVSYGIVGNQNGIGNYTTLGLADNKEYEFGNVFQMGYLPSKELSNPNLKWEQSATANFGVDFSFFNGRLNGTVEYYNTHTKDLLVKRSLNASLGYTTMLDNLGKTKSSGIDLSLNGDVVRTKEFTWTLGTNFSMYKNEIVRIDDTLDENGKPASQVAQGWIIGEPINVYYDYLIDGIFQYDDFDITRDGTGNLVYTLKNTYDSDNDGVADSPINYGGAIEPGMVKVRDNNGDGKITADDRVPIRKDPKFTLSLSSTWNWKGFDLFMDWYGVSGRKIKNGYLYEYNSGGSLRGKLNGVKVDYWTPFNPSNKFPRPSYSADPAYLSAIAIQDASYIRLRTLQLGYTFPTRLLKNTPIHKLRLYATATNLLTFTEFKSYSPELTPGSYPESRQYVFGVNVSF

SEQ ID NO: 12732 - protein, 231 aa, Coxiella burnetii
MSVKKLVTLATLSMASVGVTSAALAGGPDYVPAPSYAGVYLEGNLGYAYRPWRKDATTVVGLAKQAGLLGSSSRGNGGFTFGADLGYQFNQYFAVEGGWFYLPKVKFTTTGVVNGLAAGTYTVKSGMAYAALKGMAPVYENTYVFGKLGVAYTYNRANAGLPTNKIPATFGSRSRFWNPLFAAGVQYYFTPNWSVNAQYTFVPGYRNASSKRFVAPVTHLFTVGLGYKFLM

SEQ ID NO: 12733 - protein, 237 aa, Coxiella burnetii
MGRCILYLFCLLSALFLIPTNAAAGGIEVPHYIPIPFVYSGVYVEGLYGYASRDWESYLPYQTYVAALQGDGPPFGPFVKRGKGGSVAGVDVGYQWNRYFAAEIGWIHLPTVRYLVPSGLPVAGGRISEHSWLGYIALKLAFPICGNLYAYSKVGAAGLNIRTRINFTPVNDLTQNGDFWSPLFAVGLQYYLNWYWFFTLQYLHVNGYGRASAGAIQKLPSPHSDLFTFSVGYKLAI

SEQ ID NO: 12734 - protein, 232 aa, Coxiella burnetii
MLFEIKIYMYRKIISQFISLLFLLLINFASKANSIQTYDFPSIWRTHPFYIGLSLGYGRTDWSQLVAKGTPMEIPLLAVSTPISAGDRGFLYGFVAGYELQPHFAIELNYTRFPNTTVVFDPDFYTIKPIVSMRSFTYAYNLVGKFMAQLGESGFRGFANAGASFTHRNDLLVKGAHICPTFGVGINYVFIKRIMLEMGFQYYAGYGKAVINPGVNYVPFLYALTLKLAYRF

SEQ ID NO: 12735 - protein, 190 aa, Coxiella burnetii
MKNIVLALIATVAVGLGTESLAQGAAVEEESGLYTNGDLVGVKPKVTNLGSIDDGGIIYKAGGGYQFNKYFALEGNYTRFPNLKSGRVIPEKSNTEIYAAGKAIIPLKKGYNVFAKIGAAQVSTTTVPGMEDVSGINLSNTHSEILPYGGLGVGYSVSQKVGFNLQFAGTPEGDNIPARYAVMGGLSYNF

SEQ ID NO: 12736 - protein, 248 aa, Coxiella burnetii
MLKKIVIGVTATAAFGIGAGALAGGSVDQSYNNTSGAGFYVRGEAGYGLVDKKSGTSKVNFTGVTLTENSHTNTKKSRGFNGRVAIGYAFNPYFSLESGFTYYHPAYRDVNIAGSALPLFSSVQAEGRQKINLYSIDLMGKATLPIDNFYAFIEGGVAYVHTKFVAFTETGTAVSPLLPPVTSSVAVKVPSSSKGYIRPKAGIGVGYNITQNIGVDVSYSRVFGQGKINNTNYLPNLNAVTLGLTYKF

SEQ ID NO: 12737 - protein, 448 aa, Coxiella burnetii
MQGDGKKRLWTLPLVLGAGLMASAVAEENAERSKEGFIEGSEVNLLLRNFYFNRDFRKGQSSPAGGGYTEEWVQGFMANFSSGFTQGTLGVGIDAFAQLGVRLDSGGGRSGAGGSVDLLPYDDQGRPQDDYSRAGGAVKLRWYGTVLRVGDVFPETPVIQYGNSRLFPSSFRGFTLVNDSLAKGLTLQAGKLNSMTQPNSTSGSDDFYSFYTGRRIDSPWVAYAGGDYQATEHWSVSLYGSRQKDAWDQYYAGTSFNYPLDDKLSLLGGANYYKVKDQGRQVMGELDNDIWSVRGGFAYGPHQVLLSYQRNNGDDDFDYLRQTDSIYLDNSIQYSDFNSPKERSLMLRYDLDMAAFGVPGLSFMTRYGKGWDADYSNANSVYMRTDANGNPLTNQGRWERDVEVKYVVQGGAAKDLAFRVRQATVRSDSFESDLDEVRLIVEYPLQVL

SEQ ID NO: 12738 - protein, 448 aa, Oligotropha carboxidovorans
MVMSQKTLFTKSALAVAVVLISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTPQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGNTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 12739 - protein, 403 aa, Oligotropha carboxidovorans
MAIVMAASPMSGVVYGANFEGPDSVENTIAEQKAQKKSWRESLAEDGFTFGADYFALGLTSGDGVGGDSVDASSGVARLYGSWHLLGKGTQNSGSLVWKVEHRHAYGDTAPKDYSFGPLGYVGAIGPAYSDQGFRVTDLNWKQKINDGKGTIVVGWQDVTNYADVYALASPWSGFTNLAFSTGSGAMGLPDDGVLALSAGHMLGENFYVVGGIADANGQSDDIFDGFDSAFGSDASYFTTLELGWTASQEQIYTDNFHVTFWDFGDDTRHSNSLAAEGGSGVNFSWSQFMTDQVMPFVRGGFSEGDVALYDKSISVGMGYFGLGKPTNNLGVALNWAEVNGDSFAADAKAISGNTEQWTAEIYYNMQLNDFIQVTPDIQYIKDPAFSNESSAWVFGVRARVFI

SEQ ID NO: 12740 - protein, 735 aa, Oligotropha carboxidovorans
MKRTILSAAALLVSASALPFAASAVAQDAGTSADTVRDVVTVTARRREESLKDVPVAVSALSADQLDQIGAQDITTLQAITPNATVQVARGSNSTLISFIRGVGQQDPLWGFEPGVGLYIDDVYVARPQGAVLDIFDIERIEVLRGPQGTLYGRNTIGGAIKYVTARMDGDPTLMARVSGGSYNQLDYMVSASTPLSDTFAVGGAYARYTRDGYGENLTTGQDHYNKDVTAFRLSAEWTPTDDLFFRLAYDRVEDDSNPRHGSRILPGALPGSTPLDDIYDTRAGLVGENSVSTEGLSLTAEWNFSDTLTFKSITAYREGDTDTIIDFDNTPTPVLDIPAYYADDQFTQEFQLAYEGERMQGVVGVYYLDSTAEGAFDTVAGLLGITIGTGGSVDTESYAIFGDFSYDVTDRLRVSLGARYTEDKKTGDVFRANYLGVGRTPLTGGPAATPILLRTDYTSERSFDQFTPRLSVSYDLNDQLTGYASYSQGFKSGGFDMRGDAILTPDTVNGYEPETVDSFELGLKGENIGGVLNFSSALFWSDYQDQQVTTQVPTATGIASFVDNVGQSTIYGAELEGSLFLTENLTANFALGWLQAEFDEFLRYDLVAQAYVDISDQVVFQNSPEWSGYLGLTYTAEAFGGDLAVTPSISYRDSYSQFEFPNPLLDEDGYTLVDLSAVWSAPNEHWEIGLHGRNLTDEEYRIGGYNFPGAIFDDSVVAFYGPPRTFTATLTYRY

SEQ ID NO: 12741 - protein, 855 aa, Oligotropha carboxidovorans
MGNESSPSPSSTDSPIMASIRLTYQRRPAPARHLPRASRPAASGRLARRLAGAVLLSALLPLPALADTDADAAPATQRASRRAFDIPAGPLEAALNRFGRDAGILLAFPPELTAGLASGGVHGRFDVDGAFDRLLAGTGLVALRQPGGGYTLMRADGSAAGPVAAGVAPAAELPTIDVRSSALRAESYRAPKEAGVLRSDIPLLDTAQAVNIVPAQVLRDQRPRNLDDALGNVSGITQGNTLAGTQDTIMKRGFGGNRDGSIMQNGMPLVQGRAFNAATDSVEVLKGPTSLLYGLMDPGGVVNVVTKQPQLVRYNVISLGASTFGHGKNGGSATFDSTGPVGDSRLAYRLIVDQSNEQYWRNFGEYRQTFVAPSLAWYGRDTQVAVSYQYRKFHSPFDRGTALDPRTNAPLDIPARRRIDEPFNNMDGESQLAQLSVDHQFNADWSAHFGYSYNRETYDANQLRTTGVDPVKGTMTRSNDATHGSLSTDSYGIGYVTGKLTLAGMRHDVQVGFDTEYRRIYRKDLLRQAVKTPFSYIDPVYGLLPPSSTVSASDSDQTDTLHDASAFFQDTVHLTDKWIVSGGLRYITYNQVAGRGRPFVANTDLSGSKWLPRAGVVYKWTDAFSLYGSYSQSLKPSSSIAPMTGYIIDGATPPEEATAWEVGGKLGLAGGMTGTLALFNIDKKNVLVSQYNDATKLTDWRTSGKARSRGVELDVSGKLGERVNVIASYAYIDAKTTEDPLYAGNQLWNVARHTASLAAVYDFGTVAGGDDLRIGADVRYVGARPGDSANSFTLPSYVLADAFATYDTRIGKQKLSFQLNVKNLFNRTYYPSSANRYFVAVGDARQVSLLTTLQF

SEQ ID NO: 12742 - protein, 717 aa, Oligotropha carboxidovorans
MIFRPFPATRTAAAQAAVALLCGAAAHAQTTEAALPAVTISADPAQQSATEPVRGFVARRALSATKTDTPLIETPQAISVVTRDQMEAQGVQTLRETTRYSAGIVSSYFDSRVDSFKARGGDVTQYLDGLLRTYGTYNNVKAEPYTLERVEFLRGPSSVLYGQGSVGGVLNLTSKRPLAERQREVQVQIGSHARKQIAADLTGPLDAEGRWLYRLVAVGRDSGTQVDHVDDDRVVFAPSLTWRPSADTSLTLQAHYQKDQSGSLIGFFPWQGTRLPSAYGRIPTNTFISEPGWDAYDTENASWGYLFSHRLNGDWTLRQNLRRTVSDVDYRTLYTSFTANAASGRPARPVFDANGRTVLRDAAWQRNASRLLLIDTQLEGRLRAGAVEHTLLVGVDGQRNHTSQSSWRAVAPAIDVYAPVYGNFTPPSSAALTALPDVTQRQLGLYLQDQMRWGAWTATLGLRHDRAKTDTEGRPAAAVDDKAWTKRLGLTYQAGGGWAPYVGYSESFQPLGGVNVYGTAYKPQRGQQWEAGVKWMPEGRGISAFAALYHLREKNRKTTDPSNPLNSLQIGEVTIKGLEAEMTASLARHWDWTLGYAYADATISRSNAGDQGQRVAGVPRHTASSWLMHRFAAQGRGGWTVGAGVRYTGSQWTGTPAIDTPSVLLADAMVAYDAGDWRLALNINNLTDKVNITQCLARGDCFYGERRNVLLTGTYRF

SEQ ID NO: 12743 - protein, 1036 aa, Oligotropha carboxidovorans
MTSHAARQRRPFRSTSPARYGRISMLALALSGAVGMLATGTAAAQSTTAGIYGSAPASAGATVTAQSDTGLTRTATVDANGRYAIGNLPVGTYTVTLQREGQAAETRKNIALRVGAGTDVSFGSSNASDDTATLGTITVTGKNISPVDVSATASRTVITAEQLQRLPLARSGEAIALLSPGAVQGSGYFGNAISFGGAGVTENAYYLNGYLSSNPLTNIGGVTLPFGAIDQQETYTGGYSARYGRSAGGVLSQVGKRGTNEWHFGAQALWRPRSLSSDYKNVFYPDTAPPAGYEYSDESLPGTLYRSRKDDTFWNTVYSVYAGGPLVEDRLFVFVAAEQERTEGVSTARRDDPVIGRNNYRIDEPKVYAKIDWNINDSNILELTGVKNNSREGGAYTDFNGYPDVVSDANGAFADTVKVNDRYYIGKYTSYITDDLTLSATYGKSRQTDFRNNPSTAPLLTNTNLQDPAITGGSEIRNNQTSSQARDGENKTRGLRIDLEYVLGSHTLTAGVDNMYFNANNEGVITTGPGYRWIYGRSSRPTSPISAALGVGPAGGNGYYVYRSVFNTATSMSVAQKAYFLEDKWQVNDKLLLTLGIRNDKFTNFNDAGEAYVTSGDQWAPRLGLSWDVFGDSSLKVYGNAGRYYLALPNSVAIRGASPSTFTREYFTYSGIDAQGSPTGLTPVAVDPSAGFSCSGNIVSSNLECGQAPDAAGIAATDLKSMYQDEFMLGFDKTLGESWVTGAKATYRTLGATIDDVCDADRMRTKLTASGVDPSTVNVPGCIIFNPGETNSFSLANLDGSGRTSVTMSPSDWGFDKKAKRTYLAVDLFLQHPFDGKWEGRIDYTWSRNFGNTEGQVKSDIGQTDVSKTQDWDAAALMWYSGGYLANDRRHQIKLYGSYQIAPEWLIAGNIRILSGTPKSCLGYVSINGISEDSDAGDPVGYGSSYHTCNGQPSRPGDAGRLPWTKIVDLGLTYRPAFADNKLAMTLQAFNIFNERKPLQVDSTWEDSAFTLSNTYGMGLYFTQPRYAMFSVSYDY

SEQ ID NO: 12744 - protein, 170 aa, Oligotropha carboxidovorans
MRAIIFSILVLFSVNAHSNDFQFGASTILSDYDAEYEGSYKINVAYLFDDNFSVEASYIKLGTNSDGDGNEEFDAKGIAIMGIYKYPINDFALYAKLGALKWKEEGFYNIWWETELPKRKVPAKDNGTDAIYGVGISYSLTNNIAVKFEIDETDFNAGTLLIGLGFDISF

SEQ ID NO: 12745 - protein, 785 aa, Oligotropha carboxidovorans
MFADMHYIRAVIFLFVLLSQVPPLFAQVKRTVSGAITDAETGETLIGASVRLIGPASANETSIAAVVSNSYGFYTVSAVEGTYTFVVSFIGYQTESRQLVLTRDIKVNIAIKDNNQLEEVVISATKRDENVSSPQMGLQKINVSEINSVPVLLGERDVLKTLQLLPGIKSAGEGNTGFYVRGGATDQNLILLDEAPVYNASHLLGFFSTFNSDAIKDVSVYKGGMPAQYGGRLASVLDIRMREGNRKEFTTEGGVGLIASRLKVEGPIVKDKGSFMISARRTYADAFLKLSSDSSINSNTLYFYDLNAKANYQLDENNAFYVSGYFGRDKLGIAETFGFNWGNGTVTLRWNHLFSQRLFSNTSIIYSNYNYVIKNMLDDNNFEISSAIKDFNLKQDFEYHPGGRHQLKFGVNAIHHTIDPGELTASQTSSVNPTTYESRKGLELAAYFSDEWNVSGQFNLVYGLRISSFSLLGPGNFKTYDTEGEVLAEQYYGSGKTVKSYLNLEPRLSMNYQLSASSAFKAAYTRNVQNIHLMSNSTATSPTDLYIMNSNNIRPETADQLATGFFKNFEDNKYEFSAEVYYKWMQHQIEYRSGTDLRGNQEVEADLLYGDGRAYGIELFFKKRFGRFNGWIGYTLSRTERRFDTIDEGSWFYAKQDRTHDVSVVGIFKVNARWTFSSVFVYNTGNAVTYPSGKYQVNGRTAFYYAEKNGYRTPAYHRLDVSATLEGKPGRKLHSSWSFGIYNLYNRHNAFAIDFKDDPVDLSRTQVVQTTLFGMIPSVTWNFKF

SEQ ID NO: 12746 - protein, 529 aa, Oligotropha carboxidovorans
MVENFDLVEGPPGAVFGATQPSNGYVNYITKQPHFDKFRGYVWDTTGMYENYMWGADIGGPVDKEHKVAYRFSYMGIENGSYYQYVHNNQQNFYFALGYNPSENYQADLYFDYGNADYTPIEVLLDRPTQSLIDNGLYITGFLPPSAVTAGTENNPPANTYLNGELPISRRATVKYPGDIGQANFAMTQLIQRIHVNDNLEIVNNTFFWYQDQTAIRFETYEANVFKGDYEIDNRTEARTHFDTDLGSGHNLLNIKHFIDSGFEFRFQRTLDYQSEVYLGNSWDAITENPQLYNFLLSNNFGSFGLYPIPGSPAGGYFIPLNDETNQTQFFRLSPFYQHQMNFSDKIILFVGTRMDGYFVHSQTPPGTPGFLFQSLNTTQLNPLVNAAITYRPARFVSLYFNYNWQYTTNASGGGGYSPLFPPTAFHLLNQLIEGGVKWNLLNEKLYISLAGFSEDTYLGNIEFPATPASFKGLEANLTFQPDKHFWIRLGYLLEQGIEDWSGFPEGPEMAQTYSTQFAKQYGLPLNND

SEQ ID NO: 12747 - protein, 841 aa, Oligotropha carboxidovorans
MHKKVLLALTASLICQESLFAKDKDYTLGKVSTAGKKDRSDYSGQVNLGYSGITAPKSWQDEEVKKYTGSRTVISNKALTQQANQSIEEALQNVPGLQIRNATGVGAMPTIQIRGFGAGGSGHSDATLMLVNGIPVYMAPYAHIELDIFPVTFQAIDRIDVIKGGGSVQYGPNTYGGIVNIITKPIPNQWENQAAERITYWAKARNAGFAAPPDKTGDPSFIKSLGNNLLYNTYVRSGGMINKHVGIQAQANWVRGQGFRDNSPSSISNYWLDGVYDINESNGIKAYYQYYDFAIAQPGSLSEQDYKINRFANLRPLNQKGGRSQRFGAVYENRFGDLDRVGGTFSFTYYGQLMTRDFQVSSSYNSANMVTCFSEAACRAAGLPAGYNLAVPYYATNYNGWAEVENPVRSINNAFEPKVNLIVNTGKVRQTFIMGLRFMTTTFLQRQYLNTNECATKTSGEGAGFLCEGPNVMSGWKPHIKHGVYRNWNNWRNNYTAVYLSDRIEAWDGRFFIVPGLRYAFVQYNNENASNWMQIPEKDLRKIKHMNNWMPSTNIGFIPVQGDHNVLTYFNYQRSFVPPQLDVLSYGGAEYFTQHFDTVEAGARYTYKDKFSFNADYFRIWARDFATGQYSVYTSGPMKGNVRPINGYSQGVELELYYRPIRGLQFHAAFNYIDTRVTSHGPLTDLNGDVLKGTSYNKHFPFVSPFQFIFDARYNWRKTTIGISSYFYSRAYSGISNSAAGGYYGMQYYSGGNNYESVLNSGYQCEAWCMTQHEGLLPWYWVWNIQVSQIFWENGRHRVTGSLQINNIFNMKYYFTGIGSSPAGLQPAPGRSVTAYLNYTF

SEQ ID NO: 12748 - protein, 777 aa, Oligotropha carboxidovorans
MQPTRLTPLARTLRNLVLGASLSFSALPLAQAADTKAYHIAPSSLENALNQFGREAGVLISFGSQVTSGVQSRGLEGSYTAEQGLNALLEGTGLQARAEGGNAFSLQPSNDGALELDTSKVVGDWLGEAAQVNVFEHPGARDVIRREEFERQGATQARDVLNRIPGVNAPENNGTGSHDMALNFGIRGLNPRLAARSTVLMDGIPVPFAPYGQPQLSFAPISMGNMDAVDVVRGGGAVRYGPQNVGGVVNFVTRAIPDEPTVKGGFQTETSPSSSHDGFKTSANLLAGGTNANGLGGALLYSGTRGGDWREHSDTEIDDLILKGKYQLDEANSFNAMAQYYEGKADMPGGLNVADYDADPYQSTRPKDQFWGRRTMFNVGYRYQEDRREFTANTFFTKTLRSGYLDQGTFLSLSPREYWVRGLETRFAQGFDLGATSHEVGVGYRYINEAGHELRYRTPISSNEYPTTNSRNDRDTRGGTEANAFFVDDRIDIGKWTITPGVRYEMIESQQTNNLTNVKYKGDYNTALPALNVLYHLSDSWNLYANTEGSFGSVQYSQMPNRVSSGEVKPEKARTWELGTRYDNGALRAEIGAFLINFDNQYESNQTNDSVIARGETRHQGIETSINYALDDLSPALAGFDVYATYAYVNATIREDGPNKGNRVPFSSKHKGTIGVGYTEGPWKLNLDSSFQSDQFADNANTSKESADGSTGKIPGYMLFSSRAGYDFGPQLSDLNVAVGVKNIFNTQYFTRSFDDNNKGKYVGEPRTVYVQTSVAF

SEQ ID NO: 12749 - protein, 687 aa, Oligotropha carboxidovorans
MGRGSRLPSAAYGSTHDMRGQPMMMATALICAFVPGPQLAFAAPGSAASPDSTTLPEITVTAEKIERPLERVPASVAVIDGWDAEQSGITSLKQLEGRIPGLSFQPFGQAGMNSPVMRGLTANFNSFSSSTLLLVDGVPTLTAQGFESGMLDLDRIEVIRGPQSTLYGRNAEAGVIAIHSLPMDATPRASVSAEAGSRNKRVMRFALSQPLVEERLYGSVSGNWSSQDGFIDNTHTGHKADDREQKNLNLGLRWAPGAATDVVMRYAHQEYDDGASLWGSPGAPRKRVASGTPSWNRSEGQTLSFNVQHEFASGLRLHSVTAWNEFKDRIQQDTDFMPADVLHVGRDHHLRTLSQEFRVEGQLGEASWLAGVYADRSDNDLHSTSKTMMGLSDIRADQQSDTAALFTHWNVPLSADWSIDAGARVERNEVQLRPQGATSHEKGWTHVSPRLALQHQITANHQWYVSASRGVRTGGFNVLAPTLGYLPYDTEKNWSYETGLKGWLLDKRIRYSLAAYLMDIDDMQVMQMPTVGVMYITSAATATSKGLELDVDYLLGGGWQLKGGLAWNHTRFDHFRDGEADYDGNQNPFAPDLTGHLGIRYDAPEGWYAQASVTGSSKVYLDAANGYERNGYGLVNLVAGYQRGNWEIAAYADNATDQRYDAVGYQNGFVTVYSPPREAGLRLTWRL

SEQ ID NO: 12750 - protein, 410 aa, Oligotropha carboxidovorans
MAAPPEGNERALIMKLKLLAGAAMAAAFAASAAQAQVGWYGAVDLGYHWPEQFEMDSSNNAPNGNPYVWDFNQEEDWAGFARLGYQVTDNWRVELELGYRGGDLESVRGGSNQAVLGLCTPGVVRTAAAPTCGSPDGDVTSWTVMGNVIYDIMPGSSINPFIGGGIGINHVSMETLGQFSNVPGITAANPAIQNLTIDDDDTAFAWQLLAGVAWRATDRLNVDLTYRYLGGSDLDFDSTGSNAGGLQPGVFSGEYRDSSVTLGLRYSFAAPPPPPPPPPPPPPPPPPPPPPPPPPAPAYEAKQFIVYFPFDQYVLTPEAQQVVTEAANYAKGGNATRVVVVGHADTSGSQAYNVRLSERRAKAVADALVGSGVNQTSLSVDWKGETMPAVATGDGVKEPLNRRSTIDINF

SEQ ID NO: 12751 - protein, 1519 aa, Oligotropha carboxidovorans
MTKISDVQEKNFLKRKEKSSSLRNRKFFQPLIATTLAFSLASSFVNAADAGNAGQAPVNAEGITVTVNQANKTATVSGNNGNATFTFTNGANTTVNGTADPAVTAPNIEVNIANTVNNFTVDGKPANQANQNLGAEGKPVNLNFDFGGIASSGTAKTFTLNLGGAGNANALTGNLNILGAGNATLNTNTNGSIASGGPVINVNKDATFNATFSGGATMTGNIVTGNTKETSGTGTNNITFDGPKQIPHNGSLIKDGTAVTGQADPATVLTGNISTYGGINNVTFEKGTMKGDIIAGNATGQSLGMNVVTFKEQGVHYTGNVIASGTGGVNNTLNFGNATVDATNGGNTLIIQNSGITFNNTNGVNNSPTLTHATITPAAAGGDPANQATVFQGNIKSAYQGVNTLNFYNFAKLEGTPANKANPAPAANITATNNGANNIVFTDGGLVNANLTSTLDQGINTLVMNTNNIVTNPILLTGNVVTNTPGWAGSNTLLFQNNGTSSTGGNAMQTLTNQVAYVGNIVANGGSVQAIFSNTYWAPTNLKDLKEQAGGLNAAGAAGANARANAQAKSQQIQGYLDKFNGNSANATGNLTATNGGTATLVLRNTTTLANLPRQAAQYNVTVGGNNSSANIVLEAPVNASATITYGGYYLGGNGTSNYVWNGSQNTSSVNLIFANADNRGTPTLNGATGSSTLVSDAFGGQFRNDLGAGKVLGVTYQNGIQMSLSDKNVTLQGQNGLYSGSFMAFFKDAILAKIAKVDSNAEFATQGIPLNVSLVKSGNGTSSPGSGGNSFVNNITLEGVAVGSITALTNKQATGTNGMNNTSGIVNLVLKSDSVLLGTIAGENQKGLTMNMQLNQGAKLILQNSGAGTGGDVALNNLTIASGNNGNGNNGAAVTFQGGSVSFDKNQANDYTALQNNTVIDLATGGGSNNVPSRTWFNLLTVGQANSSNTTTASDGQQASGLGGNNALFKVYVNADANQGNGAGGGRGNATLNGQNSFNGSGLYGNIYSDRVIVYQTQEQHFCDRISPNPRQWKSYGVRYHGGGTERAGNVAVATVKNEGGQASVNFTTVGSVIGFDVFDAKLTAVKTNAYGKVETNNANNAGNSTPAPGLGSIPGLGGTGGTSSGNGTGGSQDQANAQDYTTYFISQAVANTSEANQLATATALASNYYLYLANIDSLNKRMGELRSNPRSNGFWMRMFNGMQTTKFALQTTSIYTTVQAGWDHVFGSEGGNDFLGFAVAYAGAAMSSEKKEQLVNGAQKGVKSSGGNAFEISLYNSYVQDGAASSTDFKYGFYSDSVAKFSFLWNKLTMFGEDSSPNMQNFGFTFSQEIGYRFLLGNHNEWYITPQGQVALGYFNQSNIKQTLGSHWLKGEQSSIFTVQGRIGSNFGYRFNQFTEDKGWASELYLGLWYIGDYISGGNLTLVSDLGSVNTLRTLSSTGRFAFNIGTNFVVKDNHRFYFDFERSFGGKIITDYQFNIGYRYNFGENRKYVSLLAGSMKDTIKKDDKKENKEETEEIE

SEQ ID NO: 12752 - protein, 613 aa, Oligotropha carboxidovorans
MTRLLATTALAVVMASVAAPALAQQRSYSSIVVFGDSLSDTGNLPAPLRPGAPYVGGRFSNGPVWAEQLGTLRGTPVQSVALGGARSGRVQPIDLQFQLDQYLAARPQLSGDALYAVWIGGNDYLAYASNPVGDPFQVVGTTVGNTVAGATRLIQAGARNLIVLGLPDLGSTPGVAANGSAAAAQASQITDVHNANLQQAVRSLRAGTGASITYVDIGALIRSVVADPSAYGLSNVTVPCLGTSGPTGACATADAAAATLFFDPIHPTVTGHQGIAQYVNGTFAALYDAPAAYVATSQLGLRLFELAAQGVQSRMAAARTGRGDVGLLGSARAGADGRYGLYAFGGYVDGERDRIPGQFGYDYDAWNVGAGLDYQVDENFLAGIALGYADGSLDLEGGAGSADAKSYSVQIYGTAAWGPWYADGSMGYSYEDYGTLERSTRFAPYPLAEADTDGSTYGLSGRAGYVIQAGGFGIGPEVGLRYLNTEVEGFTEEDAGPLALTVERSRAESLIGSLGVQASGRFGDDGLAVVPALGLAYEHEFLGDGRSLTARLANGEVGMTEVGAGDRGRIVLDAGVTVETAAGLLLSVGYRGEPFGGSDREDHAVVGRVRIGF

SEQ ID NO: 12753 - protein, 744 aa, Oligotropha carboxidovorans
MHAPRHYSFTLPSALTVALVACWGSYAHAQSTGQQPANTASEPESVNAIGASQVSGPVRTLPAVTVTGAPESLRSDLMPVYAGGQVARGGSLGLLGNRDVMDTPFSLTSYTAQAMQDQQARSINDVVKNDASVRTIWSDSSYGSQFMIRGFPVQGQDMAVNGLYGIIPPQFSGGVELFERVEVLRGPTALLNGMAPTGAVGGTINLVTKRATDTPIAQVTGSYASDSQFSGHIDLARRLGERNQVGIRFNGLYRDGDTTVDKQGQRLALAGLGLDYRGERVRLSADLGYQNLKSDNPGRPIYLDSGNFDVPRAPKGSSNLGQSWYNAKSEDTFGMVRGEVDLTPNLTAYAAAGGRKNRFLGLYDFIYLQNEDGDFRGRQYYQPTYADTWTAQGGLTGKLKTGPLNHTLDLSFTTLDIESGVLAQVPADYSGSNLYDPISVPKPSLDAFSSHAPKTAHSKLSSVALADTITMLDERVQLTAGVRRQSVKVDNYSAVTGAKTTSYDEHAYSPSVALLVKPWQHVSFYGNYIQGLSQGPSAPAAATNAGTVFAPIKTKQYEIGAKAEFDGFGATIAYFQIKQPSGFLDGSNTYVMDGEQRNRGVEINAFGEVARGVRLLGGVSFIDGELAKTQGGTNDGNKAIGVPDTMLNLGVEWDLPYVSGLTVSARYLYTDSQYVNAANTQEIPSWNRVDVGLRYKTRLLDRNVTLRANVENLFNKDYWAGATSNFGLARGVSRTFLLSATVDF

SEQ ID NO: 12754 - protein, 897 aa, Oligotropha carboxidovorans
MRYVKLATISYAALAAVAPLAVAAQDVAPQATQDDDVADIVVTGIRSSLQGALNAKRNSPTVLDAISAEDIGKFPDKNVGEALQRVTGVQITRSDGEGSGVTIRGADPSLNRVEINGTTALSTTVGGGRDVDFRDLPSEFVNRVEVVKSATADMTEGGVGGTVRIITRRPFDNGGKPYLAGSAQAIYADIGDHMDPRLALIGSDTFADGTIGILVSGTFENRNVESHQARTTGWVQLRDPNGDLYDLNDDGMGDFFPDIPRYVINRLETRRYALNGILEWQPSDDLKAYFEGNWTRSNQSVTSQYLQTGTSGGIVDTENTIIGPDNTVQHLEMTNNPALAQTSQLGVSYRNILGDIRRTTYNLALGAEWTTGNLTLTPKISYSKAKAYNNEINATAAVTGMDSLIVDYANGQNAPNIILPNDPTTRAGINQLTVLRRPRYDDQSEKMAKLDAEYKPDGGFLTSIKIGGQYRDLKVTSKFFNRSTVLNGFSDPAVQQQIDNAVGFASLGTAPFFHTGDLGFSDGYRGWLNMTQGVADAIGVPDPFEANGCPTRPGGTCQVFTDTWEVGEKNLAGYAQAAFAFDVGAVPVTGVIGARVVNTKVDTSGYLSQGGIVSPVAYDSKNTEFLPSLNMKAELIPNKLMARVTATEVMARPLPQQLAPRFTLDVVGLTGSRGNPGLQPFRARQYDAGLEYYINRTSFASVTYFRKEISSFIQNTTEDYTDPATDVTYTITVPTNGTQKVTINGVEAGAQLAFDFLDVPVLKQMGVIANYTYSKDSGYEGVDRFTGDSLPFQGLSRHSYNLSAYYEDDVVSLRGAYNWRSKYLINAAGRGGNPEFGEAYGQLDASLNITVMPGVAFFLEGVNLLDATRKENANSVYRRTIIETFGRRVYGGVRLKL

SEQ ID NO: 12755 - protein, 1029 aa, Oligotropha carboxidovorans
MLKIVRPVSFVLLSAAFCSGGVVHASDRAAITPRVGISQQEGSLKGTVSDSFGPVAGASIVVKGTTNGTVTDMNGNFVLDVKKGDVIQVSFIGYLTQEFKYNGEPSINVSLQEDTQKLDEVIVVGYGTQQKANLSGAVAQLDSKELTSRPISNVSSGLQGMMPGVTVTSGQGRPGQDGSTIRIRGVGTLNSASPYILIDGIESGSMNDIDPNDIESISVLKDASSAAIYGSKASNGVILITTKRGKTGAPRISYNGYVGASKATSMIDRVSSADYARLWNRFEPGHYSDEDIRMFEDGSDPYGHPNTDWNDEAYRTGLLHKHNVSITGGAENVKYMASAGYLGQTGILPNSDRKQFNGRTNLDMQLTKKLAVRMNMSFIKNDFSDPNASYYGGSSDQIIRQLNIISPMIPVKDKDGKYGQTNDGNPIAWLDSGQTVDNCNQNFTGALSVDYDIIDGLKATVTGAYVNEDQRHTERVLSIPDDPASASRTTSLVERFVNWKRYNFDALLNYSKNFGQHGLKVMVGYHAEKYEVSKNQMQRNNFPSNSLNDMDAGGASTQTNDGLSRELAMLSYFGRINYDFAGKYLLEANFRADASSRFAPGHRWGYFPSFSGAWRISEEEFMESTHDWLSSLKIRASWGMLGNQDALNKSNPWENQYYPWMQTYNLDGNYPMGGNLTTGYYQKAYRIEDLSWEKSTTWGIGLDAVINHVTFTFDYYDRKTTDIIMEVPVPTEFGLDPYFDNVGSMRNRGVEVQLGYNNKWNDWSLNVMGNMAYNKNKIEDLGGVDRMTNPDDGDLWRFVGKPIDSYYVYKADGFFQSDAEAQQWMDTYKGKDGYPFGQDFQAGDLRYVDTNGDGKLDADDRVLSKTINPVVTFGLNLNVGYKAFDLTLNFTGAANVGRAFTKEAFGEFSGSAGHPSTAWLDSWTPENTNASMPRVAESRKSPSEASNVMSDFWVINTSYLRLKTLQLGYTLPKSVLNAIGLSNVRVYYSAENLFTIDSMPLNVDPETVSSRLSSYPLVMTNSFGVNVTF

SEQ ID NO: 12756 - protein, 242 aa, Oligotropha carboxidovorans
MRGGVGTTTITAALAWSLQMLGENVLVVDACPDNLLRLSFNVDFTHRQGWARAMLDGQDWRDAGLRYTSQLDLLPFGQLSIEEQENPQHWQTRLSDICSGLQQLKASGRYQWILIDLPRDASQITHQLLSLCDHSLAIVNVDANCHIRLHQQALPDGAHILINDFRIGSQVQDDIYQLWLQSQRRLLPMLIHRDEAMAECLAAKQPVGEYRSDALAAEEILTLANWCLLNYSGLKTPVGSAS

SEQ ID NO: 12757 - protein, 920 aa, Oligotropha carboxidovorans
MGAQTTITGVVKDAKTGETLPGANIKISRKAVGTNTDFDGKFVLTTTDVPPFTLEISMLGFQTEEVQITKNNQEVTVMLKENETALDEIVVSASRTPERIMESPVTVERMDTRAIKNTSAPSFYDGLENLKGVDINTNSLTFKSVNTRGFATFANTRFMQLVDGMDNSSPALNFAIGNLLGMSELDVKTVELLPGASSALYGANAFNGIMFMTSKSPFDDQGISVSVKGGYTSQEAAGTNEFYDMNIRMAYAFSDKFAAKATLAYLDGTEWFATDYRNNREGTSVDGDYIAGTRETDLNYDGLNIYGDEVTTNINGVAQTLEGLGIIPNGSSALIPSVDVSRTGYEERDLMTYEAKSVKFGGSLNYRPFGDDRLEIIWNSKFGVGNTIYQGTNRYNIQDFYLAQHKLEFRGKNFFVRGYVTNEDAGNSYDTRFAAININRAWKDDNTWFGEYVGAYLTGTLGGLNSDQSHALARQTAETGRFEPGTPEFQAAFNRVTSDPDLVTGSKFQDQTKLYHGDVNYNFQDVIDWAEFQVGGSYRRYSLNSNGSIFTDYDGPIDYDEYGVYTQMQKKFLEDDRLKFTASIRYDKAQNFDGNFSPRVSLAYAGGENKNQNFRASFQTGFRNPTTQDQYIGLNAGRAYLVGSAPDNLDRYQTQPLLVSGFGQGILGTATTTVSGRAAYENSFAASSVTAGAPVAANVDLVAPEKVTAYEVGYRGLVNAGSQRITVDLSAYYNSYEDFISGKNVITPFYGTVGDNSLSLAALANGDFTVFQTYTNTAADISSYGASIGLNTKILNGFDLGLNYTYAKFDFDRDSDPDFEPGFNTPEHKVKVQFGKTDLFENFGFNINLRWQDEYLWESTFMDATIEGRTVLDAQINYSVPSIKSIFKLGGANLTGQEYLSAPGVGAIGSQYYLSWTINN

SEQ ID NO: 12758 - protein, 681 aa, Oligotropha carboxidovorans
MHVCKQRPLSLIHCGFCFLLWILFSNPILAQNHPKSKEVDSLKPLPLNEVILTASKREFRIESPMPVQILSGKQLENLNSLSIADAVRYFSGVQLKDYGGIGGLKTINVRSLGSAHTAVFYDGMTVGNAQNGQVDLGKYSLDNIEAIELYNGQKSTIFQPARGFFSSNTLFLKSKVPVFESGKNANVRASFKTGSFGLVNPSVLYQQKITSKTALSSNIEWTKADGKYKYRYQKKDGYDTTAVRQNGDITALRAELNLNTKFGTNGQANLKAYYYDSERGLPGAILANRYEYVQRQWDRNFFIHASVQNSFFEKHEMLANVKFSRDYSRYIDPDYKTLEGALDNKYYQNEFYASIVNLYNIKDWWKMSFAADLSINTLDANLYHFPYPTRYSYLGALSSEMHWKRLDIQANLLGAYIDEQVKYYQQGDSQHVFCPVVSASFQPFDVKNFRIRAFYKESFRMPTFNDLYYTFIGNSFLRPEFTTQYDFGTTYLIEPKKFLQSASFQADVYYNRVKDKIVAMPSSNLFRWTMMNLGEVDIRGLEINTNLVFKFPEQIFLDLGLSYTYQQAIDITPKGTTYGDQIPYTPRNSGTLTSSINWKNWNLNYSFIYTGERYSQKANIPVNYVKPWYTSDMALIWNGKIEKLPVKISGEVNNLFNQYYDVVLNFPMPGRNYRLSMSINL

SEQ ID NO: 12759 - protein, 1677 aa, Oligotropha carboxidovorans
MPYDAGKDYLTIKGPTEDYKVKRSGEGYVGYKVGIAQVQENGPSQFDGNKQKMTNSSTGKINFFGERSIGMYVYLPGNTTHAIMRNEGEINLRGSESYGMKIAAKSADRAEMVNTSTGKITLGKNGKDSASNSIAMALTADSTVTNGVSLKRGNARNEGTITVKDVQNSLGAYVNVNSSITNTATGKININSTIAELTAAEKAANKKQAYNMGMRADTVSGAEIINNGEITIDGAHAIGMLANGSKLVNTKTISSTNVKNGIGIVGMNGATVENSGTIKVVGTGNTNNIGILINGSTGTVGTPAGATPPSIEVSGDNSTGALVTGAGSSLTMKGNVTVSGNSITGIVANGTTVKLEGDATVKVDNNGAEAGEINKKGSYGIVVKGSAGKFEGKDTTVNTKVTTDKSIGLYSEGELIVKKANVTATDGAINFFAKDGKININGGGTTITGQKSLLFYTSGSGKVTLGGAMTATIKGGTTPSTRGTAFYYVSPIRYGAFNTGAIQNYFNNTFGNGTSTLNHLTLNMEQGSRLFVASNVGMNLSDTSATNLMSGITNAPTITGSNYKTFMLYLSKLTINQAVDLNDSNSNYAQLEIANSSIENANNMTGTQNRQVAMAQENGNDTSGAGYESKEVTLTNTATGVINLTGEETTGIYAKRGRIVNAGKISVGKKSTGIYLVEDDRSPAAAAVGATATNDASGVITVGENSTGIYYKVKNDNADGKGTNTGVSGGISNDGRIESTAKDVIAMSFDSPYSSKTVKNEHTGVIDLQGENSTGIFATGAGTYTAINEGKIKLASSTNVNTPNIGVYTDKSTITLESDGTIEGGDKTVGIYGYGVNLKTNAITKVGTGGTGVYSKGGNITINGGTLSVGENGAEGSNDAVGVYYVGAGGTITNNAANVNIGNSAYGFVVQNENGAAVTLKTSTPNVTLKNDTVYAYSNNRAGSVTNTSVLNSTGNGNYGIYSAGTVANNGNINFGTGIGNVGMYSILGGTATNNARITVGASDAATEKFGIGMAAGYKSSDSGNIINSFTGVINVTGKNSIGMYATGPSSTATNKGTINLSGENSVGMYLDNGATGINEGTITTVGSPKGAKGVVLSNNSKLINRAGAKININSAEGFGIYRVNSEETNITVANYGDITVGGGATTSGEFDPTGGKPLEKTAGGVSLKSPKGTNDINITVNGKPVPNVEKVTNPIGHRGDALISSLGMYVDTLRGTNPINGLSKLNVKKAELLYGVEAAENSNSKYFEVSGKILKPYQDAVKNAQGIKWSHNSAAFTWMALPTVDSNGVPLKVGMAKIPYTAFAGKEPMPVEVSDTYNFLDGLEQRYDKNALDSREKLLFNKLNGIGNNESVLFYQAVDEMMGHQYANVQQRIQSTGIILDKEFKYLRDEWRTASKDSNKIKAFGTRGEYKTDTAGVIDYKNHAYGVAYVHENEDIKLGRGIGWYTGIVHNTFKFKDIGNSKEQMLQAKVGLLKSVPFDDNNSLNWTISGDIFVGRNRMHRKYLVVDEIFNAKARYYTYGIGVKNEIGKEFRLSESFTLRPYAALKLEYGRVSKIREKSGEVKLEVKQNQYFSVKPEIGAELGFKHYFGMKALKTTLGVAYENELGRVANGKNKARVADTSADWFNIRGEKEDRRGNVKFDLNVGIDNTRVGVTANAGYDTKGHNLRGGLGLRVIF

SEQ ID NO: 12760 - protein, 695 aa, Helicobacter pylori
MKIKKSLLLSLSLMASLSRAEDDGFYMSVGYQIGEAAQMVKNTGALQNLADKYDNLSNLLNQYNYLNSLVNLASTPSAIASAIDNLSSSAINLTSATTTSPAYQAVALALNAAVGMWQVIAFGISCGPGPNLGQEHLENGGVRSFSNTPNYSYSTGSGTTTTTCNGASNVGPNGILSSSEYQTLNTAYQTIQTALNQSQGGGMPALNGSKKMVVNINQTLTRNPTTENTYPDGNGNYYSGGSASLIQLKFNSVNDAKNLLQQAATIMQVLTTQNPHVNGGGGAWGFHGKTGSVMDIFGDSFNAINEMIKNAQAVLEKTQRLNANENTQITQPENFNPYTSKDKGFAQEMLNRANAQAEILSLVQQVANNFHSIQGPIQQDLEECLAGSAGVINDKTYGSGCAFVKETLNSLEQHATYYGNQVNQEKALAQTILDFKGALNTLNNDSKAINSGISSLPNAKSLQNMTHSTQNPNSPEGLLTYSLDSNKYNQLQATTQELGKNPFRRFGMISSQTNNGAMNGIGVQMGYKQFFGKKRNWGLRYYGFFDYNHAFIKSSFFNSASDVWTYGVGMDALYNFINDKNTNFLGKNNKLSVGLFGGFALAGTSWLNSEFVNLNVVGNIYSAKMNVANFQFLFNLGLRMNLARSKKKDSDHAAQHGVELGVKIPTINTDYYSFMGAELKYRRLYSVYLNYVFAY

SEQ ID NO: 12761 - protein, 1112 aa, Helicobacter pylori
MKKTILLLGIYLCIAISNILAQTSQVAGLVVTAEENEPVVGASVLVVGTTIGGITDLDGKFTLNNVPSSARSLQISFIGYKTQTLPINRKGVMKVVLESDSEVLEEVVVTGMTKVDKRLFTGAADRLTASDVKLDGMADISRGLEGRSAGVSVQNVSGTFGTAPKIRVRGATSIYGNSKPLWVVDGVIMDDVVEIGANDLSSGDATTLISSAIAGLNSDDIESFQILKDGSATSIYGARAMAGVIVVNTKKGKAGTSRFNYTGEFTTRLKPSYRTFNIMNSQDQMGIYKELQDKGWLNLASTYRAANSGVYGKMYHLINTYDPETGQFALLNNTLNRNAYLRQAEYRNTDWFDLLFSNALMMNHSISMSSGSDKSTSYVSLSAMTDPGWMKGTNVQRYTANLNTTYNIHKDLSITVIANGSYRKQKAPGTIGQSRDAVTGEVSRGFDINPYSYALNTSRTLDPNEYYTRNYADFNIFNELNTNNITLNVVDLKFQGELKWKPIMGLEISALGAVKYSSSSQEHKITEHSNQAMAYRAMDDATMRDNNPWLYTDPDIINSLPFSILPKGGFYNKTDYRMFSYDFRLSASWNKVFGNDNIINLYAGMEANAQDRSNNAFQGWGMQYDNGEIPYFDYNAFKKMREDNSDYYSLTNTKRRTLAYFATGTYSYQGRYSLTGTFRYEGSNRLGKARSARWLPTWNIGVAWNMHEEKFFEKLQPALSHFTLKSSYSLTADAGPADVTNSFVNINSYTPWRPSASVGESGLHIVELENGDLTYEKKHEINVGVDMGFLNNRINMELAWYKRNNYDLIGAVLTQGVGGETRRNANLASMKSHGYEVSLSTQNIVTKDFQWTTDFIFGYSKTKITDLKSQTYLFDLVTGYGQREGYDWGSLFSIPFAGLDEDGFPTFWWNGELIDKTNYGSINFQQIQDVDFLKYEGPRDPTITGSFGNVFKYKGFKLNVFITYSAGNKVRLDPQFSSTYNDLDATPKDFKNRWMLPGEEKITNIPVIPSARDNQKYSNLNYAYNAYNYSDARIADGGFIRMKEISLTYDFPKALLGSQNILKTLSLKVQATNLFLIYSDDKLNGQDPEFFNSGGVAAPVPKQFTFTLRAGF

SEQ ID NO: 12762 - protein, 485 aa, Helicobacter pylori
MKNHSFKKTIALSLLASMSLCNAEEDGAFFVIDYQTSLARQELKNPGFTQAQELKQLIRDGAVRLQTSAIPLSYYLDILGNKTATLLRESLKNNAQPSQPNGQSTPNPALVNLERSLGILGKLLDLSQQYANQGVIKPLVVDVGKEQIGITDSMLLVAQNIVLALGQVDLSKIQQNKNNGNGQLYENIMKVMLLGAGGTNGAYNGVSVGDIATGMQNFSSQTGLIGANSTVSELNALIKSGISLDRETLRLGSFIEKNICSSASSCFTGSQLIYKKGLDRTINIINAVLGQFESSASSLYKISYIPNLFSLKDYQSASMNGFGAKMGYKQFFTHKKNIGLRYYGFLDYGYANFGDTNLKVGANLVTYGVGTDFLYNVYERSRRRERTTIGLFFGAQIAGQTWSTNVTNLLSGQRPDVKSSSFQFLFDLGVRTNFAKTNFNKHRLDQGIEFGVKIPVIAHKYFATQGSSASYMRNFSFYVGYSVGF

SEQ ID NO: 12763 - protein, 665 aa, Helicobacter pylori
MKNTLLYSAAALIATSAAANAQSIDYQVMSEMFGEPVTTGATGAPQRSTDVPATMIIITQDDIANAPEYDIPGILRHYSGVDVARFSMGQGEVGIRSAAAPYTPRLLVLVNGREVYLDSYGYTAWSTLPVSLDEIQQIEVVKGPQSALYGFNAVAGVVNIITRNPAFGDYANATAEVGTNGYQQYRLSGGRALNDQIALRFSYGRTDGRDFDVEPDATEAVGLRAANPDFSREHFALGGSVQFTDKVGLTFEYTQSEAEVLELTSVYSSAANAYDLTSYQGELGADTDFGYITLSAYRNESQIAYSFGDLDGELTSFKLQDLIKVGTNDTLRFAVEFRTAKTASFPDTTAGDLNYETLAFSGMWNHKFSNRLETTLAVRYDMVDWSRDGSPNPALYPYTQSDYDVSFEEFSYNAALVYKPEAGGTVRLSAARGIQAPTMFDMGFLLPVGTAVLIGDPGIQPSIVDNIELAYDRSLANGVQLRTALFWQNTDDVKSSLGGAPGLFPPNAPLPAYVFGNRGESRLWGFEGSLAGMIGENVDWDLNYTYKSVEDDLAPFPTSTLLDFEGITPEHTVNAHLGWTSGRISLDGYANYVSDTTMPFQPVFGAVASREIDGHISFSGRASYALSDNLDLSLTAQNVNFGDGELTTPVYETEARYWVSLRANF

SEQ ID NO: 12764 - protein, 2899 aa, Helicobacter pylori
MKKFKKKPKSIKQSHQKTILKRPLWLAPLLISGFASGVYANNLWDLLNPKVGGEYVHWVKGSQYCAWWEFAGCLKNVWGANHKGYDAGNAANYLSSQNYQAISVGSGNETGTYSLSGFTNYVGGNLTINLGNSVVLDLSGSNSFTSYQGYNQGKDDVSFNVGAINLNGALEVGNRVGTGAGTHTGTATLNLNANKVNINSNISAFKTSQVNIGNANSAITIGSVSLSGDTCSSLASVGVGANCSTSGPSYSFKGTTNATNTAFSNASGSFTFEENAAFSGAKLNGGTYTFNKGFSATNNTAFNSGSFNFKGTSSFNGATFNNATYTFNNQATFQNSSFNGGTFTFNNQTNQTNSAQHPQILFENSSFSGNATTLKGFVDFQQAFNNSNHQLTVQNASFNNANFSNTGKITINESASFNDTTFNTSINTNNMTITGSVTLSGKNDLKNGSTLDFGSSQVTLTQGTTFNLTSLGDKNSVTILNSSGGITYNNLLNHALNSLTSALKTNESSSDPQSFAQGLWDIITYNGVTGQLLSANIAASKPADSSPSKSSTNPTQVYQVGYKIGDIIYKLQETFSHNSIIIQALESGTYTPPPVISGSKFDLSASNYIDSNTPWYDHKSYIPKSQNFTESGTYYLPSVQIWGSYTNSFKQTFSANGSNLVIGYNSTWTDHNVSSSDTVSFGDTSGSALNGHCGPWPYYQCTGTTNGAYSAYHVYITANLRSGNRIGTGGAANLIFNGVDSVNIANATITQHNAGIYSSSMTFSTQGMDNSQNWNGLNPNGTLSVYGTTFTNQAKDGKFIFNAGQAVFENTNFNGGSYQFSGDSLNFSNNNQFNSGSFEISAKNASFNNANFNNSASFNFNNSNATTSFVGDFTNANSNLQIAGNAVFGNSNNGSQNNANFNNTGSVNISGNATFDNVVFNGPTNTSVKGQVTLNNITLKNLNAPLSFGDGTITFNAHSVINIGEAITNGNPITLVSSSKEIEYNNAFSKNLWQLINYQGHGASSEKLVSSVGNGVYDVVYSFNNQTYNFQEIFSPNSISIRRLGVGMVFDYMDMEKSDHLYYKNVAGFMTYMPNSYNNNLGNSNNTIYYYDKSIDFYASGKTLFTKAEFSQTFTGQNSAIVFGAKSIWTNASDAPQSNTIIRFGDNKGAGSNDASGHCWNLQCIGFITGHYEAQKIYITGSIESGNRISSGGGANLNFNGLQGILLTNATLYNRAAGTQSSSMNFTSNSANIQAQNSYFIDDTAQNGGNPNFSFNALNLDFSNSSFRGYVGKTQSVFKFNAANAINFTNSTNLSSGLYQMQAKSVSFDNSNLSVSVGTSSIKANAINLSQNASINASNHSTLELQGGLNLNDTSSLNLNQSVINVSNNATINDYASLIVNDGSRLNFNGTTNFNSANITTSLNHSSIVFKGAISLGGQFNLSNNSSLDFQGSSAITSNTAFNFYDNAFSQSPITFHQALDIKAPLSLGGNLLNPNNSSVLNLKNSQLVFSDQGSLNIANIDLLSDLNDNKNRVYNIIQAGMNNNWYERINFFGMRINDGIYDAINQTYSFTNPLNNALKITESFKDNQLSVTLSQIPGIKNTLYNISSEVFNYQKVYNNANGVYSYSDDAEGVFYLTSNVKGYYNPNQSYQASGSNNTTKNNNLTSDSSVISQIYNAQGNPISALHVYNKGYNFNNIKALGQMALKLYPEIKKILGNDFSLSSLSGLNPDALNQLTKLITPNDWKNINELIDNANNSVVQNFNNGTLIVGATKIGQTNANSAVVFGGLGYQKPCDYTDIVCQKFRGTYLGQLLESSSADLGYIDTTFNAKEIYLTGTLGSGNAWGTGGSASVTFNSQTSLVLNQANIVSSQTDGIFSMLGQEGINKVFNQAGLANILGEVAMQSINKAGGLGNLVADMLGSNSVIGEHLTPEQKNQTLSQLLGQNNFDNLMNDSGLNAVIKDLIRQKLGFWTGLVGGLAGLGGIDLQNPEKLIGSMSINDLLSKKGLFNQITGFISANDIGQVISVILQDIVKPSEALQNDVAALGKQMIGEFLGQDTLNSLESLLQNQQIKSVLDKVLAAKGLGPIYEQGLGDLMPNLGKKGLFAPYGLSQVWQKGDFNFNAQGNVFVQNSTFSNANGGTLSFNAGNSLIFAGNNHISFTNHAGALNLLSNQVSNINITMLNVSNGLKINAANNNVSVSQGNLFINASCAGQSDPATANIANPCVLSTQSANGASSSNASNNAQIALNNNDESLMVTANDFNFSGNIYANGVVDFSKIKGSANIKNLYLYNNAQFQANNLTISNQAVLEKNASFMANNLNIQGAFNNNATRKIEVLQNLTIASNASLSTGIYGLEVGGALNNFGAIHFNLENIQTPTPLIQAEGIINLNTTQTPFMNVNNSMANNTTYTLLKSSRYIDYNINPNSLQSYLNLYTLININGNRIEEKNGVLTYLGQRVLLQDKGLLLSVALPNSNNAHQNNILSLSVLHNQIKMSYGDKVMDFTPPTLQDYIVGIQGQSALNQIEAVGGNNAIKWLSTLMMETKENPLFAPIYLKNHSLNEILGVAKDLLNTASLISNPNFRNNATNLLELASYTQQTSRLTKLSDFRAREGESDFSERLLEFKNKRFSDPNPSEVFAKYSQPNKHPNNLWVQGIGGASFISGGNGTLYGLNVGYDRLVKNVILGGYVAYGYSGFNGNIMHSLANNVDVGMYARAFLKRNEFTLSANETYGGNASNINSSNSLLSVLNQRYSYNTWTTSVNGNYGYDFMFKQKSVVLKPQVGLSYHFIGLSGMKGKMNDAAYKQFLMHSNPSNESVLTLNMGLESRKYFGKNSYYFVTARLGRDLLIKSKGGNVVRFVGENTLLYRKGEVFNTFASVITGGEMHLWRLVYVNAGVGLKMGLQYQDINITGNVGMRVAF

SEQ ID NO: 12765 - protein, 361 aa, Helicobacter pylori
MKLTLKSLATLTLLATSASHAAVIYQANDGSNIDLYGRLGFNISDKKTGDTSGDFDARIGFSARQAINDKLAVIGFTQYQVNAAEYANNISAEDPDDFTARYVWAGIDFSEYGKLTGGRVSSGLIMFTDIGDVFASSDVAMARQANFVDPTAVQVFRQDGTIQYQNTFGNLDFSTAYILGNNTSDLDYGYNAALRYTLDMGEFGRLQPVIAGQTEKASHDKTSAQSDDNADKYTFYGIGTRYYLGDVMLGLLVAQDKVSYLDGSPDSTDTDYEATLVWNVSPDWALRTGYRHLKNEDGDGLKLRDTTFEAQYKLTVRSSVFASYSWRNGEKGTKRTNGSDVSFGGSNPADDYFHLGLRYEF

SEQ ID NO: 12766 - protein, 200 aa, Helicobacter pylori
MYYLRILILSISFLNILNAENLSYMSSSYQIGTVFMRPLNTNKLLQGASILQGYEVNPKNDWAYSRYYFFIDYGNVLFNNDSTLQANMFTYGVGGDFMVAYAKNPINRWAFFFGLQLAANTWILNNKVKDLVVNTWDSLKDFNFRNTYFRAIGKFGVQFRTIVLYHKVDVEIGMKIFLTPERRSLFERSFLFFVSHSWHF

SEQ ID NO: 12767 - protein, 240 aa, Helicobacter pylori
MGLKKRAILWSLMGFCAGLSALDYDTLDPKYYKYIKYYKAYEDKEVEELIRDLKRANAKSGLILGINTGFFYNHEIMVKTNSSSITGNILNYLFAYGLRFGYQTFRPSFFARLVKPNIIGRRIYIQYYGGAPKKAGFGSVGFQSVMLNGDFLLDFPLPFVGKYLYMGGYMGLGLGVVAHGVNYTAEWGMSFNAGLALTVLEKNRIEFEFKILNNFPFLQSNSSKETWWGAIASIGYQYVF

SEQ ID NO: 12768 - protein, 454 aa, Helicobacter pylori
MCFKHKVAAVLAAGAITATMALPAMALENEFHGMYRVKGFISNFNNGSPGEFYEPAGKDSKAPTNSYVEQRARLKYMAKANDDLKLVTHFEIDSRFGDASYGVARNKGGALGADEVNLETKSIYLDFNIPATPVNMKVGMQPWEDAYNGIFVDADMAGVLASSRMNNTSLALGWFRFDDKGSIAGKEARDLLILDGKYQVNKDMVLGGSYYLLNDDVGGTNAIRAITKEIAHTLGVNAAATMGIASVEGFLLYQFGNLEGPGTQRHLNAFAGSVAARAKVGPGSIKTSFLYASGEKSTSRSTSNAFQAVEDIDSGAEHDYESEMRMLRKDKFAGTTDNAIVYTINNKDQGVIFGSIGYDVAITDKLFADAYAGFAAVAKENANKPTNLNTGVKNSSNYLGTEINAEIGYKLFDNLTARLQGGYIFLGDYFKGVAKNGADPDNPYTTRIMMVYAF

SEQ ID NO: 12769 - protein, 586 aa, Helicobacter pylori
MLKFAQYYHLLVKKNAIMKQPGLIPQIYQTLIGLCLFWLTFGILITPKPVRGSPLTFKLPQTRVTSKPQFFSNQPMGQVNSVNRLKDISPGDWAYEALKNLIERYSCMEGYPNLTFYGERSLTRWEFVAGLNACLSTIERLIQNNIAVLREDIETFKRLAKAFEEDVQVLGTRISNLENRTAYIEDHQFSTTTKLAGSVVFSASDVYGTDNRKNNAILDYRTNLNFITSFTGKDLLVTSFFAGNTPLDISFNLATIDVPTPSGITLPLPTAEGTLSSQFAGNTNNQLKLLSFQYTFPVNEKLRLNFAGSITAFHPLVPTLNPYMDDLDSGKGSISEFGQRNPIYAASGGGTGLMFNYKFTEGLKLSAGYLADGLTAGNPRQGNGLFNGGYGALSQLTWDATESFSIAGVYVNEYTPPGRFGFNYNGLGVSGTAVANSLAGQDIPFGGVFGVEQFPTISNAYGVNFSWRTSPTFTVNGWFTTTNTRLIGRGDGNILTYALTFAFPDLGKEGNLLGFVVGAQPYLTHFEGGNPQPFEVDIPYHVEAFYRYGVNDNIYVTPGFIWLLAPNQDNDNATDFIGTIRTTFTF

SEQ ID NO: 12770 - protein, 417 aa, Helicobacter pylori
MIKRFVVIVALLGIVLTANAQEGTSSPYSFYGIGLTKFRGTAEQRGMAGLGAYSDSIHINLQNPASFAKLRLTAYSVGASHQSLSLENANASESASHTTFDYLALGFPAGRLGFGLSVYPSTTVGYNIKPDNGESLSSSDQFTGRGGLNKVALSTAYKVTDNFNIGVDFQYNFGNIQNKSIRFQDDIQFGTREINRSDFLGFSFKVGAIYDTKLTENLDLTATATYMPSTTINVENFRELATVIVGNSGQELVADRQDIELEDSDFKNPSEISLGLGIGKANKWYAGLEYVNSQKSNFNNRSFNNEDVIFDDASKFKVGGFYIPKYNDLTSYLNRIVYRLGARYEETGLNLRGEDINEFGISFGVGIPAGRLFTNANLSFEYGQRGTTDAGLIKESFYNIIIGLSLNDKWFEKTKFN

SEQ ID NO: 12771 - protein, 722 aa, Helicobacter pylori
MQFNLLPLAAAVALALNPLLVLAEEQSTPDLQDQNIEKITVMGKYTVSKTIDTATGLGLSLMETPQSVSILTAERIQDQALNTVVDVVNNAVGLSSSKTDNVRNGFNSRGFSVQNYQIDGVPLSWSLGGDAGETVSDVSLYERVEVVRGATGLLTGAGDPSASINLVRKHADSSDLKGYINVTTGSWDKKQITADVSNGLNESGSVRGRMVAKYVNSDSYQELYQDRKTILYGVIDTDITDNTMLRVGGSYNNNNPKGAMWGALQAVYSDGTPTDWDVSATTAADWSRWETTNVNYFANLNHYFNNGWQLVANYNRMEYETTTKMIYMSGLLDKETGAGLSGQRYHSHGESNSDNFDLQLKGDYQLFNREHEFVVGALYSKQKSYTDTFEPIRDNMSGYDNKPVDNFYEWQNNAFAEPEWSTDANRQLKMDTEQKGFYAATRFTITEALKIIAGGRISSWNREGVSYGTDTNFGDDGVFVPYVGALYDISEQHRAYASYTEIFNPQNVTNAYGEYLDPLKGKAYEIGLKSAYLDDRLHTTVALFKIDQDNLATPNGIVIIDGKPVTNYKAAQGTESTGFELEVVGEFIDGWNITAGYSQFTAEDVEGNRMATTSPRKQFKLFTTYQFVDYLPELTVGGGINWQSDSYSEGGTVKIDQEAYSLVNLMARYNLADNMDLQLNVENLLDEKYYAYMSASSSMSEAYSVYHYGTPRNVTLSFNYRF

SEQ ID NO: 12772 - protein, 376 aa, Helicobacter pylori
MKKIVAPLALFYFCCPAAYAEAPKLFGNLFVQGYYSDANFDADKKQLADKYPTYQGSGKYGEDDFHIKTYKSTIGLRGSEPISATTDVVYQFQFGVNLTESNGSSVDLPNRSNYLGLKNDTWGTIRAGRYWTPVDLINNVVVAKGIWDNNGTTQLSKTTQSVNALNMTDAVPRVSNVLFWQSPERKDLPFELFVMYQADEDNEYHNGEGFGSYLTYKPNNGLVASVAYDKDLEISGSLVRGTATYDLAKSTNVPVTLGALYQVADYDGYSEKEKGMVLSAKLGLSNFARPASVYAQYNRSTDLHGISGADSNQIAIGGEYNFKDNVIAHAYMGYNKAKDVEGYLGTQEDANGELTPLYAKGDSDYFAIGTGLQYKF

SEQ ID NO: 12773 - protein, 773 aa, Helicobacter pylori
MFAPLEHTGAIAKSPASSPRHKRKKHITPLIVGLGLVPSSCLAQATPSNLPTIEVVGKRDEPPMNPIDHTAMGHEVSGERLASKRVISPDTALLLKEVPGISLAQGGGLSSLPVIHGLNDDRNAIEIGGISITSACGNHMNPPLSYIDPSNISKIEVLTALIPVSKGGDSIGGSIIVTPREPIFAPPVPTQVSVTQDNLPILASDNTPVFSGSLSLFYRSNNKNPTIAGTASAATEHFSVNYTGAWTKASNYHAGGGVEVPSTSFAAQNHSATIAYRKEDQFIALRAAYQDIPYQGFVNQRMDMLGNKSLNFDLTYKGGFDWGRAEANAYYQHTRHYMNFLADKNGGIEATSTTGMPMYTSGTDFGYRFKSEILASQIDSIRIGNEFHGQSLNDWWPPVAGSTPSMGSMSMSMSSMMCCETFQNINNGTRDRLGTYVEWERSWTQSWSTLIGIRNDLVWTNTQNVEGYNTMMYGADAARFNASNHARMDINFDVTALVRFAPDAGSLIEAGYTRKTRSPSLYERYTWSTNAMASEMNNWFGDGNGYVGNIALKPEVAHTFSISASWRDAVEGGFEAKVTPYYMHIENYIDVDKLGVLGTGSGQVNLLQFANHDAEIFGVDFSGRARLFRSEDAGTLTLTGVASYTRGRRLDDSGSLYHMMPMNGKVAIEHQIPLLGGVLTTALEGEAVAAKTNVQTLRLEPQTPAYGLMNVRTAFEFANLRFDAGVENLFDRLYYSPLGGVDIASYKAGLNSVLQTPVAGIGRTIYGGMTIRF

SEQ ID NO: 12774 - protein, 355 aa, Helicobacter pylori
MKKALLAMTAAAAASAASGVASAQSTSNVTLYGIVDAGVEVISNVPGSGGAEGTAVRLNSGNLSGSRWGLRGTEDLGGGLKGIFVLESGFDVDTGTSGQGNRLFGRQAYVGLQGGWGAVTLGRQQNALYDLFGAFDPMGVGPRYSLNSVDSAFNGRADNAVKYTGKFGGLTATGFYSFGRDNTEIPGETKVGRNFGGGLSYAAGGFSVGAAYDQFHGGTVALQDRAAKRAAVGAAYAFGGAKVFAGYRWLRDDGVSSATAAETRSNVYWAGAQYRFTPAFLLTGAAYYNDTRNSDADPWMFVLSADYSLSKRTDVYLNVGYSKNKSGSALGLNGVGTVVAGENQTGATIGLRHRF

SEQ ID NO: 12775 - protein, 270 aa, Helicobacter pylori
MKKFVVFKTLCLSVVLGNSLLAAEGSTEVQKQLEKPKEYKAVKGEKNAWYLGISYQVGQASQSVKNPPKSSEFNYPKFPVGKTDYLAVMQGLGLTVGYKQFFGEKRWFGARYYGFMDYGHAVFGANALTSDNGGACKLNEPCATKVGTMGNLSDMFTYGVGIDTLYNVINKEDASFGFFFGAQIAGNSWGNTTGAFLETKSPYKHTSYSLDPAIFQFLFNLGIRTHIGRHQEFDFGVKIPTINVYYFNHGNLSFTYRRQYSLYVGYRYNF

SEQ ID NO: 12776 - protein, 767 aa, Helicobacter pylori
MKRILVSLAVLSHSAHAVKTHNLERVEASGVANDKEAPLSWRSKEVRNYMGSRTVISNKQLTKSANQSIEEALQNVPGVHIRNSTGIGAVPSISIRGFGAGGPGHSNTGMILVNGIPIYVAPYVEIGTVIFPVTFQSVDRISVTKGGESVRYGPNAFGGVINIITKGIPTNWESQVSERTTFWGKSENGGFFNQNSKNIDKSLVNNMLFNTYLRTGGMMNKHFGIQAQVNWLKGQGFRYNSPTDIQNYMLDSLYQINDSNKITAFFQYYSYFLTDPGSLGIAAYNQNRFQNNRPNNDKSGRAKRWGAVYQNFFGDTDRVGGDFTFSYYGHDMSRDFKFDSNYLNVNTNPKLGPVYTNQNYPGFFIFDHLRRYVMNAFEPNLNLVVNTNKVKQTFNVGMRFMTMDMFIRSDQSTCEKTDIINGVCHMPPYVLSKTPNNNQEMFNNYTAVWLSDKIEFFDSKLVITPGLRYTFLNYNNKEPEKHDFSVWTSKKQRQNEWSPALNIGYKPMENWIWYANYRRSFIPPQHTMVGITRTNYNQIFNEIEVGQRYSYKNLLSFNTNYFVIFAKRYYAGGYSPQPVDARSQGVELELYYAPIRGLQFHVAYTYIDARITSNADDIAYYFTGIVNKPFDIKGKRLPYVSPNQFIFDMMYTYKHTTFGISSYFYSRAYSSMLNQAKDQTVCLPLNPEYTGGLKYGCNSVGLLPLYFVLNVQVSSILWQSGRHKITGSLQINNLFNMKYYFRGIGTSPTGREPAPGRSITAYLNYEF

SEQ ID NO: 12777 - protein, 273 aa, Helicobacter pylori
MEFMKKFVALGLLSAVLSSSLLAEGDGVYIGTNYQLGQARLNSNIYNTGDCTGSVVGCPPGLTANKHNPGGTNINWHAKYANGALNGLGLNVGYKKFFQFKSFDMTSKWFGFRVYGLFDYGHATLGKQVYAPNKIQLDMVSWGVGSDLLADIIDNDNASFGIFGGVAIGGNTWKSSAANYWKEQIIEAKGPDVCTPTYCNPNAPYSTKTSTVAFQVWLNFGVRANIYKHNGVEFGVRVPLLINKFLSAGPNATNLYYHLKRDYSLYLGYNYTF

SEQ ID NO: 12778 - protein, 661 aa, Helicobacter pylori
MKKLFIPLLLFSALEANEKNGFFIEAGFETGLLEGAQTQEKRHTTTKNTYATYNYLPTDTILKRAANLFTDAKSISQLNFSSLSPVKVLYIGGKLTIENFLPYNLSNVKLSFTDAQGNAIDLGVIETIPKHSKIVLPGEAFDSLKEAFDKIDPYTFFLPKFEATSTSVSDANTQRVFETLNKIKTNLIMKYSNKNPNNFNTCPYNNNGNTKNDCWQNFTPQTAEEFTNLMLNMIAVLDSQSWGDAILNAPFEFTNSPTDCDSDPSKCVNPGVNGRVDTKVDQQYILNKQGIINNFRKKIEIDAVVLKNSGVVGLANGYGNDGEYGTLGVEAYALEPQKLFGNNLKTIRLEDLRTILHEFSHTKGYTHNGNMTYQRVPTGQTENGKPKDSDGLPYNVCSLYGGSNQPAFPSNYPNSIYHNCADVPAGFLGVTAAVWQQLINQNALPINYANLGSQTNYNLNASLNTQDLANSMLNTIQKTFVTSSVTNHYFSSTSQSFRSPILGVNAKIGYQNYFNDFIGLAYYGIIKYNYSKALNQKFQQLSYGGGIDLLLDFITTYSNKNSPIGVQTRKNFSSSFGIFGGLRGLYNSYYVLNKVKGSGNLDVATGLNYRYKHSKYSVGISIPLIQRKASVVSNGGDYTNSFVFNEGASHFKVFFNYGWVF

SEQ ID NO: 12779 - protein, 617 aa, Helicobacter pylori
MHAEDNGFFVSAGYQIGEAVQMVKNTGELKNLNDKYEQLSQSLAQLASLKRSIQTANNIQAVNNALSDLKSFASNNHTNKETSPIYNTAQAVITSVLAFWSLYAGNTTSFHVTGLNDGSNAPLGRIHKDGNCTGLQQCFMEREIYNKMKNLAESLQKAQGNLCALSECSNDQPNGNKTSMTAALQTAQQLMDLIEQTKVSMVWKNIIIAGVTNRPDGAGTITSTGPVTDYAVFNNIKAMLPILQQALKLTQDNHTLSTNLQDRAMGSQTNREFAKDIYALAQNQKQILSNASSIFNLFNSIPKDQLKYLENAYLKVPHLGKTPTNPYRQNVNLNKEIDAVQNNVANYGNRIDSALSVARDVYNLKSNQTEIVTVYNNAKNLSEEISKLPYNKVNVTNIVMSPKDNYQINPEQQSNLNQALAAMSNNPFKKVGMISSQNNNGALNGLGVQVGYKQFFGESKRWGLRYYGFFDYNHGYIKSSFFNSSSDIWTYGGGSDLLVNIINDSITRKNNKLSVGLFGGIQLAGTTWLNSQYVNLTAFNNPYSAKVNTSNFQFLFNLGLRTNLATARKKDSEHSAQHGIELGIKIPTITTNYYSFLGTQLQYRRLYSVYLNYVFAY

SEQ ID NO: 12780 - protein, 305 aa, Helicobacter pylori
MGRIESKKRLKALIFLASLGVLWGNAAEKTPFFKTKNHIYLGFRLGTGATTRTSMWQQAYKDNPTCPSSVCYGEKLEAHYKGGKNLSYTGQIGDEIAFDKYHILGLRVWGDVEYAKAQLGQKVGGNTLLSQANYNPSAIKTYDPTSNAQGSLVLQKTPSPQDFLFNNGHFMAFGLNVNMFVNLPIDTLLKLALKTEKMLFFKIGVFGGGGVEYAILWSPQYKNQNTHQDDKFFAAGGGFFVNFGGSLYIGKRNRFNVGLKIPYYSLSAQSWKNFGSSNVWQQQTIRQNFSVFRNKEVFVSYAFLF

SEQ ID NO: 12781 - protein, 278 aa, Helicobacter pylori
MNKLLKKGFLAFFLSVYLRADDLVTYTIAKEEDLGYQRFLAKKCLRGKTHPPCFTASKKPKRKPFNIDKSSHYYGTSVVQMSWLQSREKFENHSKYRNIPFAEVSLIYGYKQFFPKKEHYGFRFYVSLDYAYGFFLKNKGALGDSLRASSQIPKSYREKLQRKETFINAIFYGVGADFLYKRAFGTLILGVNFVGETWFYETKIFKQWAKDSLNTYRPNMFQVMLNVGYRYRFSRYKNWAIEFGARIPFLINDYFKTPLYTLHFKRNISVYLTSTYDF

SEQ ID NO: 12782 - protein, 781 aa, Helicobacter pylori
MNGYKRFALSPLILAIASASAIADQDKEETSKKDEQMEEIIVVGKRQTFASNTVSMDMISRRPANASVNTVVQELPGVIVQEADTFGSSDWMTNIRMRGFNTNNGQIGTTLDGLPNGGSNYGGGSKANRFIDVLDLETVEVSQGTADISSRSNEALGGTLNFITSDPLMEENLSLLYMAGDQDASKYRFRYDSGEISPDTYFYLSGSSSQNKDVWDNEAITEKDYLTGKITTIIDGFHITGFATYNSANENEYEYVSLEDYYENPRHDGLHMNWTGIPGLDENYRDGWRALRDNSFYSFQVEKDFGNFSFNTAVYYHRMKGRGDWIPPYITDVDGDGNLDNERSGNTIYGDYEGDDIFFVNAGTNVPGTLIDSCTGRYGLDAEKDPNCYDGNVEGVGSYRTSNYANHRYGITGDVSYDFETGNIQHTLRSGFWYENYDADVTRSWHLVENSAISPEFNETPYWIQYKTEANTKELMYYAQEKAVLGPLSASLGVKQYQVDTTVDHFYNDDRTGQLDSTSDPLLYAGLTYTTPVNGLELFAGYSENYKSIVPGIIDSGLSNSELGGIDPETAENIELGFRYINNGFNAAVTLYDIKFDNRIVQLDTSVLDGIDYKEEVDGSYVNVGGQKSRGAELLTSYQVTSGLRVSGSYTYNDAEYLSTGDTGLDQDAEIRAGNQVYGGPKTFFTIAADYVGSNITSGISLRHIGDRFINFENSATAPGYEVVDAYIGTDIQGVSSSISALRLRLNVNNLLDDEYISAVGSNSVYPGSPRTVTFSVSADF

SEQ ID NO: 12783 - protein, 587 aa, Helicobacter pylori
MKNFSPLCCFKKLKKRHLIALSLPLLSYANGFKIQEQSLNGTALGSAYVAGARGADASFYNPANMGFTNDWGENRSEFEMTTTVINIPAFSFKVPTTNQGLYSVTSLEIDKSQQNILGIINTIGLGNILKALGNTAATNGLSQAINRVQGLMNLTNQKVVTLASSPDTQIVNGWTGTTNFVLPKFFYKTRTHNGFTFGGSFTAPSGLGMKWNGKGGEFLHDVFIMMVELAPSMSYTVNKRFSVGVGLRGLYATGSFNNTVYVPLEGASVLSAEQILNLPNNVFADQVPSNMMTLLGNIGYQPALNCQKAGGDMSDQSCQEFYNGLKKIMGYSGLIKASANLYGTTQVVQKSNGQGVSGGYRVGSSLRIFDHGMFSLVYNSSVTFNMKGALVAITELGPSLGSVLTKGSLNINVSLPQTLSLAYAHQFFKDHLRIEGVFERTFWSQGNKFLVTPDFANATYKGLSGTVASLDSETLKKMVGLANFKSVMNMGAGWRDTNTFRLGVTYMGKSLRLMGAIDYDQAPSPQDAIGIPDSNGYTVAFGTKYNFRGFDLGVAGSFTFKSNRSSLYQSPNIGQLRIFSASLGYRW

SEQ ID NO: 12784 - protein, 429 aa, Helicobacter pylori
MFLQSNEHVGTYYAAVNPELIQPRQALEGDLDCEVLVVGAGFSGLHTALRLVEGGRQVCVIEASRIAWAASGRNGGQALPGWSSDLPPLEADLGYEGARRLWDGMLWAAGEMRELPQRHGFDCDYRVGHLWTAILPRRVGLLYDWQAEANRRWGYEGLRFVAKDELPEWIASERYLAGLYDPHAAHLNPLKLAFGLAAAIERAGGRIHERTRALNYREEGDGYRVRTEHGEIRCAALVLACNAYIDGLDSELSQRMLPVGTYQVATEPLGEERAKSLLPRNCCVTDNQFVLDYFRLTPDHRLLFGGGCTYLGGMPSDIRAATRPYLERVFPQLRGVALEYAWGGHIDCSMRRTPDIGRQGNRYWLQGYSGHGVLPSLAAARAVSDALLGDDETLALYQRLRNPKFPGGQRFAAPLEALGKAYYRLRDLF

SEQ ID NO: 12785 - protein, 1323 aa, Helicobacter pylori
MEIQQTHRKINRPLVCLALVGALVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTVVNINRINTNADGTIKVGGYTASLTTNAAHLNIGKGGVNLSNQASGRSLLVENLTGNITVDGALMVNNQVGGYALAGSSANFEFKAGVDTKNGTATFNNDIHLGKAVNLSVDAHTAYFNGNIYLGKSTNLRVNGHSAHFKNIDATKSDNGLNTSTLDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGASLNSGGNTSLYGTSAGVDAYLNEKVEAIVGGFGSYGYSSFSNQANSLNSGANNTNFGVYSRIFANQHEFDFEAQGVLGSDQSSLNFKSALLQDLNQSYNYLAYSATTRASYGYDFAFFRNALVLKPSVGVSYNHLGSTNFKSNSNQKAALKNGASSQHLFNASANVEARYYYGDTSYFYMNAGVLQEFAHVGSNNAASLNTFKVNTARNPLNTHARVMMGGELQLAKEVFLNLGVVYLHNLISNASHFASNLGMRYSF

SEQ ID NO: 12786 - protein, 744 aa, Helicobacter pylori
MKKHILSLTLGSLLVSALSAEDDGFYTSVGYQIGEAAQMVTNTKGIQDLSDRYESLNNLLTRYSTLNTLIKLSADPSAINAARENLGASAKNLIGDKANSPAYQAVLLAINAAVGFWNVVGYVSQCGGNANGTKSTSSTTIFNNEPGYRSTSITCSLNRYSPGYYGPMSIENFKKLNEAYQILQTALKKGLPALKENNGTVSVTYTYTCSGEGNNNCSKEATGVEKQNGGTKTETQTIDGKNVTTTISSKVVDSRANGNTTGVSYTEITNKLDGVPDSAQALLAQASTLINTINEACPYFHANNSSEANAPKFSTTTGKICGAFSEEISAIQKMITDAQELVNQTSVINSNEQSAPVGANNGKPFNPFTDASFAQGMLANASTQAKMLNLAHQVGQTINPDNLTGNFKNFVTSFLATCNNPSTAGTGGTQGSAPGTVTTQTFASGCAYVEQTITNLENSIAHFGTQEQQIKQAENIADTLVNFKSRYSELGNTYNSITTALSKVPNAQSLQNAVSKKNNPYSPQGIDTNYYLNQNTYNQVQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGLKIPTINTNYYSFMGAELKYRRLYSVYLNYVFAY

SEQ ID NO: 12787 - protein, 949 aa, Helicobacter pylori
MIKKMLLFAFLVFGSATMLAQTIITGTVKDAKTGETLPGANIKVERKAVGTNTDFDGKFTLNVSDVPPFVLEISVLGYKTEKVEVKKNNQNIAVLLSENETFLDEIIVSASRTPERIMESPVTVERLDARAIKNTSSPSFYDGLENLKGVDINSNSLTFKSVNTRGFATFANERFMQLVDGMDNSAPGLNFAVGNLLGISELDVKSVEILPGASSALYGANAFNGIMFMRSKSAFDDQGVSFSLKSGITSQKAAGDNEFKDLNIRMAYVFSNYFAAKATLSYLKGTDWYATDYRDEVDASSTSHFNNTAYNGLNVYGDEVGTILDFDAISGAPVGTFGATRVTRTGYTDTDFMNNEAKSVKFGASLNYRPLGDDRVEVIFNSKFGTGNTIYQGQNRYNIKNFTLAQHRLEVKGKNFFVRAYTTAEDAGDSYDTRFAAINVNRMWSTDSNWFTEYAGAYLGAAASFGVPGMNHDAARAFADRARLSPGSPEFNAAKEIVVNDPNLLTGAKFQDQTKLYHGDANLNLRDYINFAEIQIGGSMREYRLNSQGTIFTDYDGPISYTEAGAYIQGQKRMLDDRLKVTASARYDKAINFKGNVSPRISLSYAVGEDKRHNFRASLQTGFRNPTAQDQYIGLDAGSGILVGTAPDNIERYRSLPYELGINPALAGYINAVAGTTIGATQVLTGDMAYNNSWTVSSLQAFAASRNPADLKKSNIDFVAPEYVTAYDIGYRGVLAGVTIDINAYYNKYEDFIASKNAAAPLYGNVNFSDAVDLGPATGGAQGITPLALIAVANGDYKGIAFDSNSDSDISSYGLGIGLSKKVMNGFDLGFNYSFAKFEEAGGTDPDFEAGFNTPEHKIKVQFGKTDLFENFGFNVNYRWQDEFLWQSSFYDGMVDARSVVDAQINYTIPSLSSVIKLGGANLGGKEYFSAPGVGATGSQFYLSWTIGN

SEQ ID NO: 12788 - protein, 529 aa, Helicobacter pylori
MKQNLKPFKMIKENLMTQSQKVRFLAPLSLALSLSFNPVGAEEDGGFMTFGYELGQVVQQVKNPGKIKAEELAGLLNSNTTNNTNINIAGTGGNVAGTLGNLFMNQLGNLIDLYPTLNTSNIQQCSATNSGSGGGATTAAATSNSPCFQGNLALYNEMVGSIKTLRQNISNNIFQGNNNTTSQNLSNQLSELNTASVYLTYMNSFLNANNQAGGIFQNNTNQAYGNGVTAQQIAYVLKQASITMGPSGDSGAAGAFLDAALAQHVFNSANAGNDLSAKEFTSLVQNIVSNSQNALTLANNANISNSTGYQVSYGGNIDQTRSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 12789 - protein, 825 aa, Helicobacter pylori
MHYWYRLLGFTGGVALFWAAQELSAVAASPQPSDATAVSAPMTLTQATTIITDVAIATEGDQVELQFTATAPLENATVIQRAATTEITIPNANVTQAEVLQEFAPESGLEQIEIRNQADNSVQILIRNGDRQIQTQLITTATGLTLNIEPVLVSTDEDNIEAFELVVTDAEQPYNPRSATTATGLETDLRDIPQSVEVIPQAVLQDRNVTELGEALETSGSIVSSGGRGTSVFGPGFLIRGFAAEESVFLDGIETFSLAALDTNDIERVEVLKGPASVLFGQGDPGGVINLVSKEPLAEPFFGIDAAIGSFANYRGNLDLSDALTENGAARYRLNFSYSNFGSFRDLVDGERVVVSPRLSFDLSEATSLDVYGQYAYTRETIDEGIPFTASGPVDVPRSRFVGEDFGEFSEKRFNLGYDLNHEVNENFSLKHQLQFLQYRPRRYAPLYTFFDETTGNVDRLEYFAGGSYQRFFTNIEAIAKFETGGIKHQVLGGVEYRNTLEQPEFQFSNDYTPINVFDPVYTGVPYAIAPEFFRDDTIKTVGVYIQDQIEFSPQFKALAGLRYDFVEQLRSTQDLGGPRNEFFQSDEALSPRLGVVYQPIEPISLYASYSKSFEPTFGTSRDPDGMNFEPERGRQWEVGVKADLSDRLSFTAAAFDIRKQNVIVRDGAFNGFQTGEQTSRGLEFNLNGALTPGWNVTAAYTLLDAFVSKEDINPDIEGNQLPNVPQNQFSLWTTYDIQQGALEGLGFGLGFFYVGDRPGNIDNEFTLPSYFRTDAAIYYRRDNWRAQLNFENLFDTEYFTAADEFQFATPGAPFAVTAKFAVDF

SEQ ID NO: 12790 - protein, 811 aa, Helicobacter pylori
MNDKRFRKYCSFSIFLSLLGMFELEAKEEEKEEKKTERKKEKNAQHTLGKVTTQAAKIFNYNNQTTISSKELERRQANQISDMFRRNPNINVGGGAVIAQKIYVRGIEDRLARVTVDGAAQMGASYGHQGNTIIDPGMLKSVVVTKGAAQASAGPMALIGAIKMETKSASDFIPKGKDYAISGAATFLTNFGDRETVMGAYRNHHFDMLLYYTHQNIFYYRDGDNAMKNLFDPKANNKVTGSPSEQNNVMAKINGYLSERDTLTLSYNMTRDNANRPLRANFTGTFLPYSCGDFNAFPNEKNPSDCLFENDASLFKTYSVNLVHNVSLNYEREGGSRFGDPKLKINGYTSIRNVQIDPLFKPNDIAAIIPFTPNPKLGEENECVAQGGIYDALKQTCSITFKSLGGGSVVANKNLFIINSGFNANVIHTIDHKNDNLLEYGLNYQNLTTFDKAIPNSELVKPGDAPDACLRVTSPNDPNMNGRCQRNGATANVVGVYAQANYTLHPMVTLGAGTRYDVYTLVDKDWQLHITQGFSPSAALNVSPLENLNFRLSYAYVTRGPMPGGLVWMRQDNLRYNRNLKPEIGQNAEFNTEYSSQYFDFRAAGFVQLISNYINQFSSTLFVTNLPVQDIIYVPGYEVSGTAKYKGFSLGLSVARSWPSLKGRLIADVYELAATTGNVFILTASYTIPRTGLSITWISRFVTDLSYCSYSPYRNGPTDIDRRPSNCPKTPGIFHVHKPGYGVSSFFITYKPTYKKLKGLSLNAVFNNIFNQQYIDQASPVMSPDEPNQDKYARGMAEPGFNARFEISYKF

SEQ ID NO: 12791 - protein, 271 aa, Helicobacter pylori
MAFKFKTFAAVGALIGSLALVGCGQDEKDPNHIKVGVIVGAEQQVAEVAQKVAKDKYGLDVELVTFNDYVLPNEALSKGDIDANAFQHKPYLDQQLKDRGYKLVAVGNTFVYPIAGYSKKIKSLDELQDGSQVAVPNDPTNLGRSLLLLQKVGLIKLKDGVGLLPTVLDVVENPKNLKIVELEAPQLPRSLDDAQIALAVINTTYASQIGLTPAKDGIFVEDKESPYVNLIVTREDNKDAENVKKFVQAYQSDEVYEAANKVFNGGAVKGW

SEQ ID NO: 12792 - protein, 80 aa, Helicobacter pylori
MFLKFCFSSASQSFRIPILGVNAKIGYQNYFNDFIGLAYYGIIKYNYAKAINQKVQQLSYGGGIDLLLDFITTYSNKNRG

SEQ ID NO: 12793 - protein, 700 aa, Helicobacter pylori
MLRFVSKTICLSLIGLFNPLEAFQKHQKDGFFIEAGFETGLLEGVQTKEEVITTQKIYENPLTHPQTKEQPKEQNKSDTATPQSAYGKYYIPQSTILKNATALFTTDNIENGLTFYSQNPVYANMVNGSVTIQNFLPYNLNNVELSFKDAQGKVVNLGVIETIPKDSQIILPASLFNDSEFEQADSFNYQQLQATATQFSDANTQSLFEKLSQITTNVTMSYENADTNNFKGNCNDCVSDFTPQTAEELTNLMLDMIAVFDSKSWEEAVLNAPFQFSNSPSECGSDYPKCVNPFNNGRVAPIYEHYVLTPQSVIDAFRRAINLEVNILKSGFVGLGYELDDNDGNLGIEASALNPEKLFGKTLNKVDIVELRDIIHEFSHTKGYTHNGNMTYQRVRLCQENGGAIQECEGGKEELVNGKEELKFTNGKEVKDQDGYTYNVCSRFGGKNQPAFPSNYPNSIYTNCAQVPAGLIGVTTAVWQQLINQNALPINFANLNSQTSHLNAGLNAQNFATSMVSAIAQNFSTTSTTTYHSSSKNFRSPILGVNVKIGYQHYFNDYIGLAYYGIIKYNYAKTNDEKIQQLSYGGGMDVLFDFITTYANKKQGNPTKKVFASSFGVFGGLRGLYNSYYVFNQVKGSGNLDIVTGFNYRYKHSKYSIGISVPLIQSGIKIASNNGIYANSVVLNEGGSHFKVFFNYGWIF

SEQ ID NO: 12794 - protein, 352 aa, Helicobacter pylori
MNKTMIALAVSAAALATNAVAADGKQAGGIDGTSVYSSNGTSLEIGGRAEARLSLKDGKAQDNSRVRLNFLGKVEIQDGLYGVGFYEGEFTTSDYDANGNNVSGDNTIDNRYTYAGIGGTFGEVTYGKNDGALGVITDFTDIMSYHGNSAAYKIGVADRTDNMVSYKGQFQDLGVKASYRFADRTENKVGDTVISYDDNEADGYSLSGIYAIGDSGFKLGAGYADQDEQNEYMLAASFRTEALYFAGTFTDGELAKDNGDYTGYEFATAYTLDKTAFTLTYNNAETNGDTSADNVAIDATYYFKPNFRTYISYNFNLISKGDKYGQVGNVGNRGATSAEAEDELALGLRYDF

SEQ ID NO: 12795 - protein, 277 aa, Helicobacter pylori
MKRALYLVLGLSYALHADSFKDVLTKGDYTFFNKKVVSPIKRYADQSAFYLGFGYQLGSIQHNYSNLNLSQQFNKSQIIFSDGLSPVFKNSYVSNGFGVQVGYKWVGKHEETKWFGFRWGLFYDLSASLYGQKESQSIIISTYGTYMDLLFNAYNGDKFFAGFNLGIAFAGVYDKLSDELLYQALLLDTFGGKVNLNGFQFLVDLGVRLGNEHNQFGFGIKVPTYYFNHYYSMNNISNNSEDVLKVLRFLEYGINSLLYQVDFRHNYSVYFNYTYSF

SEQ ID NO: 12796 - protein, 534 aa, Helicobacter pylori
MQNFCKYLLVSPAVCCAMLFVSTAAFAGETSATSEINQPQVLASPDTNTHITGQVTSVSQFSDVQPTDWAFQALQSLVERYGCIAGYPNSTYRGNRALTRYEFAAGLNACLDRVNELIATATSDLVNKQDLATLQKLQADFSAELATLRGRVDAVEAKTAELEANQFSTTTKLNGEVVIAIASVVSGNTVNGQEVNQNAVLADRVRLNLDTSFTGKDLLRTRLQATNLDPFSQTATFTPEGDFRFAGGNNSNGVVIDALLYQFPLGNKTGVTLEANAGAIDDFTNTVNPYLDGDGGSGALSQFGTRNPIYYLVNGTGIGIKHEFSDKLELSLGYLANDAANPQLGSGLFNGAYGAMAQLTVKPSNQITLGLTYLNAYKNTFFANGSGGSNNANDILENASSNSYGIEASFQPSSKFVIGGWAGLTKARVLSVTPGDADIWNYAVTLAFPDLGKTGNIAGIIVGMEPKVTSVSGSLSNAGINKDPDTSYHIEGFYQYKLSDNISITPGVIWLTAPDHNNQNDDIVIGTVRTTFTF

SEQ ID NO: 12797 - protein, 1230 aa, Helicobacter pylori
MIKKARKFIPFFLIGSLLAEDNGWYMSVGYQIGGTQQFINNKQLLENQNIINSVTQSAINIAGPTTGLITLSSQTVIDALGYGVSNTVGNQLEGISNILNQIGKRKDFYSSRQISSISQQIIGLKGSSDPLKAHSSQITAKLLSNTQSAFDQGIALSTNIISSINSLNPSNNTQEVKKQLQNTAQSMTELLQQIEHSITKTTSTTYAQSLLSNLTDAVNASSNNTAYVSALVNALNTLGVGVFPTTTTTHVVLNPPGQVVFYPTNSILGSTSSNSNNQQQYNNTLLMNTLQGTLSANTQNNPNGCANQVQCLEQFIQNLAPLAATPTSNNQANQQVQAIAQKLQSVAINTLDNNAINNTTYNLNNLHNALNFQAYESTIEQYNNALKQISWISFTEPKNLLKNTSNNYQIGTVTNAQGQNISAYDCMTATGSLSSNASSGISCSATSSTSSTNSFDNSLVATSKVQTINGKEQIGVNSFNLVSQVWSVYNSLKTSEENLQKNANILCANGTQSGTSSCNSSSGGLSISGNAQLQNILSPTSGTTTNTQAKSNAPKLKAMVVVNNEEEAKTANLAQSSGTTTQSPNSTVMGALNTVLQNVSNFQQSIQNAFQNQESNIQAWANAIYNTNGSQSQEMTPNNNQDLRIQLRANFYQLINTINQQVPTDMNALINQSQQTQQTSGSASNNNACASGMSGSNGNWCYQQWSDSKAYYSGLQSALGYQTQATTQSGSNGGNSITYNVQQITLTSNGLLNQIITNLKSVNGGNGASGTGSGNGTSQINTAYQMLTDASDGKLGTYSSSSGSNNGYTPCNSTNGSNKTSGNNCYEPNKQQNATTATATTDSNLQKVYNDAQKIANIIASSGNNKGVENGLKQFFEALKNNSSSLSNLCGNGSSGSSGTTCSGWLINLLGAIPTNGVSDTNNLINLLTEFIKTAGFIQNNDSSVSTSLTSAFQAITSAISQGFQALQNDISPNAILTLLQEITSNTTTIQSFSQTLRQLLGDKTFFMAQQKLIDAMINARNQVQNAQNQANNYGSQPVLSQYAAAKSTQHGMSNGLGVGLGYKYFFGKARKLGLRHYFFFDYGFSEIGLANQSVKANIFAYGVGTDFLWNLFRRTYNTKALNFGLFAGVQLGGATWLSSLRQQIIDNWGSANDIHSTNFQVALNFGVRTNFAEFKRFAKKFHNQGVISQKSVEFGIKVPLINQAYLNSAGADVSYRRLYTFYINYIMGF

SEQ ID NO: 12798 - protein, 641 aa, Helicobacter pylori
MKKTKKTILLSLTLASSLLHAEDNGVFLSVGYQIGEAVQKVKNADKVQKLSDTYEQLSRLLTNDNGTNSKTSAQAINQAVNNLNERAKTLAGGTTNSPAYQATLLALRSVLGLWNSMGYAVICGGYTKSPGENNQKNFHYTDENGNGTTINCGGSTNSDGTHSSSGTNKLKADKNVSLSIEQYEKIHEAYQILSKALKQAGLAPLNSKGEKLEAYVTTSKYQQNSQTKTTTSVIDTTNDAQNLLTQAQTIVNTLKDYCPVLIAKSSNGSSGTATTNTPSWQTAGGGKNSCETFGAEFSAASDMINNAQKIVQETQQLNTAPLKSIAQPHNLNLNTPSSLTALAQKMLKNAQSQAEILKLANQVESDFNKLSSGHLKDYIGKCDASAISSANMTMHNQKNNWGNGCAGVEETQSLLKTSAADFNNQTPQINQAQNLANTLIQELGNNPFRNMGMIASSTTNNGALNGLGVQVGYKQFFGEKKRWGLRYYGFFDYNHAYIKSNFFNSASDVWTYGVGSDLLFNFINDKNTNFLGKNNKISFGLFGGIALAGTSWLNSQFVNLKTVSNVYSAKVNTANFQFLFNLGLRTNLARPKKKDSHHAAQHGMELGVKIPTINTNYYSFLDTKLEYRRLYSVYLNYVFAY

SEQ ID NO: 12799 - protein, 724 aa, Helicobacter pylori
MLGVSYLCHCSSGRTGRRCTGNESEDLQNKVEKLSIRGKWAVRKWFKIIFIYSMSGRTKVLLVCAVSLGASILRLSAQEVGGDTITGKVHQIEKVTVTARRSPNKVTSAVPIQTMSRQDISQLGIQNMADAVRRFAGANVKDYGGIGGLKTVSIRNMGAAHTAVSYDGVAVSNCQAGQIDIGRFSLDNVSMLSLAIGQSEDLLQSARLYASAGVLGIETEKPHFDDGRNAAFQARVRGGSFGMVSPSLRWWQKLGCRTRVAVDAGYMRADGNYPFTLVNGKYVTEEKRNNSGIYSWQGEATFYHTFKDDSELDVKGYYFYSRRGLPGAVTLYNPLSDETLWDENTFVQARYRKHFSPRWSLQAQAKYNHGWNQYKDEGKEYADGYYRENHRQDEYYISATVLYRPLEALTLSLAQDGVINKLRNSLPECPFPTRYTSISAFNARYRQGWLTATASLVHTATSEHAEKGTVPDDFHRFAPSLSVSMQPWQDESLYFRLMYKSTFRLPTFNDLYYYRLGNRNLRPEKADEYNVGITWSKSGLSVFDYISVTLDGYYNDVTDKIVAFPTTYAWKMANYGKVHAAGVDATLAATVPLTEKIRLIMSGGYTWQKAIDLTDSDAKNYKDQLPYTPLHSGNASAIVETPWVNVGYSAVGVGKRYYLSQNIPENEIEGYLEHTMSLSHEFALGGCRLLLQAEIINLTDEQYDVIKYYPMPGRSWRLTGTFKF

SEQ ID NO: 12800 - protein, 320 aa, Helicobacter pylori
MNTNLKKALFLTTLGYLQANEGFLAIMPDENKQEDISQEQKLEHKMEQKIALQNTLKKQQSAPLQSAELLQSQVKREVKEQKKSQKHLVAMQTKNGFFLGSEIAITGTSLKQSLSLISNATDDLLTYSKTSKNANFNMGLLIGYQHYFGASKRHGIKISSHLYGGTPSDVSTDIKIYKSKVSTNYTPLNFGIDVKYLFDFLNVIKKHRHTLGLSVGFGWRMQYYFAKIDPIKTSHSEFITNKPKDIFNHGFYPTIGLHYYLNHHQFEVNYRFGGAINYQSVVPSKIVVQNGNFKGEVLFSNFLTKATNSSYIAFNYAYLF

SEQ ID NO: 12801 - protein, 293 aa, Helicobacter pylori
MQVTPHYLKTKFLFLALYSVLGFHFSHAIDESGLNELVGKKVQEALAKEKAKAKHQRADKSAFFAGLGYSGMFSWNLAYKDSFVLLSHSHFNFGGRLLERKDPSTILNGFNFKVGYQYAAPVKIKKMGFGVRGGFQYSYKAGNYMEKDKYQQYLFGVIPIISPVSFFNGGMITMSTYSFFMDFLHNVYENEKFFIGYFIGAGLGGESVTANVLKDFGNILAQLAQFQGYGSLGLRMGDKHHTLELSASIHGDAPSCSLKKLKSCESVRVLQAKIPRGIFESYATWSADYVYRF

SEQ ID NO: 12802 - protein, 746 aa, Helicobacter pylori
MLKLASKTICLSLIGSFTAVEAFQKHQKDGFFIEAGFETGLLQGTQTKEQTIATTQEKPKPKPKPKPITPQSTYGKYYISQSTVLKNATELFAEDNITNLTFYSLTPVYVTAYNQESAEEAGYGDSSLIMIQNFLPYNLNNIELSYTDNQGNVVSLGVIETIPKQSQIILPASLFNDPQLNADGFQQLQTATTRFSDASTQNLFDKLSKVTTNLQMTYINYNQFSSGNGSGSKPPCPPYENQENCTAKVPPFTSQDAKNLTNLMLNMMAVFDSKSWEDAVKNAPFQFSDNNLSAPCYSNYSTCVNPYNDGLVDPKLIAKNKGDEYNIENGQTGSVILTPQDVIYSYRVTNNLYVNLLPPRGGDLGLGSQYGGPNGPGDDGTNFGALGILSPFLDPEILFGKELNKVAIMQLRDIIHEYGHTLGYTHNGNMTYQRVRMCEENNGPEERCKGGKIEQVDGQEVQVFDNGHEVRDTDGSFYDVCSRFGGQNQPAFPSSYPNSIYTDCSQVPAGLIGVTSAVWQQLIDQNALPVDYTNLSSQTNYLNASLNTQDFATTMLSAISQSLSSTRSSATTYRTSKTSRPFGAPLLGVNLKMGYQKYFNDYLGLSSYGIIKYNYAQANNEKIQQLSYGVGMDVLFDFITNYTNEKNPKNNLTKKVFTSSLGVFGGLRGLYNSYYLLNQYKGSGNLNVTGGLNYRYKHSKYSVGISVPLVQLKSRVVSSDGATTNSITLNEGGSHFKVFFNYGWIF

SEQ ID NO: 12803 - protein, 231 aa, Helicobacter pylori
MFKKIIFFCVFLMGGFVVFPLDAMPILHDKTPKKNYQEAHEKLYRSIINRQKLTRKKSGWYFLGGFGAVEAIKDYQGQEMKDWIATLDLKTGVQSFFKKYIGIRGVFAWDLGSGKVNYQSHKDPTNSFFTMLAVGLDVIMEFPLGSYKHYLGAFGGARGALVAYTDKQNFKFFKHSVVSGGLAINGGVMLTLFLRHRIELGFKILPTARLLSSSKRFETSPLFYAAYSYKF

SEQ ID NO: 12804 - protein, 248 aa, Helicobacter pylori
MLKRIILLGALGVLANAEESAAFVGVNYQVSMIQNQTKMVNDNGLQKPLIKFPPYAGAGFEVGYKQFFGKKKWFGARYYGFFDYAHNRFGVMKKGIPVGESGFIYNSFSFGGNTLMERDSYQGQYYVNLFTYGVGLDTLWNFVNKENMVFGFVVGIQLAGDSWATSISKEIASYAKHHSNSSYSPANFQFLWKFGVRTHIAKHNSLELGIKVPTITHRLFSLTNEKGYTLQADVRRVYAFQISYLRDF

SEQ ID NO: 12805 - protein, 388 aa, Helicobacter pylori
MMLNFMTKKKNRMQDCKMVCKNFNRKESVLIAQSLDISKKGSVILGALLSSLWLTNPLNAHEKNGAFVGISLEVGRADQKTNAYKNGELFQVPFGDVSANDDGKVPDGQTGGCQPASGTPGTPGYTKANCVVNWTSRTMLSTNKNIPGRNQPMYGLGVMTGYKHFIGKKRWFGLRYYGFFDYGHTNFSNSRAANAISPFYLSDQKADMYTYGFGTDMLFNIIDKPKATAGFFLGVNFAGNTWTNNRVGYFKDGYVYGVNTDADAYMTNADGTITCGDTTPASCNVGINPNSVYTTGKLNAKVNHTIFQFLVNVGIRTNIFEHHGIEFGIKIPTLPNYFFKGSTTIRAKKQGPLENGQPTTITGAETNFSLTQTLRRQYSMYLRYVYTF

SEQ ID NO: 12806 - protein, 879 aa, Helicobacter pylori
MLRNQFRIVFVSCIVASSLQAQENTHTLGKVTTKGERTFEYNNKMYIGRKELQQRQSNQIRDIFRTRADVNVASGGLMAQKIYVRGIESRLLRVTIDGVAQNGNIFHHDANTVIDPNMVKEVEVIKGAANASAGPGAVAGKLSFTTIDANDFLRKNQTYGAKAEAAFYTNFGYRMNATAAYRGKNWDILAYYNHQNIFYYRDGNNAFRNVFHPNYDLQDPSNSDMSVGTPSEVNSVLAKINGYINETDSISVSYNLTRDNSTRLLRPNTTSALSKANDPGSQPAPFVIDFGKELAHTINFNHNLSLKYKHEGGPNFNQPRVESTAFLGVRGGNYNPVVNPFAYNSNEPANPDYIPEVKEWCNNPDNISQCTQGAIRPSNGGYQIGYGAPNSINWQGDSDSSGGVQAGYGQLNATMLSTSANVYHGLVPKNPDYDMTPPNAQNPSANDWTLGNADAEGTLARRIFLINSGVNFKVTHPISEDYGNVFEYGMIYQNLSVFSGLDKGKNGFYKNNIDPNDPNGPGLPYRHYYTDQSSQYPQNLNTPNPLYRNMPQNSHAIGNIIGGFMQANYNILSNVIVGAGTRYDIYTLLDKNGRTHVTSGFSPSATVLYNPIESIGLKVSYAYVTKGALPGDGVLMRDPTVIYQRNLHPAIGQNVEFNVDFNSKYFNVRGAAFYQVINNFINSYGQDTSKNGGGNATAKNMSGNLPETINIYGYEVSGNVRYKNFLGTFSVARSWPTARGHLLADTYALAATTGNVFILKADYDVRRWGLTLTWLSRFVTNMYYEGYSIYYPQYGLIKIHKPGYGVHNIFINWTPPSKKWQGLRISAVFNNILNKQYVDQTSVFQASADAPASDMIPKGKRMALPAPGFNARFEVSYQF

SEQ ID NO: 12807 - protein, 543 aa, Helicobacter pylori
MKFFRQLLLAPVALGLMAPVAATAGEMNLDGINQYAASEDQVTSITQFSDVQPTEWAYQALSNLIERYGCVAGYPDGTFRGKKPLSRWEAAALLNACLDRITEVTDELRRLLKEFEKELAILRGRVDNLEAKVGELEANQFSTTTKLRGVATFTIGANSFSGDARATLGESILNGGKVAPGERFASAAAAQQGATAFNYNLDLYLDTSFTGKDLLRTRLRAGNFGSSPWGAANPDNLVGLNAFEVAFEGGSGADSVEVNRLFYQFPLGKNFTATVGGKVRQDDMLAFWPSVYPADTVLDIFTYGGAPGAYPLTLGSGGGLWWKSGGFSISANYVAANGNVGNPNVGGIGTDGSAQTGTAQIAWNNENFGIAAAYTYTTPQGGLAGLYGGNGTPLANLGYALSDSVNSVGISGYWQPSNSGWLPSISTGWGLNAHSSDTFDQIDGAQSQSWYVGLQWSDVFIKGNSAGMAVGQATFLTKSGDEDILKPNDGNYAWEWWYKFQVTDNISVTPAIFYLSVPQGQFQKANSDTFDNFGGLVKTTFKF

SEQ ID NO: 12808 - protein, 242 aa, Helicobacter pylori
MKKFFSQSLLALIISMNAVSGMDGNGVFLGAGYLQGQAQMHADINSQKQATNATIKGFDALLGYQFFFEKHFGLRLYGFFDYAHANSIKLKNPNYNSEAAQVASQILGKQEINRLTNIADPRTFEPNMLTYGGAMDVMVNVINNGIMSLGAFGGIQLAGNSWLMATPSFEGILVEQALVSKKATSFQFLFNVGARLRILKHSSIEAGVKFPMLKKNPYITAKNLDIGFRRVYSWYVNYVFTF

SEQ ID NO: 12809 - protein, 669 aa, Helicobacter pylori
MKKTLLLSLSLASSLLNAEDNGFFISAGYQIGEAAQMVKNTGELKKLSDTYENLSNLLTNFNNLNQAVTNASSPSEINAAIDNLKANTQGLIGEKTNSPAYQAVYLALNAAVGLWNVIAYNVQCGPGKSHQQSVTFEGQPGHNSSSINCNLTGYNNGVSGPLSIDNFKQLNQAYQTIQQALKQDKGFPVLDNAGKQVTITITTQTNGANKNETTTTTTTNDAQTLLQEASKMISVLTTNCPWVNHNPGQNGGAPWGLDTTGNVCQVFATEFSAVTSMIKNAQEIVTQAQSLNNQQSNQNAPQDFNPYTSADRAFAQNMLNRAQAQAKMLELAAQMKKDLDTIPSQFITNYLAACRNGGGTLPDAGVTNNTWGAGCAYVGETITALNNSLAHFGTQAEQIKQSELLARTILDFRGSLSALNNTYNSITTTASNTPNSPFLKNLISQSTNPNNPGGLQAVYQVNQSAYSQLLSATQELGHNPFRRVGLISSQTNNGAMNGIGVQVGYKQFFGEKRRWGLRYYGFFDYNHAYIKSSFFNSASDVFTYGVGTDVLYNFINDKATKNNKISFGVFGGIALAGTSWLNSQYVNLATFNNFYSAKMNVANFQFLFNLGLRMNLAKNKKKASDHVAQHGVELGVKIPTINTNYYSLLGTQLQYRRLYSVYLNYVFAY

SEQ ID NO: 12810 - protein, 690 aa, Helicobacter pylori
MKKKFLSLTLGSLLVSALSAEDNGFFVSAGYQIGESAQMVKNTKGIQDLSDSYERLNNLLTNYSVLNALIRQSADPNAINNARGNLNASAKNLINDKKNSPAYQAVLLALNAAAGLWQVMSYAISPCGPGKDTSKNGGVQTFHNTPSNQWGGTTITCGTTGYEPGPYSILSTENYAKINKAYQIIQKAFGSSGKDIPALSDTNTELKFTINKNNGNTNTNNNGEEIVTKNNAQVLLEQASTIITTLNSACPWINNGGAGGASSGSLWEGIYLKGDGSACGIFKNEISAIQDMIKNAAIAVEQSKIVAANAQNQRNLDTGKTFNPYKDANFAQSMFANAKAQAEILNRAQAVVKDFERIPAEFVKDSLGVCHEVQNGHLRGTPSGTVTDNTWGAGCAYVGETVTNLKDSIAHFGDQAERIHNARNLAYTLANFSSQYQKLGEHYDSITAAISSLPDAQSLQNVVSKKTNPNSPQGIQDNYYIDSNIHSQVQSRSQELGSNPFRRAGLIAASTTNNGAMNGIGFQVGYKQFFGKNKRWGARYYGFVDYNHTYNKSQFFNASSDVWTYGVGSDLLVNFINDKATKHNKISFGAFGGIALAGTSWLNSQYVNLANVNNYYKAKINTANFQFLFNLGLRMNLARKKHRATDNAAQHGIELGTKIPTINTNYYSLLGTTLQYRRLYSVYLNYVFAY

SEQ ID NO: 12811 - protein, 661 aa, Helicobacter pylori
MKKLFIQLLLFSALEANEKNGFFIEAGFETGLLEGTQTQEKRHTTTKNTYATYNYLPTDTILKRAANLFTNAEAISKLKFSSLSPVRVLYMYYNGQLTIENFLPYNLNNVKLSFTDAQGNTIDLGVIETIPKHSKIVLPGEAFDSLKIDPYTLFLPKIEATSTSVSDANTQRVFETLNKIKTNLVVNYRNENKFEGHQNHWEAFTPQTAEEFTNLMLNMIAVLDSQSWGDAILNAPFEFTNKGGGGECDTSKENDCVNPGTNGLVNSKVDQQYVLNKQDIVNKFRNKADLDVVILKDSGVVGLGSDITPSNNDDGKHYGQLGVVASALDPKKLFGNDLKTIKLEDLRTILHEFSHTKGYTHNGNMTYQRVPVMKDGQVEKDNNGKPKDSDGLPYNVCSLYGGQGQSAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLVDFITTYSNKNNPTGVQTKRNFSSSFGIFGGLRGLYNSYYVLNKVKGSGNLDVATGLNYRYKHSKYSVGISIPLIQRKASVISSGSDYTNSFVFNEGASHFKVFFNYGWVF

SEQ ID NO: 12812 - protein, 253 aa, Helicobacter pylori
MKTLFSIYLFLSLNPLFLEANEITWSKFLENFKNKNDDDKPKPLTIDKNSEKQPVLDKNQQILKRALEKSLKFFFIFGYNYSQATFSTSNQSLTFVANSIGFNTATGLEHFLRNHPKVGFRIFSVYNYFHSVSLSQPQILMVQNYGGALDFSWIFVDKNIYRFRSYLGIALEQGVLLVDTIKTGAITTIIPRTKKTFFQAPLRFGFIVDFIGYLSLQLGIEMPLVRNVFYTYNNHQERFKPRFNANLSLIVSF

SEQ ID NO: 12813 - protein, 286 aa, Helicobacter pylori
MKKSVIVGAISLAMTSLLSAETPKQEKAIKTSPTKKGERNAAFIGIDYQLGMLSTTAQNCSHGNCNGNQSGAYGSNTPNMPTASNPTGGFTHGALGTRGYKGLSNQQYAINGFGFVVGYKHFFKKSPQFGMRYYGFFDFASSYYKYYTYNDYGMRDARKGSQSFMFGYGAGTDVLFNPAIFNRENLHFGFFLGVAIGGTSWGPTNYYFKDLADEYRGSFHPSNFQVLVNGGIRLGTKHQGFEIGLKIQTIRNNYYTASADNVPEGTTYRFTFHRPYAFYWRYIVSF

SEQ ID NO: 12814 - protein, 775 aa, Pseudovibrio sp. JE062
MKQSLHIASIATIAFLTMIPVEAQAQEAARAAPADEAPAAGGIDDIVVTARRRAERLQDVPLAVSAVSTAALERANIQNVAQLSRLVPSLTSVPGQGGSRSLPNFSIRGLSQQELTILADQSVSTYIGDIVAARTQGINSALFDIASVEVLRGPQGTLFGRNTTGGAIIIRPARPTDEFEGRVGVTVGNLDTFNVEGMVNVPLSPNIAIRVAGQRQRDDGFVYDEILQRNVNDTKQEGARASILMHNDDLESLTVYNYFHENDGGTASFLQNVRATGSLNGAAVRASRGYRPLEDLLAEQQARGIYRIANGSPIFTKVETHDIANTTSFDLSETIKLKNIVGYRHVKDHIFDDMDGSSNALHPQERIDRAKQFSEEFQILGDTANLNWIAGLYYFRESGRNQGISAVGAVDPGLVEPDNVAAFPGTAYSNTDTAARNTSYAAFAQGTYRFGGGLSLTAGIRYNRDERQATIRNRTATACRFTRDLDNNPATPETAVPLAQCELGVKDSFSEVTYNVSLEYKIAADKLVYIAHRHGYRTGGFGARASTEAGLRRTFRPETVDDVEVGVKADWRMGDAFLRTNLAGYYAKYKDIQRLLTDPVAVPPTTVTTNAGRARIYGIEADILFRPVKMIELTANYAYTNAKFTKFIYPDGTDHSNDPFARAPRNVYTLGARLLAPLDEGQGDASVGVSYYHTGDYSGNDTYVPGYTDVKGYSLLNFDASWNRVMGSGFDVALFVNNVTKKKYDFLLINLDSLGYTSHTPGMPRTYGATLRYHF

SEQ ID NO: 12815 - protein, 728 aa, Pseudovibrio sp. JE062
MATINTRRLPLLSLLFATTSLAAISVAQAQDTTGTDTGEDAPKATQLDAVTSTATRNPTAINDVAGTVSVITAEELERRNANSMQDIVRYEPGVSVSNSPTRVGAGNFTIRGIGGNRVLVLVDGFTAPDYIDASAGGLYTRDFFDLDSMKRVEIIRGPASALYGSDGLGGVVSYVTKDPSDYLDIFDKDWYASLKSGYDSSDESFTESATGAVRAGNVEMLGLYTRRDGHEVEPNSSYVANPIDYESNSFLAKLVFNGPDSNKLTFTGQLDNKQADIRLLSEETGTVNRSEATDETDRYFVSAAYSHRMPTPIADRMELKIGYTKLDRVEHTEQLRSGSTVLRLSDLHFNQEILSGDFQFGLTREWAGFTHDFTYGVTADYTETSRPRYRTETNLITNTTTNVVGFETFPNKNFPDTETIKAGVYVQDDIGIGRLNIIPALRFDYYSLDTKIDRMFLNSAGTNVPVDMTETEISPKLGLTFALTEEYKIFAQYAHGFRAPPYDSANYAWQHTTFGYEIIPNPNLKPETSDGFEAGLRGKFRDGSSFSVAGFYNTYEDFIDQVLLGVGGVPPLMQFQYQNLAEVTIYGAEAKGEYRFLPEWALIGSLAYARGEDDQTGDPIDSVDPLKGVLGLAYEGDSWGSQLVATHAWRDTRNATPGNFEAPSYTLVDLMAYYDMSEHLTVNAGIFNIFDEEYYFAQDVAGLASGSPLTGRYAQPGRNFGINATVRF

SEQ ID NO: 12816 - protein, 647 aa, Pseudovibrio sp. JE062
MTLNYSFSYFMQKPIRYSLTAAACLLAFSAQAQLISNLYSVGDSLTDAGTYAPTTQLFVPDSGRFTTNPGLVWTQYLGQSLGLSSEAAIVNQFGAPTRTPNGGTNYAQGGSRVLLSPGVGVGAGVWFTADPVSSQVDRLLADTGGRIDGKALVTVWAGANDVLTQYGAVGLGLPVPSALGNVGTSAGDLNAQIMRLQAAGAKLILVNTLPDLGVTPFGLSQGPAGAGLLTAMSDTFNQQLLQATAGRNVLVFDTNRVLNDLRARPAAYGFTALNAATQPACLPSGSSSLLCVNPPEADTYVFADGVHPTSATHKVFAQVTLASMRAAGQNSTLAVAPLVAIRQHAQTLEGRLTSGALVVEQPDDSKIVLRPKGHLEMYTALESGRFGASTLGVRMGNEAKTTVVLVGGDITLAPNALAGLVLSHAEGDLSFSENTGGFKTRQTTVGTYATVALSPEWYLNAALAYGDLDFDNIHRDVRLGSTQLLVSSTGQTTGSYASARVGGGYILKAGRFFGGPTLSLTEERVKVKAYTEAPGPLAFSFGDTTYRSRRVSLGFNGTYDVGRIKPFARVSLEKDLNHDPLRVTMGSYASNAITVDGDRPDGLFALATLGVKGLLGGGMQWSLLYSTTVSQNDIRGWSVGAALQVPF

SEQ ID NO: 12817 - protein, 786 aa, Pseudovibrio sp. JE062
MLIHYTFPTKPVNKKQRFANKNDNQLYTTPPPPANINKNNYYYFFLSCQTLTVWLNFPSYTQKDEQMNAPFFRLSLLSLTLAAGFAHAAENNANVALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFAGNNGVSYGASVFGKEGNFDGLFSYNRNDEKDYEAGKGFRNVNGGKTVPYSALDKRSYLAKIGTTFGDGDHRIVLSHMKDQHRGIRTVREEFAVGGENSRITIKRQAPAYRETTQSNTNLAYTGKDLGFVEKLDANAYVLEKKRYSADDKDNGYAGNVKGPNHTRIATRGMNFNFDSRLAEQTLLKYGINYRHQEIKPQAFLNSEFSIPIKEKKNGQEVDKPMEQQKKDRADEAIVRSYRLTNPTKTDTGAYIEAIHEIDGFTLTGGLRYDRFKVKTHDGKTVSSSSLNPSFGVIWQPREHWSFSASHNYAGRSPRLYDALQTHGKRGIISIADGTKAERARNTEIGFNYNDGTFAANGSYFRQTIKDALANPQNRHDSVAVREAVNAGYIKNHGYELGASYRTGGLTAKVGVSRSKPRFYDTHPKKLLSANPEFGAQTGRTWTASLAYRFKNPNLEIGWRGRYVQKATGSILAAGQKDRDGKLENVVRQGFGVNDVFANWKPLGKDTLNVNLSVNNVFDKFYYPHSQRWTNTLPGVGRDVRLGVNYKF

SEQ ID NO: 12818 - protein, 469 aa, Pseudovibrio sp. JE062
MYVDTLRGTNPINGLNKLNVKKAELLYGVEAAQNSNSKYFEVSGKILKPYQDAVRNASGIKWSHNSAAFTWMALPTVDSNGVPLKVGMAKIPYTEFAGKEPMPVEVSDTYNFLDGLEQRYDKNALDSREKLLFNKLNGIGNNESVLFYQATDEMMGHQYANVQQRINATGNILNKEFDYLRSEWQTVSKDSNKVKVFGTRGEYKTDTAGVIDYKNYAYGVAYVHENEDIKLGRGIGWYAGMVHNTFRFKDIGNSKERQLQGKVGLFKSVPFDDNNSLNWTISGDIFIGHNKMHRKFLVVDDIFNAKARYYTYGIGIKNELGKEFRLSESFTLRPYVALGLEYGRVSKIREKSGEIKLEVKQNHYISVKPEVGAELAFKHYFGRKTFKVGLGVAYENELGRVAKGKNKARVADTNADWFNIRSEKDDRKGNVKFDLNLGLDNQRYGVTANVGYDTKGENIRGGLGLRVIF

SEQ ID NO: 12819 - protein, 351 aa, Pseudovibrio sp. JE062
MNIRVKPVWIALALAATGAQAAPDNDWYAGVGGGWAIAHDLGDFGKDASKDATALSLFGGYNFTENLGAELGYLSTGDWDVQGNDFSSQGATLSVIGRLPLGDIFSVFAEGGGYVYHVKSINGGDNNLAPLAGLGLTAKLHDWVDIQARYRYMVRVGDDPDNDKVGSGTQRWVSDISTATLELVIHPNRSKPVEPAPAPMVVPPPPPAPEPVDQTFNLSSDVLFAFGKAELKPEGMQALESLYQQIADVKPKDGNAVVMGYTDRIGSDANNQALSEARASTVANFLIGKGLPADKVSIQGNGESNPVTGSQCDAIKARAALIDCLAPDRRVEVRVTGTQGAPEAAAAPAEQ

SEQ ID NO: 12820 - protein, 795 aa, Pseudovibrio sp. JE062
MTSQRRRAFRRGLTLSAALIGIIAVPAHAQAADDAVAEGEIVVTANKRTQALKDVGVTAAVLGAQQLTERKIVSLADIAATVPGLSYSSSENNTPVFTLRGVGFNEASLAAYPTVSVYTDEAPLPFPVLSAQGAFDLDRIEVLKGPQGTLFGQNSTGGAINYIAAKPTDTLSAGADLSYGRFNMVEANGFVSGPLGEQLKFRLAGHYLHADDWQKSYTRKDSLGESEVYAVRGLLDWEPADTVKFSLMLNAWQDKSDPQAGQLVAVYPQIAAAAYPEVVNYPYPPQNARAADWSNGTTVSPTGSILDPRPRSNRKFQQAVLRGDIDLTDQVTLTSLSSYLHFRQRQSQDYDGTASNNDDIPFNDGTIKSVFQELRLSNGGRSSIRWVLGANYQRSRIRENDGISYSTGSTSNAGLNFIIQNGYRSNTLRRDYAFFGNAEVDVAPGLTLKAGARYTNSLTGVNLCNTDLGDGRTAALISGLSALLTGGPAPVVRPGIDCVTLNSSFQVGQPFIDSLKQHNTSWRFGVDYKLNRDVLLYANVSRGYKAGSYPTISASSEAQYIPVTQESVTAYEAGAKLTTADRTFTTNVAAFYYDYRNKQIRGKTLDPIFGVLNALINVPKSRLYGAEIEAGVRPFRGLALGASVTYVNSKVQRYTGTNVLGVQQDFAGSSIPFSPKWQAQVDGEYRWDMGGVTPFVGAVLNVRAKTIAYIGGSDLTIPASPVNSMAPGVTRPFAIKGYETVDLRAGAEWGQWKAMIWGKNVFDTYYWQNVISAFDTVYRLAGRPASYGVTVGYKF

SEQ ID NO: 12821 - protein, 1653 aa, Pseudovibrio sp. JE062
MKKLRVAACMLMLALAGCDNNDNAPTAVKKDAPSEVTKAASSENASSAKLSVPERQKLAQQSAGKVLTLLDLSEVQLDGAATLVLTFSIPLDPDQDFSRVIHVVDKKSGKVDGAWELSDNLKELRLRHLEPKRDLIVTIGKEVKALNNATFSKDYEKTITTRDIQPSVGFASRGSLLPGKVVEGLPVMALNVNNVDVNFFRVKPESLPAFISQWEYRNSLANWQSDKLLQMADLVYTGRFDLNPARNTREKLLLPLGDIKPLQQAGVYLAVMNQAGRYDYSNPATLFTLSDIGVSAHRYHNRLDIFTQSLENGAAQQGIEVSLLNEKGQTLTQATSDAQGHVQLENDKNAALLLARKDGQTTLLDLKLPALDLAEFNIAGAPGYSKQFFMFGPRDLYRPGETVILNGLLRDADGKALPNQPIKLDVIKPDGQVLRSVVSQPENGLYHFTWPLDSNAATGMWHIRANTGDNQYRMWDFHVEDFMPERMALNLTGEKTPLTPKDEVKFSVVGYYLYGAPANGNTLQGQLFLRPLREAVSALPGFEFGDIAAENLSRTLDEVQLTLDDKGRGEVSTESQWKETHSPLQVIFQGSLLESGGRPVTRRAEQAIWPADALPGIRPQFASKSVYDYRTDSTVKQPIVDEGSNAAFDIVYSDAQGVKKAVSGLQVRLIRERRDYYWNWSEDEGWQSQFDQKDLIENEQTLDLKADETGKVSFPVEWGAYRLEVKAPNEAVSSVRFWAGYSWQDNSDGSGAVRPDRVTLKLDKASYRPGDTIKLHIAAPTAGKGYAMVESSEGPLWWQEIDVRAQGLDLTIPVDKTWNRHDLYLSTLVVRPGDKSRSATPKRAVGVLHLPLGDENRRLDLALETPAKMRPNQPLTVKIKASTKNGEKPKQVNVLVSAVDSGVLNITDYVTPDPWQAFFGQKRYGADIYDIYGQVIEGQGRLAALRFGGDGDELKRGGKPPVNHVNIVVQQALPVTLNEQGEGSVTLPIGDFNGELRVMAQAWTADDFGSNESKVIVAAPVIAELNMPRFMASGDTSRLTLDITNLTDKPQKLNVALTASGLLELVSDSPAAVELAPGVRTTLFIPVRALPGYGDGEIQATISGLALPGETVADQHKQWKIGVRPAFPAQTVNYGTALQPGETWAIPADGLQNFSPVTLEGQLLLSGKPPLNIARYIKELKAYPYGCLEQTASGLFPSLYTNAAQLQALGIKGDSDEKRRASVDIGISRLLQMQRDNGGFALWDKNGDEEYWLTAYVMDFLVRAGEQGYSVPTDAINRGNERLLRYLQDPGMMSIPYADNLKASKFAVQSYAALVLARQQKAPLGALREIWEHRADAASGLPLLQLGVALKTMGDATRGEEAIALALKTPRNSDERIWLGDYGSSLRDNALMLSLLEENKLLPDEQYTLLNTLSQQAFGERWLSTQESNALFLAARTIQDLPGKWQAQTSFSAEQLTGEKAQNSNLNSDQLVTLQVSNSGDQPLWLRMDASGYPQSAPLPANNVLQIERHILGTDGKSKSLDSLRSGDLVLVWLQVKASNSVPDALVVDLLPAGLELENQNLANGSASLEQSGGEVQNLLNQMQQASIKHIEFRDDRFVAAVAVDEYQPVTLVYLARAVTPGTYQVPQPMVESMYVPQWRATGAAEDLLIVRP

SEQ ID NO: 12822 - protein, 637 aa, Pseudovibrio sp. JE062
MRNTSFNTLDSYREQSGSSFGGTALVNLRGIGEDKTAVLINGRRVPGTGCGYIFSDVSYNTMDMERLSTFVDARRQLSDDHEIYFESRISKVESSGRFAPAIGGFGVAADAPINPVGEEFLLYHRFVAHGPRNDTSDAVEIDAVLGFNGAFSGTDIEYDLSFRKYKYDANSRGENYVLKSNIEALVKSGAYNYIDPLSQEPGHLAAIAQSNATVSRDLANDTSSFLFALNGGTGIELGFGAADILWSAGIEYSEEEYQDIYDAFRAAQNVLGSAGNSASGDRKRKALFGELLVPVLDGWDINMAVRYDDYNDFGSEVSPSISTSFVATEWLKLRASYGQGFKAPNLTNLYAKPQQSFEGVVDTTRCRAQGIADKDCPSGQQETYNAGNKDLKAETSESYNVGIILEPVDNFLITADYYSVELENVVTQLEFRDVFELEQQNNLPAGVVVNRGPTVDGVPGSITRCIAKSYPDCGLINPSANLATRKVEGLDFKVQYLLETSIGDFRPDLQWSHIKTYEEEIAGVLFEQPGKQGYPANRANFNFLYEAGNFKVNYAYQWIDETESDTGGKFEAWDIHSINMIYTAIDGLDLTFGVRNLTDEDPSIDTVGGWQAEQASVSRALYSLDGRVYTLGIKYSF

SEQ ID NO: 12823 - protein, 470 aa, Pseudovibrio sp. JE062
MLRHVFRRRFRTADMNRSFSNLSLLLAIAGGSFVEEASAEFLKDSKATLTLRNYYINQDTRNKADSPRLDEWGQGFLLDFQSGYTEGALGFGLDVLGTYAIRLDSGSHAGKADADRAPGTSGTFPLESNGKSKRDFGRVGVTGKMRYSQTELHVGTLRPKLPVVIYNDGRLLPQTYEGYQITSREIKDLTFIAGKLEHSTERNSSNSDSLSIQGSNNRKTGQFSNQFLYGGFDYKLNKDLVLSYYFGKLQDFYEQHFVGLIHNWALPVGSLKTDLRYYDSSSTGANASASGRADGYRAQGWWSGNDSDRYEVDNKLWSALFTYSLAGHAIKAGYQKVTGHSDFPSLAPDSGTGRSLYLITNTNIQAAKFASAGEQTWVVGYAYDFARIGMPGLTFSTTYYNGTDIDDTVNGRRGNSEEWARDINLGYKVQSGPLKGLGIDWRNGTWRGNDSGTVDRDENRVMVSYNIPLL

SEQ ID NO: 12824 - protein, 211 aa, Pseudovibrio sp. JE062
MRVLIAGLMASVFAIAGVSAAQAADRVDQVPEAPVAQEAPVKPAGSWEGFYLGGAGTYNMGDFGSDRHTYGFGGQVFTGYNWQQGQIVYGVESDLGYSGDDVSSGGVENKYGWNGSVRGRVGYDMNPFLLYGTAGLAIGDVKVSDDTSDESKTNFGYTVGAGVEAFVTNNITTRLEYRYTDYQSKDYDLDSGSFSRGYDENSVKLGIGVKF

SEQ ID NO: 12825 - protein, 227 aa, Pseudovibrio sp. JE062
MRVLKSVIALSILSSSVVHAAKGDQTLSIGYAQMNSDPSKAAYSANKAEYESRLKTTGNVFAQHADSDKQPQGMFIRYRYKLDDTWGVMGAITYAVGDMDNHFLSGEKAKNKKDANKIEKRFSNRVKTDYVSLLAGPTLRANEWVSAFGLLGVALHSVENSLYETDKTSIPPKQVSRNEKSSNTSLAHALGLQFNVYKGLVIDAAWAGSGSGDWKSSGFNLGVSYQF

SEQ ID NO: 12826 - protein, 619 aa, Pseudovibrio sp. JE062
MSRYAPLVATAASLFVVATLVPAIAQADSAEARPLSPIVVTPARTAQTVNESLSSVTVIDREEIDRQQPKQFTDLLAGRAGVTVSSNGPFGKASSVRLRGADSGHTVLLIDGVRMGSATLGGASWQVLPLSEIERVEVVRGPRSAIYGADAIGGVVQIFTREGREGPPRVNAFAGAGSFGTHEYGAGVAGGTADTRYRLSGSHFHTDGIDVQDGVGDDDDDGYRNSSLSGKVSHRLSNGWELFANGLRSEGRSEFDRRDFFGNDESAHHDFVHQATRIGARGDVTDRWHTELSIAHARDEQDTYYEGELDARHDTKRDQAHWLNDFVLTRTITWTAGLDWQEERVSGTTDYDETSRYNQAAYQVLAGRFGRHNVSGSLRYDDNQAYGSHTTGQLAWGYEIDDRLQGRLSYGTAFNAPTLNDLYWPGSGNPDLQPEESATAEAGLRYAGGAFYWDAALFRTEVDDLIEWAPVNGQWMPDNVDEARITGLELEGGYHQGPWRLRASGTFLDTEDKGTGRELRRRPNHTVRLDVDRELGAWAFGATALARGRSFNDKANDDRLAGHGLLHLRASYAIDPHWTVRAKLDNALDKDYATARDGSNEVDYNQPDRAVFVSIHYAQ

SEQ ID NO: 12827 - protein, 778 aa, Pseudovibrio sp. JE062
MSLKRNVRLLAGTAIVWCIAGESVLAQETTAPAEPVAAETAAVENDRRLSTVTVTAQRREESVQDVPLAVTAVTGDQLAELRVENIENISLVSPSITFSKTNAPAASSNIQIRGIGTTGQSRVFEGAVGVFIDGVYRTRSGQALSSFLDIDGLQVLRGPQGTLFGKNTSAGALLLNSTAPNLDEVNGYVAGSYGNYNAFDISGAVNIPVTDTFALRIAGSHSEQDGFLESPAGDSENDQSMDSFKVSALWEPTDALSVKLIADYSTEDDEVGYATVNALDGPLQPLINGLTLANGLQLPSSDLEDYEASINTPTANKVEDKGLALLVDWDIGPGTLKSVTASREYDTVQNADADFTGADILIINEKFNSAFFSQEFTYGGELTGAVNANYLFGAFYSDEELDMGRDLTWGTQAQPFWDVVLGAQGVPAGLSNAAPGNWAQEVLIGTAESLALFTHWDFALTDQINLITGLRYSEDEKTGSFNYDFFRDPVFDPLAIAGSGPGPEYARTFADEAVSGTLSLQYRPNADLMYYASYNRGYKAGGVNVDASGAGVPGSSLNPLDTGTPADPIFTPETIDAFELGAKVDWMDGAARTNVAVFYNDIKDLQVAQFLGLIFTILNSPEAESYGAEFEHTQALTDYLVWNASATWLPEAGYGEDAAIGVLSGRRFPNAPEISANTALNLDYELSGGKALTGLLQLQYSGERFTNTASNLEEDAVTLVNANLGLAFDNGLSVSAFLRNALDERYVSQHFNTPLQDVDRNAYVAAPRTFGVSIRKTF

SEQ ID NO: 12828 - protein, 774 aa, Pseudovibrio sp. JE062
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLSPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQIADLNLAFGVKNIFDQDYFIRSYDDNNKGIYAGQPRTLYMQGSLKF

SEQ ID NO: 12829 - protein, 726 aa, Pseudovibrio sp. JE062
MFKYILLIVAIASIGTVQAQNKITFHIKNTSTNEPVKGASAKIEETNEVLSSDNNGNIIIENLKNGDYTLSISIEGYAPNKTLFKVPAAVNFIEIALQSEMEEEAEEMKEIVVTSTRGTRTISNIPTRVEFIAGEELEEKANMKPGDIRMMLNESTGIQTQQTSATSGNSSIRIQGLDGRYTQILKDGFPVYSGASSGLGLLQTPPLDLKQVEIIKGSASTLYGGGAIAGLVNLVSKTPTEERELRFLINGTSALGLNINGFYSQQFDKIGLTVFASHDRNAPYDPADIQLTAIPKFERFNFNPKLFVNFNENTKLNFGINTVFENRIGGNIDYIKDENKYPDSYFEKNKTKRISTQFTLTHKFNDQESITIKNSFNNFSRIITIPDYIFDGLQNSTFSEISYSKNGEIAEWVAGGNLYTDKFTENSQTAFPLRNYNQITYGAFVQNTVKAKEWLDIETGLRGDYVVDYGFSLLPRISALFKINSKLTSRLGGGLGYKTPTIFTEESERIQYQNVLPINSDFNKLEKSYGLNFDVNYKTKITEDISLSLNQLFFYTNVDNPLILTSLPNDLYQFVNINGYLDTKGTETNVKLGYKDFKLFVGYTFTDASIDNNGIKSQNPLTAKHRLNNVLMYEVEDKWKAGLEAYYYSPQKLSDGTTGREYWIFGFMVEKLWENFSIFANFENFTDTRQTKFGSIYTGPISNPVFKDIYAPLDGFVVNAGIKIKI

SEQ ID NO: 12830 - protein, 581 aa, Pseudovibrio sp. JE062
MSRLLNQLVKITPGLLGCLFLVAQSAIASPKTDFETANPETINPDEALGVLRNRPQMDNPMNRTSGQKFNTSASQVTSVSELRDVQPTEWAYEALRSLVERYGCIVGYPDRTFRGNRALSRWEFAAGLNACLNTIERLLQENVAVLREDIEKLKRLAQEFEAELAALGSRVSNLESRVSYLEDHQFSTTTQLKATSIFTWSNAWGERALDYREQDTYNQAIQNRRNTTAKRRLDDNSTLGYRVRLNFNTSFSGKDMLTARLQALTIVNYANPTGTSMARLGHDANNDSNVVIDNLWYRFPIGQFTGYVGGTGLDVDDIFDTGNPYGTSSDTGALSRFMRYDPLTMRGTEGIGAGFAYKFNDMFTVRGLYLTPGGEGNDPSQGRGLFNGSFTAGGQIGFKPTDGLTFNAQFLHKYFRPNGVNVTHGTGSGIASDPFLGAATITDNYGLNGNWRINETFNLTGWVGYALARGQGLDSRGRSRRGLGADIWSWMVGLNVIDLFKEGAVFSVGGGSITNARRVDALTGDLTVPDQDTPYIIEGQYRYPLNKNIDITPGLYVILEPDGNNQNNSIWVGVVRTTFKF

SEQ ID NO: 12831 - protein, 219 aa, Pseudovibrio sp. JE062
MGIGARLWIVLAAVSAAGVAHAEIIQKPAMSVSAKDGRFAGYYAALPLDLSTDKEKVALTVKSSGMPENPTYDLDLNLSQKPDDERVGQRSLALGASWNESEARLRSSMSKLFGFGLLPRANFIRLSMDMNASQSITAPGVAPVARANIRSSLTLDGKPVGSIAFGGGTMGDEGVDLSLTRPFDLPAEFTVSLRGVSNERETWRLQDARAMVKLVKANW

SEQ ID NO: 12832 - protein, 955 aa, Pseudovibrio sp. JE062
MFQSSLFGRGLTARLLASSMLATAVAVPMASAGTISGEVADSTGTRTLRGAEVSLVELNQNAEVGQDGSYRFVNVPAGTYTLRVRYPGAEEQSRVITIADADTATESFTLAPRGSDGDTAVMETVLVIGQQANLLSSIARQRASDTVETVLTRDAIGQFPDQNVAEALRRAPGINVLNDQGEGRFVSVRGLDPNLNSASINGNRVLATGGDERAVALDVIPSELIESIEIKKSLTPDMDADTIGGSVEINTTSAFDRKKDLFSISYEGSYNDLNEKTSPKGSVDFIKLIGDNLGLSGGFSYYDREFSTDNVEMDGWSETDDGLVYAEDVEYRDYDVRRERYGFTLGLDFRASDNTDLYVRGLYSKFDDTELRTRLVFGLGEASSGTDTSASFDSADEEITVERDLKDRREIQTVRTISAGGKTITGPWTLTYDAAYSEADQTENGSIDPIIFRQDFEGDGALGLTFDYSDMKLPMFNVDFGAGGFNDPTAYEFDALERTTSEDAKDTEASFKFDVAREFALNNGTFEVKSGAKFRQRDKSLDFEFDIFDGYDGDLTLADVAGSATYGLVDIGVVPSLSRVRALTVPANIGPFERDALESEFASTVESYEADEEILAGYLMGKYQTGPLRVIGGVRVEQTKTNTSGSRAELIEEGGEFGGVTLEEDTLFITPVSYSNDYTDVLPSVNVRYDVTDKIVARFGAFQSIIRPSFGKFAPRFIIEENDEGEREGEFGNPELDPYRATNFDATLEYYFSPEAVIQGGVFYKKIDDYIVDVVFDDPGTFNGIDYNEAVIPLNGESAEVRGIELSYGQAFTMLPAPFDGLIANVNYTYTDTEAEVQTEDGLRAIPLPTSSEHTYNIVIGYDKGPVSLRLSGAGRSSYLDELGSDAEGDRYVEPHFQIDASAKYRFTENFQVFAELVNLNDATYTAYQTGPGRDRLLQYEEYSWTAKFGFKANF

SEQ ID NO: 12833 - protein, 497 aa, Pseudovibrio sp. JE062
MVVNKRLILILLFILNTAKSDELSWKGNDFTLYARQMPLAEVLHLLSENYDTAITISPLITATFSGKIPPGPPVDILNNLAAQYDLLTWFDGSMLYVYPASLLKHQVITFNILSTGRFIHYLRSQNILSSPGCEVKEITGTKAVEVSGVPSCLTRISQLASVLDNALIKRKDSAVSVSIYTLKYATAMDTQYQYRDQSVVVPGVVSVLREMSKTSVPTSSTNNGSPATQALPMFAADPRQNAVIVRDYAANMAGYRKLITELDQRQQMIEISVKIIDVNAGDINQLGIDWGTAVSLGGKKIAFNTGLNDGGASGFSTVISDTSNFMVRLNALEKSSQAYVLSQPSVVTLNNIQAVLDKNITFYTKLQGEKVAKLESITTGSLLRVTPRLLNDNGTQKIMLNLNIQDGQQSDTQSETDPLPEVQNSEIASQATLLAGQSLLLGGFKQGKQIHSQNKIPLLGDIPVVGHLFRNDTTQVHSVIRLFLIKASVVNNGISHG

SEQ ID NO: 12834 - protein, 1005 aa, Pseudovibrio sp. JE062
MVYSAKRKRFQEMGFKQKQAFRNYLMNVIFMRELFKSLRFLLFMFPVALFAQNSVSGVVTEQATGMPIPGANIIVKGTSNGSTTDFDGNYTINNVNDGDVLLFSFLGFTEQQIIYTGQATIDVGLEENQTSLDEVVVIGYGSVTKKDATGAVNQVSTEDFNKGQVNTAGQLITGKIAGVTVTSGGGAPGEGQNINIRGIGSISLNSSPLYVVDGIPLDNSNVGGSRNPLDFINPADIESMTVLKDASSTAIYGSRAANGVILITTKKGKGREFKFNYSGATTVYRPTNYVDVMNGDEFRSLVNAVGNEASIARLGNASINWQEEIYSQAMGAEHNLSTTGNVGNFMPVRASLGYTNQDGVLRGDNFTRTTGSVSLRPNVLDGYLKAEINARGMYTENEFANRDAIGASVDYDPTKPIYSADSPFLNYNGWYVYNAEVDREIQNSLSPTNPIALINEKDDSAEIRRFIGNAKIDYKLHFFSDITATVNIGLDKTNSHGRTIVSENMPSSQLDWNGSYSNYINRATNQLFDAYLTYDKDFGKSSLNAVAGYSYQSFEYDNYSFDSEAQEEGNDAEFIDKWRSTLLSYFGRANYNYDDRYLLTATMRADASSKLNPDDRWGYFPSFAVAWNINNENFFNSETINQLKLRVGYGEIANVNGLGDYLFLTNYTGSRSNANYQFGNTYYQTYRPDAYNEDLRWEVGKTFNAGIDYALFNNRVTGSLNAYLKKTEDLISFVTVDPFTNFSNRINKNIGDMENKGIEFELNVTPVQTDDFTWTIGYNVAYNDNEITNLPDQVEVGGISGGTGNNVQLHKEGYTPFSYWVYKQVYDDNGRPIEGAFVDRNGDNQINDEDRYLYKNPFADVTMGLNTNLNYKSWDLAIVTRASLGNYAYNNMASSRSYEVRATENSILTNLHRDYFNTGFQTITESSLQSDYYVQNASFFKLDNITLGYTFPQLFDDASLRLYGSAQNVLIITEYDGLDPEIGGGIDNNFYPRPRIFTFGVNLNF

SEQ ID NO: 12835 - protein, 138 aa, Pseudovibrio sp. JE062
MWYQKTLTLSAKSRGFHLVTDEILNQLADMPRVNIGLLHLLLQHTSASLTLNENCDPTVRHDMERFFLRTVPDNGNYEHDYEGADDMPSHIKSSMLGTSLVLPVHKGRIQTGTWQGIWLGEHRIHGGSRRIIATLQGE

SEQ ID NO: 12836 - protein, 887 aa, Pseudovibrio sp. JE062
MSNSLFKKGMLASSIALILSGSLSAAAIAQDAQLAQEEMEVIEVKGIRSSLKENLNAKRFSSNVSDVITSEDIGKFPDKNVAETLSRITGVAVSREFGEGEKISIRGAGPKYNRTLLNGQTVGTADWFILDEANRSFNYTMLPSVIVKGLEVNKSPVASIDEGSIGGTIVLKTRRPLDMDANSVSLSLEGQYSETSGETDPQLAGMYSWKNDDETLGVMVSAVKQERNLERQGFEVLGWVESDDDEYLVPRNIGAPKFIQSRERETLFATLQYAPNDNLLMTLNYLDSRMDVDNQNSNLINFAFGDRAEIITNATKVKNGAILASSAGGNYAYNYINRVSSTETDQVHLDIDYQGDGYSLNFELGKTAASGGTYRETSWEYVAVGSGYDYDLTGTPNVNVGVNAADGNNFAAGWIWGGAKPTTDEETFAQADLTYDVEFGPFTAIKTGIKYRQAERTQGRHAYSWHAPFADGGANSDNYLDHIFDTCPTLATCDLDANGATSIDAAVTGNITEQVSHNRELMEEIAFNGLNGISASYAIHDNLAEIWEVEEDILALYVQGDFSGEGFRGNVGMRYVSTEQTSYGYEFSGDSWGLNTINGDWLTPSVLNWVSQDNDYAEFLPSFNIAFDLTEEQILRIGAARVMARQNWADISSSETFGSLTGGRGTGSRGNPNLAPTISNQFDLSWEWYYNEASMLSVAYFAKDLSSLRSTVTVTEDRYDQENEVFVPVDFAQPGNGLGGTIQGIELGLQHDFGGFGVSANYTYTDASADEQRDTNQVGSGLVEGTSKNMLNLMAYYENDAYQARIMYNYRSDWYKGLHFNGDELFNDAFGQWDASASYNVNEYVTLTLEAVNLTDEEIVEYNTNEERIMSIYSNGRRYVAGIRVNF

SEQ ID NO: 12837 - protein, 665 aa, Pseudovibrio sp. JE062
MKNNLIELLNTLHKEAKHQEIIDKIEALPNEEKTPEIIGILARAYNNIDNYEKAVELLKSTEEYGKDTNVWNYRIGYSYYYLDNYLEAEKYFLKAVELNPTDSDSHLFLCWIYQELTDKEKDNSEKIIEYLNKSIEYANIYSKLEPEESIKDELIFAEERLGWAYDRLNNFLEGEKHLRKAIKLGDNDKWVYSQLGYTLRHQDRYEEALQNYMKSVELGRNDTWIYSEIAWTYFSLEKLSEALEYINKAKELSPVEVDLSLISRTSSILIALGKHTEAIKLLEDIINRDEYKNDIGILSDLAFAYDDLEDYKNGLIYLKRANELGRDDIWINTEFAYAYYYLGEYEKSYDYLIIVKNLGRDDLTLKLMFANTLSKMEKYEEAIEYYLELLENDKYKNDAILNCQIGWNYGELEKPKEALKYLFKAEKLGKDDRMINIDIGINLAKTGEIQDGINRLKRALTMEEGITLNDKIFLNSEIAYWYGELRDVENALNYLYITKDLGRDDAWINSQIGWNLLEEDLKEALKYLNKAKDLGKDNIWINRQFGFAYSKLGEYEKAISSFKKARELGANDSWLLYQLGLALKEYGNIEEAINIFKEEIEITDYQGFGDLQLAWCYALIDEKEKAKEYFKNVDMYLSSSLEKDEDLKKDYNTVNELINSNIYFN

SEQ ID NO: 12838 - protein, 440 aa, Pseudovibrio sp. JE062
MKYFNKTILAVAVTLASSQAMAAGFQLNSQSATGLGRAFAGDAVIADNASVLSRNPAAMALFDEKSLSVGVAYADLDVNVSDVSIPLGNYGNADDVAENKLIPNFYYIQPINDKWAFGVAGFSNFGTGTDLTGLANSNPKAADGSIVPAPAPVDLLGNTEIITMNFNASLSYRFNDHFSVGAGVDIIYGEGNLSREGNLPFGENGSMVPVSLVDVEADGVAFGGIIGAVYEFNADHRLGMSYRFSPEFKATGDVNMTQPGVGAIAFDEINIPMPDIFQVAGFHQLTEKFALHYTAQLTTWGDFHEITVTDGQLANGTPVGDAVLKQYAWDDSWLFSVGGTYTINEKWKVRAGYMHDQGVVGDLSSLSIPDSDRNWYTAGVSYGLSTQSTIDMGIAFVRGEDVHVTEHSSVIEAIPGLSGDVTAYTRSDAVYYSVQYSYQF

SEQ ID NO: 12839 - protein, 1045 aa, Pseudovibrio sp. JE062
MSKGASGRLAPQRGTLSLGIQLALLACCGATPVLPAMAATDPAGDARSQAGQYHQFDVKGGALEDAMLQLARQAGAELYLTGEAFNGLYANPVQGRFSLEGALKQLLSGLPISFSLSGGPDRPVIHLQSATSAGTDDLHPTYVYGQRDGRSRDEKGYSDIYDQDISTVYAGKEQIERYKGAAPADVFKGMLNVYSGDARNSGALDPNVRGIQGPGRVPLTIDGTEQALTVYRGYMGANNRNYIDPNLIGSIKVIKGPNLERNVYSGVGGAVVVNTLSVDDILKEGEAFGGEFKIEGSNNSVSPKLPTLMTGQMPGADYQYIPINSYYDPSLYKHPRTSSSNDLLSSDDKAYRLALGTRQEHFDLMGAYAYREKGNHYAGKKKSSYYASGELVDGKWDYVPNLARIYKPGDEVPNSSSKMESWLAKATWKIDEGQRLEFGYRATDSLYGEILPSRISFFTPGSTYDAATYGVPQWPLSHVDSKAYNVEYKLNPEDNRWVDFYSNLWMTRTVSDTYSSGGVPNETTAQNPEFRNTAVANAKHDRAGLTVSNKLKLLDSLDLTLGGSYQHEKLSSGDSIYDPTTFSATRLFPRAGRREEQEYNFNFDWQPVSFARFTAGGRYSSYWSFDDFLKRQQRDTGVSTQVVPSGKELWYTTRKQLSQEEWRAVVDEKLQFAQMFWDMFGYSEAERQADKASIEASTPYVLDVDQKKHWAHDGKGKYQRSNNPCIAAAAAGEEIVTCSAALYSGAADAVDSEGNLVNQAVDTSARHRKDQGWVPNLSATFYTSENGRFYLRYSEAIRYPSMFESTVGFSASLTPWDLKPEHAHNYEVAYIHNLSGWWGSEQADVKLTYYHNTTNDVIERSPQLVFSNIEKQTTAGVELQGRYDNGGFFTDLSVAHVLKNEVCDENSAMQLDATGATPNCVDDGFIGGYLVGMAMPEWSANLGLGARFLDRRLEVGGRVIYYKGHDSKFHSNYSGNPMVSYYLNTPLSWDDIVTYDAYVNYKLTDDVSVELVGTNLTNLYYLDPLTRSAMPAPGRTLKIGLTANF

SEQ ID NO: 12840 - protein, 854 aa, Pseudovibrio sp. JE062
MGFGEMMNYKRKTLAIALSLIGSVGYMPLAHADSDSSGTLDRVEVTGSNIKRSISKETAVPMTIIKTDDLVKQGLTSVEQVVNSLAANQSSQGANAAVGASTGGAAYASLRGLGHQYTLILLDGRRIVNQPMDGTSVDLNAIPLSVIDRVEVVRDGASAIYGTDAIGGVINFITKKTMTGLNIGGEFVSPQRSGGKEKSVNISYGYGDLGKDGFNIYGAYDYHKTEKIMATDRDFASTITSSTKRSVNSFPANYLNSKGDLVAANPACKPPYSIPDGSGACSELYSLFPSIQPEIEQQTAVLKGTTRLGDHELSLQYMITKTKNTTWVAPTPFSGDVTSPTAPGENPANGPFPLYGRSVPAGDRVDSSTATTQRLQFNAEGLIAGWDYRAGLGHSESKVTHDVVSGYLSQSKLQNALNNGFNPDTEDPAAWAPYASTGQIEQAKSKLDQADFKVSKEVYQLPAGMLAVALGVETRHETIEHTYNHAVASDTLSTGLTKTTDGSGSRNAQALYAEMDIPVIKHLDANLAVRYDHYSDSGSSVNPKVSLKYQPIPQLLLRTSASTGFRAPSLYDINQPNQQQLTAKNYTDPVLCPGGVAQPGAGSNSCVKTQQNLFVGGNKSLNPEKSSSLSFGMVLEPVKDLTTSVDFWWTNIQNTIGSLNEATIFGNPSKYGNLFVRDGSNNLLYVMDATQNLGNTSAAGVDLGFSYRFPRTAIGTFSVNLDGTYISKHMFQYEKGGDYHSDLGAYVNGGPTFRWQHNLSLNWSEGAWSGILAQDYKSGYTDDVATHMVKPYSTWNLSGSYAWDKKLTLTVGVRNLFDQLPPWSNQGDTTPQGYDPRFTDAVGRAYFLKANYKM

SEQ ID NO: 12841 - protein, 133 aa, Pseudovibrio sp. JE062
MTIKLISYNYLIFNKKLKKVEINMQSIQGNTMKKVAIAVAAVVAGGLINSAQAEMYIGGKVGMTTLDDACYLNSPCDDDAFGAGMHVGYNFTDIIGLEYGVDYLGDYKANFKAGANTVNNIDGDLWALTLAPK

SEQ ID NO: 12842 - protein, 185 aa, Pseudovibrio sp. JE062
MGGTDYTYNDPVAAGPHDWSGNYVGAQVGGSSSKFPSPFASRTGALGGIVVGKNMQNGNIVFGAELEGNFAEAEHRIGHGGTLQQSWNGNAKGKVGYTFDKTLVYGTAGYGVTRFKAKDNTTSASGCEGGVLIGAGVEQALSGPLSVKAEYDFQRFNDVKSQVNGIEQRNNLKNHSIKAGLNYKF

SEQ ID NO: 12843 - protein, 157 aa, Wolbachia endosymbiont
KTKITGITHKSGKDKDSPLKASFLAGGGAFGYKMDDIRVDVEGLYSQLSKDGDVAGDSAIAESLTAFSGLVNVYYDVAIEDMPVTPYIGVGVGAAYVSNPLATKVTDDKASGFAFAYQAKAGVSYDVTPEIKLYAGARYFGSYGANFKIAKDDARIK

SEQ ID NO: 12844 - protein, 262 aa, Klebsiella pneumoniae
MRRNERNLMWNLDPYIQTHWQLTSALGLDAGARYSSVWFDSNDRYVVGKNGDDSGEASYHKWLPAAALKYAMTPQWNGYLSAGRGFETPTINELSYRPDGQSGLNFALQPATNTTVEAGSKWQVGTGMASLSVFNTDTKNEIVVAASDNGRTSYQNAGKTRRRGVELGWDQQFAPAWRAKLAWTLLDATYRENAGDAIQSGNRIPGIARNSAYASFGWVPEEGWYAGAEVRYMSDIQVNDANSEQAPAYTVTALNTGYEICD

SEQ ID NO: 12845 - protein, 192 aa, Wolbachia endosymbiont
SYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFCAHFDKDTAAASKDKGELKVLYSTVGAEA

SEQ ID NO: 12846 - protein, 196 aa, Wolbachia endosymbiont
SYYVRLQYNGEFLPLFTKVDGITYKKDKSDYSPLKPSFIAGGGAFGYRMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGAHFDGEKVDPKDATKKVADKGAYKVLYSTVGAEA

SEQ ID NO: 12847 - protein, 189 aa, Wolbachia endosymbiont
SYYVRLQYNGEILPLFTKIEGIEYKKATDIHNPLKASFIAGGGAFGYKMDDVRVDVEGLYSQLNKNDVTGAAFNPDTVADSLTAISGLVNVYYDIAIEDMPITPYVGVGVGAAYISSPLKDAVNDQKSKFGFAGQVKAGVSYDVTPEVKLYAGARYFGSFGAHFVKDTAAASKDKGELKVLYSTVGGEA

SEQ ID NO: 12848 - protein, 193 aa, Wolbachia endosymbiont
SYYVRLQYNGEFLPLFTKVDGITYKKDKSDYSPLKPSFIAGGGAFGYKMDDIRVDVEGLYSWLNKDADVVGDTVADNLTAISGLVNVYYDIAIEDMPITPYIGVGVGAARISTPLKTAVDSQTYKFGFAGQVKAGVSYDVTPEIKLYAGARYFGSFGAHFDKSEEVDKAGGGKETKVTKDAYKVLYSTVGAEA

SEQ ID NO: 12849 - protein, 191 aa, Wolbachia endosymbiont
SYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGRFAFAGQARAGVSYDITPEIKLYAGARYFGSFGAHFDKDAAAGKDKGELKVLYSTVGAEA

SEQ ID NO: 12850 - protein, 198 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSFGAHFDKSEEVDKAGGGKETKVTKDAYKVLYSTVGAEA

SEQ ID NO: 12851 - protein, 674 aa, Helicobacter pylori
MKKLFIPLLLFSALEANEKNGFFIEAGFETGLLEGTQTQEKRHTTTKNTYATYNYLPTDSVLKRAANLFTDAKSISQLNFSSLSPVKVLYIGGKLTIENFLPYNLSNVKLSFTDAQGNTIDLGVIETIPKHSKIVLPGEAFDSLKEAFDKIGPYTFFLPKFEATSTSISDANTQRVFETLNKIKTNLIMKYSNENPSNFNTCPYNNNGNTKNDCWQNFTPQTAEEFTNLMLNMIAVLDSQSWGDAILNAPFEFTNKGGGEECDTSKENDCVNPGTNGLVNSQNQQYVLNKQDIVNKFRNKADLDVIILKDSGVVGLGSDITPSNNDDGKHYGQLGVEAYALEPQKLFGNNLKTINLADLRTILHEFSHTKGYGHNGNMTYQRVPVMKNGQVERDNNGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTDHYSSSASQSFRSPILGVNAKIGYQNYFNDFIGLAYYGIIKYNYSKALNQKFQQLSYGGGIDLLLDFITTYSNKNSPIDIPTRRNFSSSFGIFGGLRGLYNSYYVLNKVKGSGNLDVATGLNYRYKHSKYSVGISIPLIQRKASVVSSGSDYTNSFVFNEGSSHFKVFFNYGWVF

SEQ ID NO: 12852 - protein, 657 aa, Helicobacter pylori
MRKLFIPLLLFSALEANEKNGFFIEAGFETGLLEGAQTQEKRHTTTKNTYATYNYLPTDTILKRAASLFTNAEAISKLKFSSLSPVRVLYMYNGQLTIENFLPYNLSNVKLSFTDAQGNVIDLGVIETIPKHSKIVLPGEAFDSLKIDPYTLFLPKIEATSTSVSDANTQRVFETLNKIKTDLVVNYRNENKFKDHENHWEAFTPQTAEEFTNLMLNMIAVLDSQSWGDAILNAPFEFTNSSTDCDSDPSKCVNPGTNGLVNSKVDQQYVLNKQDIVNKFRNKADLDVVVLKDSGVVGLGSDITPSNNDDGKHYGQLGVVASALDPKKLFGNDLKTINLADLRTILHEFSHTKGYGHNGNMTYQRVPVMKNGQVERDNNGKPKDSDGLPYNVCSLYGGSNQPAFPSNYPNSIYHNCADVPAGFLGVTAAVWQQLINQNALPIDYANLSAQTNYNLNASLNTQDLANSMLGTIQKTFVTSSVTNHYSSSASKSFRSPILGVNAKIGYQNYFNDFIGLAYYGIVKYNYSKALNQKFQQLSYGGGIDLLLDFITTYSNKNSPTGIQTKKNFSSSFGIFGGLRGLYNSYYVLNKVKGSGNLDVATGLNYRYKHSKYSVGISIPLIQRKAKVVSSGSDYTNSFVFNEGASHFKVFFNYGWIF

SEQ ID NO: 12853 - protein, 664 aa, Helicobacter pylori
MRKLFIPLLLFSALEANEKNGFFIEAGFETGLLEGAQTQEKRHTTTKNTYATYSYLPTDTILKRAANLFTNAEAISKLKFSSLSPVRVLYMYNGQLTIENFLPYNLNNVKLSFTDAQGNAIDLGVIETIPKHSKIVLPGEAFDSLKEAFDKIGPYTFFLPKFEATSTSVSDANTQRVFETLNKIKTDLVVNYRNENKFKDHENHWEAFTPQTAEEFTNLMLNMIAVLDSQSWGDAILNAPFEFTNKGGGGECDTNKENDCVNPGTNGLVNSQNKSYVLNKQDIVNKFRNKADLDVVVLKDSGVVGLGSDITPSNNDDGKHYGQLGVVASALDPKKLFGNDLKTINLEDLRTILHEFSHTKGYTHNGNMTYQRVPVTTDGQVEKDNNGKPKDSDGLPYNVCSLYGGSNQSAFPSNYPNSIYHNCADVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIIKYNYSKALNQKFQQLSYGGGIDLLVDFITTYSNKNGSTGIQTRKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12854 - protein, 666 aa, Helicobacter pylori
MRKLFIPLLLFSALEANEKDGFFIEAGFETGLLEGTQTQEKRHTTTKNTYATYDYLPTDTILKRAANLFTNTEAISKLKFSSLSPVRVLYMYNGQLTIENFLPYNLNNVKLSFKDAQGNVIDLGVIETIPKHSKIVLPGEAFDSLKEAFDKIGPYTFFFPKFEATSTSISDANTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVNSQNKSYVLNKQDIVNKFRNKADLDVIVLKDSGVVGLGSDITPSNNDDGKHYGQLGVVASALEPPKLFGNDLKTINLEDLRTILHEFSHTKGYGHNGNMTYQRVPTGQNENGKSKDSDGLPYNVCSLYGGSNQSAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIIKYNYSKALNQKVQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12855 - protein, 661 aa, Helicobacter pylori
MRKLFIPLLLFSALEANEKDGFFIEAGFETGLLEGTQTQEKRHTTTKNTYATYSYLPTDSVLKRAANLFTDAKSISQLNFSSLSPVKVLYIGGQLTIENFLPYNLSNVKLSFTDAQGNAIDLGVIETIPKHSKIVLPGEAFDSLKEAFDKISPYTFFFPKFETTSTSISDTNTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPPKLFGNNLKTINLADLRTILHEFSHTKGYGHNGNMTYQRVPTGQTENGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKAKVVSSGSDYTNSFVFNEGASHFKVFFNYGWIF

SEQ ID NO: 12856 - protein, 653 aa, Helicobacter pylori
MKKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLSNVKLSFTDAQGNVIDLGVIETIPKHSKIVLPGEAFDSLKIDPYTLFLPKIEATSTSVSDANTQRVFETLNKIKTNLVVNYRNENKFEGHQNHWEAFTPQTAEEFTNLMLNMIAVLDSQSWGDAILNAPFEFTNKGGGGECDTSKENNCVNPGTNGLVNSQNKSYVLNKQDIVNKFRNKADLDVVILKDSGVVGLGSDITPSNNDDGKHYGQLGVVASALDPKKLFGTDLKTISLEDLRPILHEFSHTKGYTHNGTWTYQRVPTGQNENGKPKDSDGLPYNVCSLYGGSNQSAFPSNYPNSIYHNCADVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIVKYNYSKALNQKFQQLSYGGGIDLLLDFITTYSNKNSPTGIQTRRNFSSSFGIFGGLRGLYNSYYVLNKVKGSGNLDVATGLNYRYKHSKYSVGISIPLIQRKASVISSGSDYTNSFVFNEGASHFKVFFNYGWVF

SEQ ID NO: 12857 - protein, 665 aa, Helicobacter pylori
MRKLFIPLLLFSALEANEKNGFFIEAGFETGLLEGTQTQEKRHTTTKNTYATYSYLPTDSVLKRAANLFTDAKSISQLNFSSLSPVKVLYIGGKLTIENFLPYNLSNVKLSFTDAQGNVIDLGVIETIPKHSKIVLPGEAFDSLKEAFDKIDPYTFFLPKFEATSTSISDTNTQRVFETLNKIKTNLIMKYSNKNPSNFNTCPYNNNGNTKNDCWQNFTPQTAEEFTNLMLNMIAVLDSQSWGDAILNAPFEFTNSSTDCDNDPSKCVNPGVNGRVDSKVNHYVILNQHSVINNFKKKNLVDAVVKKNWGVGRVADVTGNDGEDGKHYGQFYALDSALLFGKLLGTDLLTVKLTDLRDILHEFSYAHGDDMTEHITYQRVPTGQSENGKPKDSDGLPYNVCSLYGGSNQSAFPSNYPNSIYHNCADVPAGFLGVTAAVWQQLINQNALPIDYANLSAQKNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGIQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12858 - protein, 664 aa, Helicobacter pylori
MRKLFIPLLLFSALEANEKNGFFIEAGFETGLLEGTQTQEKRHTTTKNTYATYSYLPTDSVLKRATNLFTDAKSISQLNFSSLSPVKVLYIGGKLTIENFLPYNLSNVKLSFKDAQGNAIDLGVIETIPKHSKIVLPGEAFDSLKETFDKIDPYTFFLPKFEATSTSISDANTQRVFETLNNIKTNLIMKYSNENPSNFNTCPYNNNGNTKNDCWKNLTPQTAEEFTNLMLNMIAVLDSQSWGDAILNAPFEFTNKGGGGECDTSKENDCVNPGINGRVDTKVDQQYILNKQGIINNFRKKIEIDAVVLKNSGVVGLANGYGNDGEYGTLGVEAYALEPQKLFGNNLKTINLEDLRTILHEFSHTKGYTHNGNMTYQRVPTGQNNNGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12859 - protein, 658 aa, Helicobacter pylori
MRKLFIPLLLFSALEANEKNGFFIEAGFETGLLEGTQTQEKRHTTTKNTYATYNYLPTDTILKRAANLFTNTEAISKLKFSSLSPVRVWYMYNGQLTIENFLPYNLNNVKLSFKDAQGNAIDLGVIETIPKHSKIVLPGEAFDSLKEAFDKIDPYTFFLPKFEATSTSISDTNTQRVFETLNKIKTNLVVNYRNENKFKDHENHWEAFTPQTAEEFTNLMLNMIAVLDSQSWGDAILNAPFEFTNKGGEGECDTSKENDCVNPGTNGLVNSQNKSYVLNKQDIVNKFRNKADLDVIVLKDSGVVGLGSDITPSNNDDGKHYGQLGVVASALDPKKLFGNNLKTINLEDLRTILHEFSHTKGYGHNGNMTYQRVPTGQTENGKPKDSDGLSYNVCSLYGGSNQPAFPSNYPNSIYHNCADVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIIKYNYSKALNQKFQQLSYGGGIDLLLDFITTYSNKNSPTGVQTKRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12860 - protein, 662 aa, Helicobacter pylori
MRKLFIPLLLFSFLEANEKNGFFIEAGFETGLLEGTQTQEKRHTTTKNTYATYSYLPTDSVLKRAANLFTNAEAISKLKFSSLSPVRVLYMYNGRLTIENFLPYNLSNVKLSFTDAQGNVIDLGVIETIPKHSKMVLPGEAFDSLKEAFDKISPYTFFFPKFETTSTSISDANTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALDPKKLFGNNLKTINLADLRTILHEFSHTKGYTHNGNMTYQRVPTGQSENGKPKDSDGLPYNVCSLYGGSNQSAFPSNYPNSIYHNCADVPAGFLGVTAAVWQQLINQNALPIDYANLNAQTNYNLNASLNTQDLANSMLSTIQKTFVTSSVTNHYFSSASQSFRSPILGVNAKIGYQNYFNDFIGLAYYGIVKYNYSKAVNQKFQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12861 - protein, 667 aa, Helicobacter pylori
MRKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFADAQGNVIDLGVIETIPKHSKIVLPGEAFDSLKKAFDKIDPYTFFLPKFEATSTSVSDANTQRVFETLNKIKTNLIMKYSSENPNNFNTCPYNNNGNTKNDCWQPFTPQTAEEFTNLMLNMIAVLDSQSWGDAILNAPFEFTNSSTDCDNDPSKCVNPGINGRVDSKVDQQYVLNKQGIVNNFRKKIEIDAVVLKNSGVVGLANGYGNDGEYGTLGVEAYALEPTKLFGNNLKTINLEDLRTILHEFSHTKGYGHNGNMTYQRVPVTKDGQVEKDNNGKPKDSDGLPYNVCSLYGGQGQSAFPSNYPNSIYHNCADVPAGFLGVTAAVWQQLINQNALPINFANLGSQTNYNLNASLNTQNLANSMLSTIQKTFVTSSVTNHYSSSASQNFRSPILGVNAKIGYQNYFNDFIGLAYYGIIKYNYAKASSEKVQQLSYGGGIDLLLDFITTYSNKNSPIDIQTTRNFSSSFGIFGGLRGLYNSYYALNKVKGSGNLDVATGLNYRYKHSKYSVGISIPLIQRKASVVSSNGDYTNSFVFNEGASHFKVFFNYGWVF

SEQ ID NO: 12862 - protein, 653 aa, Helicobacter pylori
MRKLFTSLLLFSFLEANEKNGFFIEAGFETGLLEGTQTQEKRHTTTKNTYATYSYLPTDSVLKRAANLFTNAEAISKLKFSSLSPVRVLYMYNGRLTIENFLPYNLSNVKLSFKDAQGNVIDLGVIETIPKHSKIVLPGEVFDSLKIDPYTFFFPKIEATSTSISDTNTQRVFETLNKIKTDLVVNYRNENKFKDHENHWEAFTPQTAEEFTNLMLNMIAVLDSQSWGDAILNAPFEFTNKGGGGECDTSKENDCVNPGTNGRVNSQNKSYVLNKQDIVNKFRNKADLDVIVLKDSGVVGLGSDITPSNNDDGKHYGQLGVVASALDPKKLFGNYLKTINLEDLRTILPEFSHTKGYTHNGHMTYQRVPTGQVENGKPKDSDGLPYNVCSLYGGSNQSAFPSNYPNSIYHNCADVPAGFLGVTAAVWQQLINQNALPIDYANLNAQTNYNLNASLNTQDLANSMLSTIQKTFVTSSVTNHYFSSASQSFRSPILGVNAKIGYQNYFNDFIGLAYYGIVKYNYSKAVNQKFQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWIF

SEQ ID NO: 12863 - protein, 660 aa, Helicobacter pylori
MRKLFIPLLLFSALEANEKNGFFIEAGFETGLLEGAQTQEKRHTTTKNTYGTYDYLPADSVLKRAANLFTDAKSISQLTFSSLSPIKVLYIGGKLTIENFLPYNLSNVKLSFTDAQDNVIDLGVIETIPKHSKMVLPGEAFDSLKEAFDKIGPYTFFLPKFEATSTSISDANTQRVFETLNNIKTNLIMKYSNKNPSNFNTCPYNNNGNTKNDCWQNFTPQTAEEFTNLMLNMIAVLDSQSWGDAILNAPFEFTNSSTDCDNDPSKCVNPGVNGRVDSKVDQQYILNKQGIINNFRKKIEIDAVVLKNSGVVGLANGYGNDGEYGTLGVEAYALEPPKLFGNNLKPHLEDLRTILHEFSHTKGYAHNGNMTYQRVPTGQNENGKPKDSDGLPYNVCSLYGGSNQPAFPSNYPNSIYHNCADVPAGFLGVTAAVWQQLINQNALPINYANLSAQTNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTRRNFSSSFGIFGGLRGLYNSYYVLNKVKGSGNLDVATGLNYRYKHSKYSVGISIPLIQRKAKVVSSGSDYTNSFVFNEGASHFKVFFNYGWVF

SEQ ID NO: 12864 - protein, 661 aa, Helicobacter pylori
MRKLFIPLLLFSALEANEKNGFFIEAGFETGLLEGAQTQEKRHTTTKNTYATYNYLPTDTILKRAANLFTDAKSISQLNFSSLSPVKVLYIGGQLTIENFLPYNLSNVKLSFTDAQGTVIDLGVIETIPKHSKIVLPGEAFNSLKEAFDKIGPYTFFLPKFEATSTSVSDANTQRVFETLNNIKTNLVMKYSNENPSNFNTCPYNNSGNTKNDCWQNFTPQTAEEFTNLMLNMIAVLDSQSWGDAILNAPFEFTNSPTDCDNDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYGHNGNMTYQRVPTGQNENGKPKDSDGPPYNVCSLYGGSNQPAFPSNYPNSIYHNCADVPAGFLGVTAAVWQQLINQNALPINYANLSAQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12865 - protein, 661 aa, Helicobacter pylori
MKKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNAIDLGVIETIPKHSKIVLPGEAFDSLKEAFDKIGPYTFFLPKFEATSTSVSDANTQRVFETLNNIKTNLIMKYSNENPSNFNTCPYNNNGNTKNDCWQNFTPQTAEEFTNLMLNMIAVLDSQSWGDAILNAPFEFTNSPTDCDNDSSKCVNPGVNGRVDSKVDQQYILNKQGIVNNFRKKIEIDAVVLKNSGVVGLANGYGNDGEYGTLGVEAYALEPQKLFGNDLKTINLADLRTILHEFSHTKGYTHNGNMTYQRVPTGQNENGKPKDSDGLPYNVCSLYGGSNQSAFPSNYPNSIYHNCADVPAGFLGVTAAVWQQLINQNALPIDYANLSAQTNYNLNASLNTQDLANSMLGTIQKTFVTSSVTNHYSSSASQSFRSPILGVNAKIGYQNYFNDFIGLAYYGIVKYNYSKALNQKVQQLSYGGGIDLLLDFITTYSNKNSPIGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12866 - protein, 410 aa, Helicobacter pylori
MRKLLFFTLLLPFPLFAQNNNAPSSYDLHDIKITGYLQTQYQKAGAEGINSFSGGNFDKNSSDRFMIRRGRLKIDRADKFSSIVFQIDATQNGVNLMDAFIQFHPEETKAILFTAGLFNRPFGHSIVYSSGYRDFPERARVFQTLMPRERDIGAMVTVRPEKKFHFLTAEIAMINGSGYNARDYDSRKDIVGNLGFKFDSLANKKLHIGFGASIYKGKVRSNTDTYYRNNGAGFTADTDSGHVNGYVSRDYYGANLQLQYDNTFGTSSFKAEYITGKQPGVAASASLAGPLASQSFSVQPTTDLYLREFSAYYLWLTQQIAKSRFTALLAYDMYDPNDKVKGADIGTPNSNTSAGDIKFTTLGYGMTYLINTRLKLTLYNEHVVNDRTSLPGYLDDIKDDVFTARLQYRW

SEQ ID NO: 12867 - protein, 661 aa, Helicobacter pylori
MKKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFDSLKEAFDKISPYTFFFPKFETTSTSISDTNTQRVFETLNKIKTNLIMKYSNENPSNFNTCPYNNNGNTKNDCWQNFTPQTAEEFTNLMLNMIAVLDSQSWGDAILNAPFEFTNSSADCDNDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLSAQTNYNLNASLNTQDLANSMLNTIQKTFVTSSVTNHYFSSASQSFRSPILGVNAKIGYQNYFNDFIGLAYYGIIKYNYSKALNQKFQQLSYGGGIDLLLDFITTYSNKNNPTGVQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12868 - protein, 667 aa, Helicobacter pylori
MKKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFDSLKEAFDKIGPYTFFLPKFEAASTSISDANTQRVFETLNNIKTNLIMKYSNKNPSNFNTCPYNNNGNTKNDCWQNFTPQTAEEFTNLMLNMIAVLDSQSWGDAILNAPFEFTNSPTDCDNDSSKCVNPGVNGRVDTKVDQQYILNKQGIINNFRKKIEIDAVVLKDSGVVGLANGYGNDGEYGTLGVEAYALEPQKLFSDNLKTINLEDLRTILHEFSHTKGYGHNGNMTYQRVPVMKNGQVERDNNGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLVDFITTYSNKNSPTGVQTKRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12869 - protein, 655 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPIRVLYNGQLTIENFLPYNLSNVKLSFTDAQGNIIDLGVIETIPKHSKIVLPGEAFDSLKIDPYTFLPKIEATSTSISDANTQRVFETLNKIKTNLVVNYRNENKFEGHQNHWEAFTPQTAEEFTNLMLNMIAVLDSQSWGDAILNAPFEFTNKGGGGECDTSKENDCVNPGTNGLVNSKVDQKYVLNKQDIVNKFRNKADLDVVVLKDSGVVGLGSDITPNNNDDGKHYGQLGVVASALDPKKLFGNDLKTINLEDLRTILHEFSHTKGYTHNGNMTYQRVPVTKDGQVENDNNGKPKDSDGLPYNVCSRFNGSGQPAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPIGVQRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12870 - protein, 667 aa, Helicobacter pylori
MKKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNGKLSFTDAQGNAIDLGVIETIPKHSKIVLPGEAFDSLKEAFDKIDPYTFFFPKFEATSTSVSDANTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGINGRVDSKVDQQYVLNKQGIVNNFRKKIEIDAVVLKNSGVVGLANGYGNDGEYGTLGVEAYALEPQKLFSNDLKTINLADLRTILHEFSHTKGYGHNGNMTYQRVPVMKDGQVERDNNGKPKDSDGLPYNVCSLYGGQGQSAFPSNYPNSIYHNCADVPAGFLGVTAAVWQQLINQNALPINYANLNAQTNYNLNASLNTQDLANSMLGTIQKTFVTSSVTNHYSSSASQSFRSPILGVNAKIGYQNYFNDFIGLAYYGIVKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12871 - protein, 661 aa, Helicobacter pylori
MKKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNAIDLGVIETIPKHSKIVLPGEAFDSLKEAFDKIGPYTFFLPKFEATSTSVSDANTQRVFETLNNIKTNLIMKYSNENPSNFNTCPYNNNGNTKNDCWQNFTPQTAEEFTNLMLNMIAVLDSQSWGDAILNAPFEFTNSPTDCDNDSSKCVNPGVNGRVDSKVDQQYILNKQGIVNNFRKKIEIDAVVLKNSGVVGLANGYGNDGEYGTLGVEAYALEPQKLFGNDLKTINLADLRTILHEFSHTKGYTHNGNMTYQRVPTGQNENGKPKDSDGLPYNVCSLYGGSNQSAFPSNYPNSIYHNCADVPAGFLGVTAAVWQQLINQNALPIDYANLSAQTNYNLNASLNTQDLANSMLGTIQKTFVTSSVTNHYSSSASQSFRSPILGVNAKIGYQNYFNDFIGLAYYGIIKYNYSKALNQKVQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12872 - protein, 661 aa, Helicobacter pylori
MRKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFDSLKEAFDKIDPYTFFFPKFEATSTSVSDANTQRVFETLNKIKTNLIMKYSNENPNNFNTCPYNNNGNTKNDCWQPFTPQTAEEFTNLMLNMIAVLDSQSWGDAILNAPFEFTNSPTDCDNDSSKCVNPGINGRVDSKVDQQYVLNKQGIVNNFRKKIEIDAVVLKNSGVVGLANGYGSDGEYGTLGVEAYALEPQKLFSDNLKTINLEDLRTILHEFSHTKGYGHNGNMTYQRVPTGQNENGKPKDSDGLPYNVCSLYGGSNQSAFPSNYPNSIYHNCADVPAGFLGVTAAVWQQLINQNALPINYANLGSQTNYNLNASLNTQDLANSMLSTIQKTFVTSSVTDHYFSSASQSFRSPILGVNAKIGYQNYFNDFIGLAYYGIIKYNYAKAINQKVQQLSYGGGIDLLVDFITTYSNKNSPIDIQTKRNFSSSFGIFGGLRGLYNSYYVLNKVKGSGNLDVATGLNYRYKHSKYSVGISIPLIQRKASVISSGGDYTNSFVFNEGASHFKVFFNYGWVF

SEQ ID NO: 12873 - protein, 668 aa, Helicobacter pylori
MRKLFIPLLLFSALEANEKNGFFIEAGFETGLLEGAQTQEKRHTTTKNTYATYNYLPTDSVLKRAANLFTDAKSISQLNFSSLSPVKVLYIGGKLTIENFLPYNLSNVKLSFTDAQGNTIDLGVIETIPKHSKIVLPGEAFNSLKEAFDKIGPYTLFLPKIEATSTSVSDANTQRVFETLNKIKTNLIMKYSNENPSNFNTCPYNNNGNTKNDCWQNFTPQTAEEFTNLMLNMIAVLDSQSWGDAILNAPFEFTNKGGGGECDTSKENDCVNPGTNGVVNSQNKNYVLNKQDIVNKFRNKADLDVVILKDSGVVGLGSDITPSTNDDGKHYGQLGVVASALEPKKLLGNNLKTINLEDLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLNSQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPIDIQTRRNFSSSFGVFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12874 - protein, 660 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLSNVKLSFTDAQGNVIDLGVIETIPKHSKIVLPGEAFDSLKIDPYTLFLPKIEATSTSVSDANTQRVFETLNKIKTDLVVNYRNENKFKDHENHWEAFTPQTAEEFTNLMLNMIAVLDSQSWGDAILNAPFEFTNKDGGEECDTSKENECVNPGTNGRVNSKVDQQYVLNKQDIVNKFRNKADLDVVILKDSGVVGLGSDITPSNNDDGKHYGQLGVVASALDPKKLFGDNLKTINLEDLRTILHEFSHTKGYTHNGNMTYQRVPVMKDGQVEKDSNGKPKDSDGLPYNVCSLYGGQGQSAFPSNYPNSIYHNCADVPAGFLGVTAAVWQQLINQNALPINYANLSTQTNYNLNASLNTQDLANSMLSTIQKTFVTSSVTNHYSSSASQSFRSPILGVNAKIGYQNYFNDFIGLAYYGIIKYNYAKAINQKVQQLSYGGGIDLLLDFITTYSNKNSPTGIQTKRNFSSSFGIFGGLRGLYNSYYVLNKVKGSGNLDVATGLNYRYKHSKYSVGISIPLIQRKASVVSNGGDYTNSFVFNEGASHFKVFFNYGWVF

SEQ ID NO: 12875 - protein, 659 aa, Helicobacter pylori
MRKLFIPLLLFSALEANEKNGFFIEAGFETGLLEGAQTQEKRHTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFNSLKEAFDKIGPYTFFLPKFEATSTSISDTNTQRVFETLNKIKTNLIMKYSNKNPSNFNTCPYNNNGNTKNDCWQNFTPQTAEEFTNLMLNMIAVLDSQSWGDAILNAPFEFTNSSTDCDNDPSKCVNPGVNGRVDSKVDQQYILNKQGIINNFRKKIEIDAVVLKNSGVVGLAHGYGNDGEYGTLGVEAYALEPQKLFGNDLKTINLADLRTILHEFSHTKGYGHNGNMTYQRVPTGQNENGKPKDSDGLPYNVCSLYGGQGQSAFPSNYPNSIYHNCADVPAGFLGVTVAVWQQLINQNALPINYANLGSQTNYNLNASLNTQDLANSMLGTIQKTFVTSSVTNHYFSSASQSFRSPILGVNAKIGYQNYFNDFMGLAYYGIIKYNYSKALNQKFQQLSYGGGIDLLLDFITTYSNKNSPIGVQRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12876 - protein, 667 aa, Helicobacter pylori
MRKLFIPLLLFSALEANEKNGFFIEAGFETGLLEGAQTQEKRHTTTKNTYATYNYLPTDTILKRAANLFTDAKSISQLNFSSLSPVKVLYIGGQLTIENFLPYNLSNVKLSFTDAQGNVIDLGVIETIPKHSKIVLPGEAFNSLKEAFDKIGPYTFFLPKFEATSTSVSDANTQRVFETLNNIKTNLVMKYSNENPSNFNTCPYNNSGNTKNDCWQNFTPQTAEEFTNLMLNMIAVLDSQSWGDAILNAPFEFTNSPTDCDNDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYGHNGNMTYQRVPVMKNGQVERDNNGKPKDSDGLPYNVCSLYGGSNQPAFPSNYPNSIYHNCADVPAGFLGVTAAVWQQLINQNALPINFANLNSQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPIGVQNRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12877 - protein, 661 aa, Helicobacter pylori
MRKLFIPLLLFSALEANEKNGFFIEAGFETGLLEGAQTQEKRHTTTKNTYATYDYLPTDTILKRAANLFTDAKSISQLTFSSLSPVKVLYIGGKLTIENFLPYNLSNVKLSFTDAQGNVIDLGVIETIPKHSKIVLPGEAFDSLKEAFDKIGPYTFFFPKFEATSTSISDTNTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGVNGRVDSKVDQQYILNKQGIINNFRKKIEIDVVVLKNSGVVGLANGYGNDGEYGTLGVEAYALEPQKLFGNDLKTINLADLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNNPTGIQTRKNFSSSFGIFGGLRGLYNSYYVLNKVKGSGNLDVATGLNYRYKHSKYSVGISIPLIQRKAKVVSTNGDYTNSFVFNEGASHFKVFFNYGWVF

SEQ ID NO: 12878 - protein, 661 aa, Helicobacter pylori
MRKLFIPLLLFSALEANEKNGFFIEAGFETGLLEGTQTQEKRHTTTKNTYATYNYLPTDAVLKRAANLFTDAKSISQLNFSSLSPVKVLYIGGKLTIENFLPYNLSNVKLSFTDAQGNVIDLGVIETIPKHSKIVLPGEAFDSLKEAFDKIDPYTFFFPKFEATSTSVSDANTQRVFETLNKIKTNLIMKYRNENPNNFNTCPYNNNGNTKNDCWQPFTPQTAEEFTNLMLNMIAVLDSQSWGDAILNAPFDFTNSPTDCDNDPSKCVNPGINGRVDSKVDQQYVLNKQGIVNNFRKKIEIDAVVLKNSGVVGLANGYGNDGEYGTLGVEAYALDPTKLFGNNLKTINLEDLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLDSQTNYNLNASLNTQDLANSMLSTIQKTFVTSSVTNRYFSSASQNFRSPILGVNAKIGYQNYFNDFIGLAYYGIIKYNYAKAANQKVQQLSYGGGIDLLVDFITTYSNKNNPIDIQTRRNFSSSFGIFGGLRGLYNSYYALNKVKGSGNLDVATGLNYRYKHSKYSVGISIPLIQRKASIVSSDGDYTNSFVFNEGASHFKVFFNYGWVF

SEQ ID NO: 12879 - protein, 657 aa, Helicobacter pylori
MRKLFIPLLLFSALEANEKNGFFIEAGFETGLLEGTQTQEKRHTTTKNTYATYSYLPADSVLKRAANLFTNAEAISKLKFSSLSPIRVLYMYNGQLTIENFLPYNLSNVKLSFKDAQGNTIDLGVIETIPKHSKIVLPGEAFDSLKEAFDKIDPYTFFLPKIEATSTSISDTNTQRVFETLNKIKTDLVVNYRNENKFKDHENHWEAFTPQTAEEFTNLMLNMIAVLDSQSWGDAILNAPFEFTNKGGGGECDTSKENDCVNPGTNGLVNSQNKSYVLNKQDIVNKFRNKADLDVVILKDSGVVGLGSDITPSNNDDGKHYGQLGVVASALDPKKLFGNNLKTINLEDLRTILHEFSHTKGYTHNGNMTYQRVPTGQNENGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12880 - protein, 661 aa, Helicobacter pylori
MRKLFIPLLLCSMLEANEKNGFFIEAGFETGLLEGAQTQEKRHTTTKNTYATYNYLPTDTILKRATNLFTDAKSISQLNFSSLSPVKVLYIGGKLTIENFLPYNLSNVKISFTDAQGNVINLGVIETIPKHSKIVLPGEAFDSLKKAFDKIDPYTFFLPKFEATSTSVSDANTQRVFETLNKIKTNLIMKYSSENPSNFNTCPYNNNGNTKNDCWQPFTPQTAEEFTNLILNMIAVLDSQSWGDAILNAPFEFTNSSTDCDNDPSKCVNPGINGRVDSKVDQQYVLNKQGIVNNFRKKIEIDAVVLKNSGVVGLANGYGNDGEYGTLGVEAYALEPTKLFGNNLKTINLADLRTILHEFSHTKGYGHNGNMTYQRVPTGQNENGKPKDSDGLPYNVCSLYGGQGQSAFPSNYPNSIYHNCADVPAGFLGVTAAVWPQLINQNALPINFANLGSQTNYNLNASLNTQDLANSMLSTIQKTFVTSSVTNHYFSSASQNFRSPILGVNAKIGYQNYFNDFIGLAYYGIIKYNYAKAANQKVQQLSYGGGIDLLLDFITTYSNKNSPTGIQTKRNLKTSFGIFGGLRGLYNSYYALNKVKGSGNLDVATGLNYRYKHSKYSVGISIPLIQRKASIVSSNGDYTNSFVFNEGASHFKVFFNYGWVF

SEQ ID NO: 12881 - protein, 662 aa, Helicobacter pylori
MRKLFIPLLLCSALEANQKNGFFIEVGFETGLLEGTQTQEKRHTTTKNTYATYNYLPTDTILKRAANLFTDAKSISQLNFSSLSPVKVLYIGGKLTIENFLPYNLSNVKISFTDAQGNVINLGVIETIPKHSKIVLPGEAFDSLKEAFDKIDPYTFFLPKFEATSTSVSDANTQRVFETLNKIKTNLIMKYSNENPSNFNTCPYNNNNGNTKNDCWQPFTPQTAEEFTNLMLNMIAVLDSQSWGDAILNAPFDFTNSSTDCDNDPSKCVNPGINGRVDSKVDQQYVLNKQGIVNNFRKKIEVDAVVLKNSGVVGLANGYGNDGEYGTLGVEAYALEPQKLFGNNLKTINLQDLRTILHEFSHTKGYGHKRDMTYQRVPTGQNENGKPKDSDGLPYNVCSLYGGSNQPAFPSNYPNSIYHNCADVPAGFLGVTAAVWQQLINQNALPINFANLGSQTNYNLNASLNTQDLANSMLSTIQKTFVTSSVTNHYVSSASQSFRSPILGVNAKIGYQNYFNDFIGLAYYGIIKYNYAKAANQKVQQLSYGGGIDLLVDFITTYSNKNSPTGIPTTRNFSSSFGIFGGLRGLYNSYYVLNKVKGSGNLDVATGLNYRYKHSKYSVGISIPLIQRKASVVSSDGDYTNSFVFNEGASHFKVFFNYGWVF

SEQ ID NO: 12882 - protein, 661 aa, Helicobacter pylori
MRKLFIPLLLFSALEANEKNGFFIEAGFETGLLEGTQTQEKRHTTTKNTYATYNYLPTDTILKRAANLFTDAKSISQLNFSSLSPIKVLYIGGKLTIENFLPYNLSNGKLGFTDAQGNVIDLGVIETIPKHSKIVLPGEAFDSLKEAFDKIGPYTFFFPKFEATSTSISDTNTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGTNGLVNSKVDQQYILNKQGIINNFRKKIEIDAVVLKNSGVVGLANGYGNDGEYGTLGVEAYALEPQKLFGNDLKTINLADLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLSTIQKTFVTSSVTNHYSSSASKSFRSPILGVNAKIGYQNYFNDFIGLAYYGIVKYNYSKALNQKFQQLSYGGGIDLLLDFITTYSNKNSPTGIQTKKNFSSSFGIFGGLRGLYNSYYVLNKVKGSGNLDVATGLNYRYKHSKYSVGISIPLIQRKAKVVSSGSDYTNSFVFNEGASHFKVFFNYGWVF

SEQ ID NO: 12883 - protein, 661 aa, Helicobacter pylori
MRKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGSVIDLGVIETIPKHSKIVLPGEMFNSLKEAFDKIDPYTFFLPKFEATSTSISDANTQRVFETLNNIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNDLKTINLENLRTILHEFSHIKGYTHNGNMTYQRVPTGQNENGKPKDSDGLPYNVCSLYGGQGQSAFPSNYPNSIYHNCADVPAGFLGVTAAVWQQLINQNALPIDYANLSAQKNYNLNASLNTQDLANSMLNTIQKTFVTSSVTNHYFSSASQSFRSPILGVNAKIGYQNYFNDFIGLAYYGIIKYNYSKALNQKFQQLSYGGGIDLILDFITTYSNKNSPTGVQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12884 - protein, 661 aa, Helicobacter pylori
MRKLFIPLLLCSALEANEKNGFFIEAGFETGLLEGTQTQEKRHTTTKNTYATYNYLPTDAVLKRAANLFTDAKSISQLNFSSLSPVKVLYIGGKLTIENFLPYNLSNVKLSFTDAQGNMIDLGVIETIPKHSKIVLPGEAFDSLKEAFDKIDPYTFFFPKFEATSTSVSDANTQRVFETLNKIKTNLIMKYSNENPNNFNTCPYNNNGNTKNDCWQPFTPQTAEEFTNLMLNMIAVLDSQSWGDAILNAPFDFTNSSTDCDNDPSKCVNPGINGRVDSKVDQQYVLNKQGIVNNFRKKIEIDAVVLKNSGVVGLANGYGNDGEYGTLGVEAYALEPKKLFGNNLKTINLADLRTILHEFSHTKGYGHNGNMTYQRVPTGQNENGKPKDSDGLPYNVCSLYGGQGQSAFPSNYPNSIYHNCADVPAGFLGVTAAVWQQLINQNALPMNFANLGSQTNYNLNASLNTQDLANSMLSTIQKTFVTSSVTDHYFSSASQNFRSPILGVNAKIGYQNYFNDFIGLAYYGIIKYNYAKAVNQKVQQLSYGGGIDLLVDFITTYSNKNNPIDIQTRRNFSSSFGIFGGLRGLYNSYYALNKVKGSGNLDVATGLNYRYKHSKYSVGISIPLIQRKASIVSSNGDYTNSFVFNEGASHFKVFFNYGWVF

SEQ ID NO: 12885 - protein, 668 aa, Helicobacter pylori
MRKLFIPFLLFSALEANEKNGFFIEAGFETGLLEGTQTQEKRHTTTKNTYATYNYLPTDTILKRAANLFTNAEAISKLKFSSLSPVKVLYIGGQLTIENFLPYNLNNVKLSFTDAQGNVIDLGVIETIPKHSKIVLPGEAFDSLKEAFDKIGPYTFFLPKFEATSTSVSDANTQRVFETLNKIKTNLIMKYSNKKPNNFNTCPYNNNGNTKNDCWQNFTPQTAEEFTNLMLNMIAVLDSQSWGDAILNAPFEFTNKGGGGECDTSKENDCVNPGTNGLVNSQNKSYVLNKQDIVNKFRNKADLDVVILKDSGVVGLGSDITPSNNDDGKHYGQLGVVASALDPKKLFGNDLKTINLADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIVKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSNGGDYTNSFAFNEGASHFKVFFNYGWVF

SEQ ID NO: 12886 - protein, 661 aa, Helicobacter pylori
MRKLFTSFLLFSALEANEKNGFFIEAGFETGLLEGTQTQEQRHTTTKNTYATYNYLPTDAVLKRAANLFTDAKSISQLNFSSLSPVKVLYIGGKLTIENFLPYNLSNVKLSFTDAQGNMIDLGVIETIPKHSKIVLPGEAFDSLKEAFDKIDPYTFFFPKFEATSTSVSDANTQRVFETLNKIKTNLIMKYSNENPNNFNTCPYNNNGNTKNDCWQPFTPQTAEEFTNLMLNMIAVLDSQSWGDAILNAPFEFTNSSTDCDNDSSKCVNPGINGRVDSKVDQQYVLNKQGIVNNFRKKIEIDAVVLKNSGVVGLANGYGNDGEYGTLGVEAYALEPQKLFGNNLKTINLEDLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSMLSTIQKTFVTSSVTNHYFSSASQSFRSPILGVNAKIGYQNYFNDFIGLAYYGIIKYNYAKASDQKVQQLSYGGGIDLLVDFITTYSNKNNPIDIQTRRNFSSSFGIFGGLRGLYNSYYALNKVKGSGNLDVATGLNYRYKHSKYSVGISIPLIQRKASVVSSNGDYTNSLVFNEGASHFKVFFNYGWVF

SEQ ID NO: 12887 - protein, 652 aa, Helicobacter pylori
MRKLFIPLLLFSALEANEKNGFFIEAGFETGLLEGTQTQEKRNTTTKNTYATYNYLPTDTILKRAANLFTNAEAISKLKFSSLSPVRVLYMYNGQLTIENFLPYNLSNVKLSFTDAQGNVIDLGVIETIPKHSKIVLPGEAFDSLKIDPYTLFLPKIEATSTSISDANTQRVFETLNKIETNLVVNYRNENKFKDHENHWEAFTPQTAEEFTNLMLNMIAVLDSQSWGDAILNAPFEFTNKGGGECDTSKENDCVNPGTNGRVNSQNKSYVLNKQDIVNKFRNKADLDVIVLKDSGVVGLGSDITPSNNDDGKHYGQLGVVASALDPKKLFGNNLKTINLEDLRTILHEFSHTKGYTHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLNTIQKTFVTSSVTNHYFSSASQSFRSPILGVNAKIGYQNYFNDFIGLAYYGIIKYNYAKAINQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12888 - protein, 586 aa, Helicobacter pylori
MRKLFSQCLKMTSGVAVLSMIAAQSAIAVPDESQLNQTQGEIISPEEALGVLQNRPTLNTPLNRDTSKQFWDNTSGDGMSQVTNISELRDVSPTDWAYEALRSLVERYGCIVGYPDRTFRGNRATSRWEFAAGLNACLNTIERLLQENVAVLREDIEKLKRLAQEFEQELMALKSRVDNLESRVAFLEDHQFSTTTKLGGEVLFTFSSASGERAIDSRQRDAIFNFGADGRRATRRPDDNATLAFRTRLNFDSSFYGKDRLRVRVQTGTIPRWDRAMGTTMARLGHDASNDADVELNDVYYRFPIGKFRGWVGTNALDIDNIFDVGNPFLASSGSGALSRFIRRNPLLFRGPEGIGAGAEYKFWDDVFVVRGLYLADNGNSPDLGEGLFNGSYSTGGQLSIYPTDSLDISFTYVFSHFTEDDVNTSSSNGSRVASDPFFDVATNRDSYGITGDWRINDTFHLYATGAYALARAQGVANPANGEDRRGLGADLWTWTAILSAVDIFKEGAVFSVGGGQYVTAERVETLPGDLQSIDRDTPYIIEAQYKYPLADGILLTPGFYTVINPEGDEDNNTIWVGVLRTTFKF

SEQ ID NO: 12889 - protein, 663 aa, Helicobacter pylori
MRKLFTSFLLFSALEANEKNGFFIEAGFETGLLEGTQTQEQRHTTTKNTYATYNYLPTNAVLKRATNLFTDAKSISQLNFSSLSPVKVLYMCGKLTIENFLPYNLSNVKLSFTDAQGNVIDLGVIETIPKHSKIVLPGEAFDSLKEAFDKIDPYTFFLPKFEATSTSVSDANTQRVFEMLNKIKTNLIMKYSNENPNNFNTCPYNNNGNTKNDCWQPFTPQTAEEFTNLMLNMIAVLDSQSWGDAILNAPFDFTNKGGGECDTSKENECVNPGTNGRVDSKVDQQYVLNKQGIVNNFRKKIEIDAVVLKNSGVVGLANGYGNDGEYGTLGVEAYALEPTKLFGNNLKTINLADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINFANLGSQTNYNLNASLNTQDLANSMLSTIQKTFVTSSVTNHYFSSASQSFRSPILGVNAKIGYQNYFNDFIGLAYYGIIKYNYAKAANQKVQQLSYGGGIDLLLDFITTYSNKNNPIDIQTRRNFSSSFGIFGGLRGLYNSYYALNKVKGSGNLDVATGLNYRYKHSKYSVGISIPLIQRKASIVSSNGDYTNSLVFNEGASHFKVFFNYGWVF

SEQ ID NO: 12890 - protein, 661 aa, Helicobacter pylori
MRKLFIPLLLCSALEANEKNGFFIEAGFETGLLEGTQTQEKRHTTTKNTYATYNYLPTDTVLKRAANLFTDAKSISQLNFSSLSPVKVLYIGGKLTIENFLPYNLNNVKLSFTDAQGNVIDLGVIETIPKHSKIVLPGEAFDSLKEAFDKIDPYTFFLPKFEATSTSVSDANTQRVFETLNKIKTNLIMKYSSENPNNFNTCPYNNNGNTKNDCWQPFTPQTAEEFTNLMLNMIAVLDSQSWGDAILNAPFEFTNSSTDCDNDPSKCVNPGTNGRVDSKVDQQYVLNKQGIVNNFRKKIEIDAVVLKNSGVVGLANGYGNDGEYGTLGVEAYALDPKKLFGNNLKTINLEDLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSMLSTIQKTFVTSSVTNHYFSSASQNFRSPILGVNAKIGYQNYFNDFIGLAYYGIIKYNYAKAANQKVQQLSYGGGIDLLVDFITTYSNKNSPIDIQTRRNFSSSFGIFGGLRGLYNSYYALNKVKGSGNLDVATGLNYRYKHSKYSVGISIPLIQRKASVVSSGGDYTNSFVFNEGASHFKVFFNYGWVF

SEQ ID NO: 12891 - protein, 976 aa, Helicobacter pylori
MKKLFFFVLIGSSILGFTREVPPSILLKPILNPYHMTGLFFPKVNLLGDTHNLTDYHLDNLKCILACLQRTPYEGAAFTVTDYLGFSDTQKDGIFCFKNLTPESGGVIGSPTQNTPTIKIHNTIGPVLFENNTCHRLWTQTDPENEGNKAREGGAIHAGDVYISNNQNLVGFIKNFAYVQGGAISANTFAYKENKSSFLCLNNSCIQTKTGGKGGAIYVSTSCSFENNNKDLLFIQNSGCAGGAIFSPTCSLIGNQGDIVFYSNHGFKNVDNATNESGDGGAIKVTTRLDITNNGSQIFFSDNISRNFGGAIHAPCLHLVGNGPTYFTNNIANHTGGAIYITGTETSKISADHHAIIFDNNISANATNADGSSSNTNPPHRNAITMDNSAGGIELGAGKSQNLIFYDPIQVTNAGVTVDFNKDASQTGCVVFSGATVLSADISQANLQTKTPATLTLSHGLLCIEDRAQLTVNNFTQTGGIVALGNGAVLSSYQHSTTDATQTPPTTTTTDASVTLNHIGLNLPSILKDGAEMPLLWVEPISTTQGNTTTYTSDTAASFSLNGATLSLIDEDGNSPYENTDLSRALYAQPMLAISEASDNQLQSESMDFSKVNVPHYGWQGLWTWGWAKTENPTTTPPATITDPKKANQFHRTLLLTWLPAGYIPSPKHKSPLIANTLWGNILFATENLKNSSGQELLDRPFWGITGGGLGMMVYQEPRKDHPGFHMHTSGYSAGMITGNTHTFSLRFSQSYTKLNERYAKNYVSSKNYSCQGEMLLSLQEGLMLTKLIGLYSYGNHNSHHFYTQGEDLSSQGEFHSQTFGGAVFFDLPLKPFGRTHILTAPFLGAIGMYSKLSSFTEVGAYPRTFITETPLINVLIPIGVKGSFMNATHRPQAWTVELAYQPVLYRQEPSISTQLLAGKGMWFGHGSPASRHALAYKISQKTQLLRFATLQLQYHGYYSSSTFCNYLNGEVSLRF

SEQ ID NO: 12892 - protein, 659 aa, Helicobacter pylori
MRKLFIPLLLFSALEANEKNGFFIEAGFETGLLEGTQTQEKRHTTTKNTYATYNYLPADSVLKRAANLFTDAKSISQLTFSSLSPVKVLYISGKLTIPNFLPYNLSNVKLSFTDAQGNAIDLGVIETIPKHSKIVLPGEAFDSLKEAFDKISPYTFFFPKFEATSTSISDTNTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGINGRVDTKVDQQYILNKQGIINNFRKKIEIDAVVLKNSGVVGLANGYGNDGEYGTLGVEAYALEPQNLFGTTLKTINLEDLRTILHEFSHTKGYGHNGNMTYQRVPTGQNGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIVKYNYSKALNQKVQQLSYGGGIDLLLDFITTYSNKNSPIGIQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12893 - protein, 653 aa, Helicobacter pylori
MRKLFTSLLLFSALEANEKNGFFIEAGFETGLLEGTQTQEKRHTTTKNTYATYSYLPTDSVLKRAANLFTNAEAISKLKFSSLSPVRVLYMYNGRLTIENFLPYNLSNVKLSFTDAQGNVIDLGVIETIPKHSKIVLPGEVFDSLKIDPYTFFLPKIEATSTSISDTNTQRVFETLNKIKTDLVVNYRNENKFKDHENHWEAFTPQTAEEFTNLMLNMIAVLDSQSWGDAILNAPFEFTNKGGGGECDTSKENDCVNPGTNGRVNSQNKSYVLNKQDIVNKFRNKADLDVIVLKDSGVVGLGSDITPSNNDDGKHYGQLGVVASALDPKKLFGNNLKTINLEDLRTILHEFSHTKGYTHNGHMTYQRVPTGQNENGKPKDSDGLPYNVCSLYGGSNQSAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKAVNQKFQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWIF

SEQ ID NO: 12894 - protein, 646 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLNNVKLSFTDAQGNVIDLGVIETIPKHSKIVLPREAFDSLKVDPYTLFLPKIEATSTSISDANTQRVFETLNKIKTNLVVNYRNENKFEGHQNHWEAFTPQTAEEFTNLMLNMIAVLDSQSWGDAILNAPFEFTNKGGGGECDTSKENDCVNPGTNGLVNSQNQQYVLNKQDIVNKFRNKADLDVVILKNSGVVGLANGYGNDGEYGTLGVEAYALEPQKLFGNDLKTINLEDLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12895 - protein, 659 aa, Helicobacter pylori
MRKLFIPLLLFSALEANEKNGFFIEAGFETGLLEGTQTQEKRHTTTKNTYATYDYLPTDSVLKRAANLFTNAEAISKLKFSSLSPVRVLYMYNGQLTIENFLPYNLSNVKLSFTDAQGNTIDLGVIETIPKHSKIVLPGEAFDSLKIDPYTLFLPKIEATSTSISDANTQRVFETLNKIKTDLVVNYRNENKFKDHENHWEAFTPQTAEEFTNLMLNMIAVLDSQSWGDAILNAPFEFTNKGGGGECDTSKENDCVNPGVNGRVNSQNKSYVLNKQDIVNKFRNKADLDVIVLKDSGVVGLGSDITPSNNDDGKHYGQLGVVASALEPQKLFGNDLKTINLEDLRTILHEFSHTKGYTHNGNMTYQRVPVMKNGQVERDNNGKPKDSDGLPYNVCSLYGGSNQSAFPSNYPNSIYHNCADVPAGFLGVTAAVWQQLINQNALPINYANLSAQTNYNLNASLNTQDLANSMLSTIQKTFVTSSVTNHYFSSASQSFRSPILGVNAKIGYQNYFNDFIGLAYYGIIKYNYSKALNQKVQQLSYGGGIDLLLDFITTYSNKNSPIGVQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12896 - protein, 661 aa, Helicobacter pylori
MRKLFTSLLLCSALEANEKNGFFIEAGFETGLLEGTQTQDKRHTTTKNTYATYNYLPTDTILKRAANLFTDAKSISQLNFSSLSPVKVLYIGGKLTIENFLPYNLNNVKLSFTDAQGNMIDLGVIETIPKHSKIVLPGEAFDSLKEAFDKIDPYTFFLPKFEATSTSVSDANTQRVFETLNKIKTNLIMKYSNENPSNFNTCPYNNNGNTKNDCWQPFTPQTAEEFTNLMLNMIAVLDSQSWGDAILNAPFDFTNSSTDCDNDPSKCVNPGINGRVDSKVDQQYVLNKQGIVNNFRKKIEIDAVVLKNSGVVGLANGYGNDGEYGTLGVEAYALEPQKLFGNNLKTINLQDLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSILSTIQKTFVTSSVTNHYVSSASQSFRSPILGVNAKIGYQNYFNDFIGLAYYGIIKYNYAKAANQKVQQLSYGGGIDLLVDFITPYSNKNSPIDIQTRTNFSSSFGIFGGLRGLYNSYYVRNPLKGSGNLDVATGLNYRYKHSKYSVGISIPLIQRKASVVSSDGDYTNSFVFNEGASHFKVFFNYGWVF

SEQ ID NO: 12897 - protein, 666 aa, Helicobacter pylori
MKKLFTSLLLFSALEANEKNGFFIEAGFETGLLEGTQTQEKRHTTTKNTYATYNYLPTDSVLKRAANLFTDAKSISQLNFSSLSPVKVLYIGGKLTIENFLPYNLSNVKLSFKDAQGNVIDLGVIETIPKHSKIVLPGEAFDSLKEAFDKIGPYTFFLPKFEATSTSISDTNTQRVFETLNNIKTNLIVKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNNLKTINLEDLRTILHEFSHTKGYTHNGNMTYQRVPVMKNGQVERDNNGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHFSSASQSFRSPILGVNAKIGYQNYFNDFIGLAYYGIVKYNYSKALNQKFQQLSYGGGIDLLLDFITTYSNKNSPIGVQTKRNFSSSFGIFGGLKGLYNSYYVLNKVKGSGNLDVATGLNYRYKHSKYSVGISIPLIQRKAKVVSSGSDYTNSFVFNEGASHFKVFFNYGWVF

SEQ ID NO: 12898 - protein, 667 aa, Helicobacter pylori
MRKLFIPLLLFSALEANEKNGFFIEAGFETGLLEGTQTQEKRHTTTKNTYATYSYLPADSVLKRAANLFTNAEAISKLKFSSLSPIRVLYMYNGQLTIENFLPYNLSNVKLSFKDAQGNTIDLGVIETIPKHSKIVLPGEAFDSLKEAFDKIGPYTFFLPKFEATSTSISDTNTQRVFETLNNIKTNLIVKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNNLKTINLEDLRTILHEFSHTKGYTHNGNMTYQRVPVMKNGQVERDNNGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12899 - protein, 662 aa, Helicobacter pylori
MRKLFIPLLLFSALEANEKNGFFIEAGFETGLLEGTQTQEKRHTTTKNTYGTYDYYTTDTVLKRATNLFTNTDITKLKFSTKNPVSVHMGLTNPNPSNGAKSKVTMVVENFLPYNLNNVRLFFKDNKGKVIDLGVLETIPKHSKIVLPENIFDKIKLDDPYFFPTFEATSTSISDANTQRVFETLNKIKTDLVVNYRNENKFKDHENHWQNFTPQTAEEFTNLMLNMIAVLDSQSWGDAILNAPFEFTNKGGGEECDTSKENDCVNPGTNGVVNSQNKSYVLNKQDIVNKFRNKADLDVIVLKDSGVVGLGSDITPSNNDDGKHYGQLGVVASALDPKKLFGNNLKTINLEDLRTILHEFSHTKGYGHNGNMTYQRVPTGQNENGKPKDSDGLPYNVCSLYGGSNQSAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTRRNFSSSFGIFGGLRGLYNSYYVLNKVKGSGNLDVATGLNYRYKHSKYSVGISIPLIQRKAKVVSSGGDYTNSFVFNEGASHFKVFFNYGWIF

SEQ ID NO: 12900 - protein, 651 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPIRVLYMYNGQLTIENFLPYNLSNVKLSFKDAQGNTIDLGVIETIPKHSKIVLPGEAFDSLKIDPYTLFLPKIEATSTSISDANTQRVFETLNKIKTNLVVNYRNENKFKDHENHWEAFTPQTAEEFTNLMLNMIAVLDSQSWGDAILNAPFEFTNSPTDCDSDPSKCVNPGVNGRVNSKVDQQYVLNKQDIVNKFRNKADLDVVILKDSGVVGLGSDITPSNNDDGKHYGQLGVVASALDPKKLFGNDLKTIKLEDLRTILHEFSHTKGYTHNGNMTYQRVPTGQNENGKPKDSDGLPYNVCSLYGGSNQPAFPSNYPNSIYHNCADVPAGFLGVTAAVWQQLINQNALPIDYANLGSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12901 - protein, 661 aa, Helicobacter pylori
MRKLFIPLLLFSALEANEKNGFFIEAGFETGLLEGTQTQEKRHTTTKNTYATYNYLPTDSVLKRAANLFTDAKSISQLTFSSLSPVKVLYVGGKLTIENFLPYNLSNVKLSFTDAQGNVIDLGVIETIPKHSKIVLPGEAFDSLKEAFDKIGPYTFFLPKFEATSTSISDANTQRVFETLNNIKTNLIMKYSNENPSNFNTCPYNNNGNTKNDCWQNFTPQTAEEFTNLMLNMIAVLDSQSWGDAILNAPFEFTNSSIDCDNDPSKCVNPGVNGRVDTKVDQQYILNKQGIINNFRKKIEIDAVVLKNSGVVGLANGYGNDGEYGTLGVEAYALEPPKLFGNDLKTINLADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIIKYNYSKALNQKVQQLSYGGGIDLLLDFITTYSNKNSPIGIQTKKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12902 - protein, 657 aa, Helicobacter pylori
MKKLFIPLLLFSALEANEKNGFFIEAGFETGLLEGTQTQEKRHTTTKNTYATYNYLPTDTILKRAASLFTDAKSISQLNFSSLSPVRASASMLNGSLTIENFLPYNLNNVKLSLKDAQGNVIDLGVIETIPKHSKIVLPEKLFDGLKQIGPYIFQQIEVSSTQVSDANTQRVFETLNNIKTNLIMKYSNKNPSNFNTCPYNNNGNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYGHNGNMTYQRVPTGQTENGKPKDSDGLPYNVCSLYGGQGQSAFPSNYPNSIYHNCADVPAGFLGVTAAVWQQLINQNALPINYANLGSQTNYNLNASLNTQDLANSMLSTIQKTFVTSSVTNHYFSSASQSFRSPILGVNAKIGYQNYFNDFIGLAYYGIIKYNYSKALNQKFQQLSYGGGIDLLLDFITTYSNKNSPTGIQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12903 - protein, 653 aa, Helicobacter pylori
MRKLFIPLLLFSALEANEKNGFFIEAGFETGLLEGTQTQEKRHTTTKNTYATYDYLPTDSVLKRAANLFTNAEAISKLKFSSLSPVRVLYMYNGQLTIENFLPYNLSNVKLSFTDAQGNTIDLGVIETIPKHSKIVLPGEAFDSLKIDPYTLFLPKIEATSTSISDANTQRVFETLNKIKTDLVVNYRNENKFKDHENHWEAFTPQTAEEFTNLMLNMIAVLDSQSWGDAILNAPFEFTNKGGEGECDTSKENECVNPGTNGLVNSQNKSYVLNKQDIVNKFRNKADLDVIVLKDSGVVGLGSDITPSNNDDGKHYGQLGVEAYALDPKKLFGDNLKTINLADLRTILHEFSHTKGYGHNGNMTYQRVPTGQNENGKPKDSDGLPYNVCSLYGGSNQSAFPSNYPNSIYHNCADVPAGFLGVTAAVWQQLINQNALPIDYANLSTQKNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12904 - protein, 662 aa, Helicobacter pylori
MRKLFIPLLLFSALEANEKNGFFIEAGFETGLLEGTQTQEKRHTTTKNTYGTYDYYTTDTVLKRAANLFTNTDITKLKFSTKNPVSVHMGLTNPNPSNGAKSKVTMVVENFLPYNLNNVRLFFKDNKGKVIDLGVLETIPKHSKIVLPENIFDKIKLDDPYFFPTFEATSTSISDTNTQRVFETLNKIKTDLVVNYRNENKFKDHENHWEAFTPQTAEEFTNLMLNMIAVLDSQSWGDAILNAPFEFTNKGGEGECDTNKENDCVNPGTNGLVNSQNKSYVLNKQDIVNKFRNKADLDVIVLKDSGVVGLGSDITPSNNDDGKHYGQLGVVASALEPQKLFGNDLKTINLADLRTILHEFSHTKGYGHNGNMIYQRVPTGQSENGKPKDSDGLPYNVCSLYGGSNQPAFPSNYPNSIYHNCAGVPAGFLGVTAAVWQQLINQNALPIDYANLSAQTNYNLNAGLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISIPLIQRKAKVVSSGGDYTNSFVFNEGASHFKVFFNYGWVF

SEQ ID NO: 12905 - protein, 653 aa, Helicobacter pylori
MKKLFIPLLLFSALEANEKNGFFIEAGFETGLLEGAQTQEKRHTTTKNTYATYSYLPTDTILKRAANLFTNAEAISKLKFSSLSPVRVLYMYNGQLTIENFLPYNLSNVKLSFTDAQGNVIDLGVIETIPQHSKIVLPGETFDSLKIDPYTFFLPKIEATSTSISDANTQRVFETLNKIKTNLVVNYRNENKFKDHENHWEAFTPQTAEEFTNLMLNMIAVLDSQSWGDAILNAPFEFTNKGGGGECDTSKENECVNPGTNGLVNSKVDQQYVLNKQDIVNKFRNKADLDVIVLKDSGVVGLGSDITPSTNDDGKHYGQLGVVASALDPKKLFGNDLKTINLEDLRTILHEFSHTKGYPYGNMTYQRVPTGQNENGKPKDSDGLPYNVCSLYGGSNQPAFPSNYPNSIYHNCADVPAGFLGVTAAVWQQLINQNALPINYANLNSQTNYNLNASLNTQDLANSMLSTIQKTFVTSSVTNHYFSSASQSFRSPILGVNAKIGYQNYFNDFIGLAYYGIIKYNYSKALNQKFQQLSYGGGIDLLLDFITTYSNKNSPTGVQTKRNFSSSFGIFGGLRGLYNSYYVLNEVKGSGNLDVATGLNYRYKHSKYSVGISIPLIQRKASVVSSGGDYTNSFVFNEGASHFKVFFNYGWVF

SEQ ID NO: 12906 - protein, 653 aa, Helicobacter pylori
MRKLFIPLLLFSALEANEKNGFFIEAGFETGLLEGTQTQEKRHTTTKNTYGTYDYLPADSVLKRAANLFTNAEAISKLKFSSLSPVRVLYMYNGQLTIENFLPYNLSNVKLSFKDAQGNTIDLGVIETIPKHSKIVLPGEAFDSLKIDPYTLFLPKIEATSTSISDANTQRVFETLNKIKTDLVVNYRNENKFKDHENHWEAFTPQTAEEFTNLMLNMIAVLDSQSWGDAVLNAPFEFTNKGGGGECDTSKENDCVNPGTNGVVNSQNKSYVLNKQDIVNKFRNKADLDVVVLKDSGVVGLGSDITPSNNDDGKHYGQLGVVASALDPKKLFGNNLKTINLEDLRTILHEFSHTKGYTHNGNMTYQRVPTGQNENGKPKDSDGLPYNVCSLYGGSNQPAFPSNYPNSIYHNCADVPAGFLGVTAAVWQQLINQNALPINYANLSAQTNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12907 - protein, 653 aa, Helicobacter pylori
MKKLFIPLLLFSALEANEKNGFFIEAGFETGLLEGTQTQEKRHTTTKNTYATYNYLPTDTILKRAASLFTNTEAISKLKFSSLSPIRVLYMYNGQLTIENFLPYNLNNVKLSFTDAQGNVIDLGVIETIPKHSKIILPGEAFDSLKIDPYTLFLPKIEATSTSISDANTQRVFETLNKIKTNLVVNYRNENKFEGHQNHWEAFTPQTAEEFTNLMLNMIAVLDSQSWGDAILNAPFEFTNKGGGGECDTSKENDCVNPGTNGLVNPQNKSYVLNKQDIVNKFRNKADLDVVILKDSGVVGLGSDITPSNNDDGKHYGQLGVVASALDPKKLFGNDLKTINLEDLRTILHEFSHTKGYTHNGNMTYQRVPTGQTETGKPKDSDGLPYNVCSLYGKSNQPAFPSNYPNSIYHNCADVPAGFLGVTAAVWQQLINQNALPINYANLGSQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLMDFITTYSNKNSPIDIQTRSFFSSPFGIWWGLRGLYNSYYVLNKVKGSGNLDVATGLNYRYKHSKYSVGISIPLIQKKAKVVSSGSDYPNSFVFNEGASHFKVFFMPGWVF

SEQ ID NO: 12908 - protein, 661 aa, Helicobacter pylori
MRKLFIPLLLFSALEANEKNGFFIEAGFETGLLEGTQTQEKRHTTTKNTYATYNYLPTDAVLRRAANLFTDAKSISQLNFSSLSPVKVLYIGGKLTIENFLPYNLSNVKLSFTDAQGNVIDLGVIETIPKHSKIVLPGEAFDSLKEAFDKIGPYTFFLPKFEATSTSVSDANTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGINGRVDSKVDQQYVLNKQGIVNNFRKKIEIDAVVLKNSGVVGLANGYGNDGEYGTLGVEASALEPQKLFGNNLKTINLEDLRTILHEFSHTKGYTHNGNMTYQRVPTGQNENGKPKDSDGLPYNVCSLYEGSNQSAFPSNYPNSIYHNCADVPAGFLGVTAAVWQQLINQNALPINYANLSAQTNYNLNASLNTQDLANSMLSTIQKTFVTSSVTNHYSSSASQSFRSPILGVNAKIGYQNYFNDFIGLAYYGIIKYNYSKALNQKFQQLSYGGGIDLLLDFITTYSNKNSPIGVQTRKNFSSSFGIFGGLRGLYNSYYVLNKVKGSGNLDVATGLNYRYKHSKYSVGISIPLIQRKAKVVSSGSDYTNSFVFNEGASHFKVFFNYGWVF

SEQ ID NO: 12909 - protein, 674 aa, Helicobacter pylori
MRKLFIPLLLFSALEANEKNGFFIEAGFETGLLEGTQTQEKRHTTTKNTYATYSYLPTDTILKRAANLFTDAKSISQLNFSSLSPVKVLYIGGKLTIENFLPYNLSNVKLSFTDAQGNAIDLGVIETIPKHSKIVLPGEAFDSLKEAFDKIGPYTFFLPKFEATSTSISDTNTQRVFETLNNIKTNLIMKYSNENPSNFNTCPYNNNGNTKNDCWQNFTPQTAEEFTNLMLNMIAVLDSQSWGDAILNAPFEFTNKGGEGECDTSKENDCVNPGTNGLVNSQNKSYVLNKQDIVNKFRNKADLDVIVLKDSGVVGLGSDITPSNNDDGKHYGQLGVVASALDPKKLFGNNLKTINLEDLRTILHEFSHTKGYTHNGNMTYQRVPVMKDGQVEKDNNGKPKDSDGLPYNVCSLYGGSNQPAFPSNYPNSIYHNCADVPAGFLGVTAAVWQQLINQNALPIDYANLNAQTNYNLNASLNTQDLANSMLSTIQKTFVTSSVTNHYFSSASQSFRSPILGVNAKIGYQNYFNDFIGLAYYGIVKYNYSKALNQKVQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12910 - protein, 664 aa, Helicobacter pylori
MRKLFIPLLLFSALEANEKNGFFIEAGFETGLLEGAQTQEKRHTTTKNTYATYNYLPTDTVLKRAANLFTDAKSISQLNFSSLSPVKVLYIGGKLTIENFLPYNLSNVKLSFTDAQGNTIDLGVIETIPKHSKIVLPGEAFDKIGPYTFFFPKFEATSTSISDTNTQRVFETLNKIKTNLIMKYSNENPSNFNTCPYNNNGNTKNDCWQPFTPQTAEEFTNLMLNMIAVLDSQSWGDAILNAPFEFTNSPTDCDSDPSKCVNPGTNGLVNSQNKSYVLNKQDIVNKFRNKADLDVVVLKDSGVVGLGSDITPSNNDDGKHYGQLGVVASALDPKKLFGNDLKTINLADLRTILHEFSHTKGYTHNGNMTYQRVPVMKDGQVEKDNNGKPKDSDGLPYNVCSLYGGQGQSAFPSNYPNSIYHNCADVPAGFLGVTAAVWQQLINQNALPIDYANLNAQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSNGGDYTNSFAFNEGASHFKVFFNYGWVF

SEQ ID NO: 12911 - protein, 652 aa, Helicobacter pylori
MRKLFIPLLLFSALEANEKNGFFIEAGFETGLLEGAQTQEKRHTTTKNTYATYNYLPTDTILKRAANLFTNAEAISKLKFSSLSPVRASASMLNGSLTIENFLPYNLSNVKLSFTDAQGNTIDLGVIETIPKHSKIVLPEKLFDGLKQIGPYIFQQIEVSSTQVSDTNTQRVFETLNKIKTNLVVNYRNENKFEGHQNHWEAFTPQTAEEFTNLMLNMIAVLDSQSWGDAILNAPFEFTNKGGGGECDTSKENECVNPGTNGLVNSKVDQQYVLNKQDIVNKFRNKADLDVVILKDSGVVGLGSDITPSNNDDGKHYGQLGVVASALEPQKLFGNDLKTINLADLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLGTIQKTFVTSSVTNHYFSSASQSFRSPILGVNAKIGYQNYFNDFMGLAYYGIIKYNYSKALNQKFQQLSYGGGIDLLLDFITTYSNKNGPIGVQRNFSSSFGIFGGLRGLYNSYYVLNKVKGSGNLDVATGLNYRYKHSKYSVGISIPLIQRKASVVSSGSDYTNSFVFNEGASHFKVFFNYGWIF

SEQ ID NO: 12912 - protein, 661 aa, Helicobacter pylori
MRKLFIPLLLFSALEANEKNGFFIEAGFETGLLEGVQTQEKRHTTTKNTYATYNYLPTDTILKRAANLFTDAKSISQLTFSSLSPVKVLYIGGKLTIENFLPYNLSNVKLSFTDAQGNTIDLGVIETIPKHSKIVLPGEAFDSLKEAFDKIGPYTFFLPKFEATSTSISDANTQRVFETLNNIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDSKVDQQYILNKQGIINNFRKKIEIDAVVLKNSGVVGLANGYGNDGEYGTLGVEAYALEPQKLFSDNLKTINLADLRTILHEFSHTKGYTHNGNMTYQRVPTGQNENGKPKDSDGLPYNVCSLYGGSNQPAFPSNYPNSIYHNCADVPAGFLGVTAAVWQQLINQNALPINYANLSSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPTGIQTKRNFSSSFGIFGGLRGLYNSYYVLNKVKGSGNLDVATGLNYRYKHSKYSVGISIPLIQRKASVVSSSSDYTNSFVFNEGASHFKVFFNYGWVF

SEQ ID NO: 12913 - protein, 663 aa, Helicobacter pylori
MRKLFIPLLLFSALEANEKNGFFIEAGFETGLLEGTQTQEKRHTTTKNTYATYNYLPTDTILKRAANLFTDAKSISQLTFSSLSPVKVLYMYNGKLTIENFLPYNLSNVKLSFKDAQGNTIDLGVIETIPKHSKIVLPGEAFDSLKEAFDKIGPYTFFLPKFEATSTSISDANTQRVFETLNKIKTNLIMKYSNENPSNFNTCPYNNNGNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYTHNGNMTYQRVPTGHNGSDNKPSDSDGLPYNVCSLYGGQGQSAFPSNYPNSIYHNCADVPAGFLGVTAAVWQQLINQNALPINYANLGSQTNYNLNASLNTQDLANSMLSTIQKTFVTSSVTNHYFSSTSQSFRSPILGVNAKIGYQNYFNDFIGLAYYGIVKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12914 - protein, 653 aa, Helicobacter pylori
MKKLFIPLLLFSALEANEKNGFFIEAGFETGLLEGTQTQEKRHTTTKNTYATYNYLPTDTILKRAANLFTNAEAISKLKFSSLSPIRVLYMYNGQLTIENFLPYNLSNVKLSFTDAQGNVIDLGVIETIPKHSKIVLPGEAFDSLKIDPYTLFLPKIEATSTSISDANTQRVFETLNKIKTNLVVNYRNENKFKDHENHWEAFTPQTAEEFTNLMLNMIAVLDSQSWGDAILNAPFEFTNKGGGGECDTSKENDCVNPGTNGLVNSQNQQYVLNKQDIVNKFRNKADLDVIVLKDSGVVGLGSDITPSNNDDGKHYGQLGVVASALDPKKLFGNDLKTINLADLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPVGVQTRKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12915 - protein, 657 aa, Helicobacter pylori
MKKLFIPLLLFSALEANEKNGFFIEAGFETGLLEGTQTQEKRHTTTKNTYATYNYLPTDTILKRAASLFTNAEAISKLKFSSLSPIRVLYMYNGQLTIENFLPYNLSNVKLSFTDAQGNVIDLGVIETIPKHSKIVLPGEAFDSLKIDPYTLFLPKIEATSTSVSDANTQRVFETLNKIKTDLVVNYRNENKFKDHENHWEAFTPQTAEEFTNLMLNMIAVLDSQSWGDAILNAPFEFTNKGGGGECDTSKENECVNPGTNGLVNSQNKSYVLNKQDIVNKFKNKADLDVIVLKDSGVVGLGSDITPSNNDDGKHYGQLGVVASALDPKKLFGNDLKTINLADLRTILHEFSHTKGYTHNGDMTYQRVPVMKNGQVEKDNNGKPKDSDGLPYNVCSLYGGSNQPAFPSNYPNSIYHNCADVPAGFLGVTAAVWQQLINQNALPIDYANLSAQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPIGVQRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12916 - protein, 661 aa, Helicobacter pylori
MKKLFIPLLLFSALEANEKNGFFIEAGFETGLLEGAQTQEKRHTTTKNTYATYNYLPTDTILKRAANLFTDAKSISQLNFSSLSPVKVVYIGGKLTIENFLPYNLSNVKLSFTDAQGNAIDLGVIETIPKHSKIVLPGEAFDSLKEAFDKIDPYTFFLPKFEATSTSVSDANTQRVFETLNKIKTNLIMKYSNKNPNNFNTCPYNNNGNTKNDCWQNFTPQTAEEFTNLMLNMIAVLDSQSWGDAILNAPFEFTNSPTDCDRDPSKCVNPGVNGRVDTKVDQQYILNKQGIINNFRKKIEIDAVVLKNSGVVGLANGYGNDGEYGTLGVEAYALEPQKLFGNNLKTIKLEDLRTILHEFSHTKGYTHNGNMTYQRVPTGQTENGKPKDSDGLPYNVCSLYGGSNQPAFPSNYPNSIYHNCADVPAGFLGVTAAVWQQLINQNALPINYANLGSQTNYNLNASLNTQDLANSMLNTIQKTFVTSSVTNHYFSSTSQSFRSPILGVNAKIGYQNYFNDFIGLAYYGIIKYNYSKALNQKFQQLSYGGGIDLLLDFIPTYSNKNSPIGVQTRKNFSSSFGIFGGLRGLYNSYYVLNKVKGSGNLDVATGLNYRYKHSKYSVGISIPLIQRKASVVSNGGDYTNSFVFNEGASHFKVFFNYGWVF

SEQ ID NO: 12917 - protein, 662 aa, Helicobacter pylori
MKKLFIPLLLFSALEANEKNGFFIEAGFETGLLEGTQTQEKRHTTTKNTYATYNYLPTDTILKRAANLFTNAEAISKLKFSSLSPIRVLYMYNGQLTIENFLPYNLSNVKLSFTDAQGNVIDLGVIETIPKHSKIVLPGEAFDSLKEAFDKIGPYTFFLPKFEATSTSVSDANTQRVFETLNNIKTNLIMKYSNKNPNNFNTCPYNNNGNTKNDCWQNFTPQTAEEFTNLMLNMIAVLDSQSWGDAILNAPFEFTNSSTDCDNDPSKCVNPGTNGRVDSKVDQQYILNKQGIINNFRKKIEIDAVVLKNSGVVGLANGYGNDGEYGTLGVEAYALEPQKLFSDNLKTINLADLRTILHEFSHTKGYTHNGNMTYQRVPTGQTENGKPKDSDGLPYNVCSLYGGSGQSTFPSNYPNSIYHNCADVPAGFLGVTAAVWQQLINQNALPIDYANLSAQTNYNLNASLNTQDLANSMLGTIQKTFVTSSVTNHYSSSASQSFRSPILGVNAKIGYQNYFNDFIGLAYYGIIKYNYAKAINQKVQQLSYGGGIDLLLDFITTYSNKNSPTGIQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12918 - protein, 654 aa, Helicobacter pylori
MRKLFIPLLLFSALEANEKNGFFIEAGFETGLLEGTQTQEKRHTTTKNTYATYSYLPTDAVLKRAANLFTNAEAISKLKFSSLSPVRVLYMYNGQLTIENFLPYNLNNVKLSFTDAQGNVIDLGVIETIPKHSKIVLPGEAFDSLKIDPHTLFLPKIEATSTSVSDANTQRVFETLNKIKTNLVVNYRNENKFEGHQNHWEAFTPQTAEEFTNLMLNMIAVLDSQSWGDAVLNAPFEFTNKGGGEECDTSKENECVNPGTNGLVNSKVDQKYVLNKQDIVNKFRNKADLDVVILKDSGVVGLGSDITPSNNDDGKHYGQLGVVASALDPKKLFGNDLKTINLEDLRTILHEFSHTKGYTHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLNTIQKTFVTSSVTNHYFSSASQSFRSPILGVNAKIGYQNYFNDFIGLAYYGIVKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12919 - protein, 651 aa, Helicobacter pylori
MRKLFIPLLLFSALEANEKNGFFIEAGFETGLLEGAQTQEKRHTTTKNTYATYNYLPTDTILKRAANLFTNAEAISKLKFSSLSPVRASASMLNSSLTIENFLPYNLNNVKLSLKDAQGNVIDLGVIETIPKHSKIVLPEKLFDGLRQIGPYIFQQIEVSSTQVSDANTQRVFETLNKIKTNLVVNYRNENKFEGHQNHWEAFTPQTAEEFTNLMLNMIAVLDSQSWGDAILNAPFEFTNSSADCDNDPSKCVNPGVNGRVDSKVDQKYVLNKQDIVNKFRNKADLDVIVLKDSGVVGLGSDITPSNNDDGKHYGQLGVVASALDPKKLFGNDLKTINLEDLRTILHEFSHTKGYTHNGNMTYQRVPTGQNENGKPKDSDGLPYNVCSLYGGSNQPAFPSNYPNSIYHNCADVPAGFLGVTAAVWQQLINQNALPINFANLGNQTNYNLNASLNTQDLANSMLSTIQKTFVTSSVTNHYSSSASQSFRSPILGVNAKIGYQNYFNDFIGLAYYGIIKYNYAKAINQKVQQLSYGGGIDLLVDFITTYSNKNNPTGIQTKRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12920 - protein, 659 aa, Helicobacter pylori
MRKLFIPLLLFSALEANEKNGFFIEAGFETGLLEGAQTQEKRHTTTKNTYATYNYLPTDTILKRAANLFTNAEAISKLKFSSLSPVRVLYMYNGQLTIENFLPYNLNNVKLSFKDAQGNVIDLGVIETIPKHSKIILPGEAFDSLKIDPYTLFLPKIEATSTSVSDANTQRVFETLNKIKTDLVVNYRNENKFKDHENHWEAFTPQTAEEFTNLMLNMIAVLDSQSWGDAILNAPFEFTNKGGGGECDTSKENECVNPGTNGLVNSQNKSYVLNKQDIVNKFRNKADLDVVVLKDSGVVGLGSDITPSNNDDGKHYGQLGVVASALEPQKLFGNDLKTINLEDLRTILHEFSHTKGYGHNGNMTYQRVPVMKDGQVEKDNNGKPKDSDGLPYNVCSLYGGSNQPAFPSNYPNSIYHNCTDVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPTGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWIF

SEQ ID NO: 12921 - protein, 657 aa, Helicobacter pylori
MKKLFIPLLLFSALEANEKNGFFIEAGFETGLLEGTQTQEKRHTTTKNTYATYNYLPTDTILKRAASLFTNAEAISKLKFSSLSPVRVLYMYNGQLTIENFLPYNLSNVKLSFTDAQGNVIDLGVIETIPKHSKMVLPGEAFDKIDPYTFFFPKIEATSTSISDTNTQRVFETLNKIKTNLVVNYRNENKFKDHENHWEAFTPQTAEEFTNLMLNMIAVLDSQSWGDAILNAPFEFTNKGGEGECDTNKENECVNPGVNGLVNSQNKSYVLNKQDIVNKFRNKADLDVIVLKDSGVVGLGSDITPSNNDDGKHYGQLGVVASALDPKKLFGNDLKTINLEDLRTILHEFSHTKGYTHNGNMTYQRVPVTKDGQVEKDNNGKPKDSDGLPYNVCSLYGGSNQPAFPSNYPNSIYHNCADVPAGFLGVTAAVWQQLINQNALPIDYANLSTQTNYNLNASLNTQDLANSMLGTIQKTFVTSSVTNHYSSSASQSFRSPILGVNAKIGYQNYFNDFIGLAYYGIIKYNYSKALNQKSQQLSYGGGIDLLVDFITTYSNKNSPTGVQTKRNFSSSFGIFGGLRGLYNSYYVLNKVKGSGNLDVATGLNYRYKHSKYSVGISIPLIQRKASVVSSSSDYTNSFVFNEGASHFKVFFNYGWVF

SEQ ID NO: 12922 - protein, 668 aa, Helicobacter pylori
MKKLFIPLLLFSVLEANEKNGFFIEAGFETGLLEGTQTQEKRHTTTKNTYATYNYLPTDSVLKRAANLFTDAKSISQLNFSSLSPVKVLYIGGQLTIENFLPYNLSNVKLSFTDAQGNAIDLGVIETIPKHSKIVLPGEAFDSLKEAFDKIGPYTFFLPKFEATSTSISDANTQRVFETLNNIKTNLIMKYSNENPSNFNTCPYNNNGNTKNDCWQNFTPQTAEEFTNLMLNMIAVLDSQSWGDAILNAPFEFTNKGGGGECDTGKENDCVNPGVDGVVNSQNKSYVLNKQDIVNKFRNKADLDVIVLKDSGVVGLGSDITPSNNDDGKHYGQLGVVASALDPKKLFGNDLKTINLEDLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNNPTGVQTKRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12923 - protein, 661 aa, Helicobacter pylori
MRKLFIPLLLFSALEANEKNGFFIEAGFETGLLEGAQTQEKRHTTTKNTYATYNYLPTDTILKRAANLFTNAEAISKLKFSSLSPVRVYMYNGQLTIENFLPYNLSNVKLSFTDAQGNVIDLGVIETIPKHSKIVLPGEAFDSLKEAFDKINPYTFFFPKFEATSTSISDANTQRVFETLNKIKTNLIMKYSNENPNNFNTCPYNNNGNTKNDCWQNFTPQTAEEFTNLMLNMIAVLDSQSWGDAILNAPFEFTNSSADCDNDPSKCVNPGVNGRVDSKVDQQYILNKQGIVNNFRKKIEIDAVVLKNSGVVGLANGYGNDGEYGTLGVEAYALEPPKLFGNDLKTINLADLRTILHEFSHTKGYTHNGNMTYQRVPTGQTENGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPTGIQTKRNFSSSFGIFGGLRGLYNSYYVLNKVKGSGNLDVATGLNYRYKHSKYSVGISVPLIQRKASVVSNGGDYTNSFVFNEGASHFKVFFNYGWVF

SEQ ID NO: 12924 - protein, 662 aa, Helicobacter pylori
MRKLFIPLLLFSALEANEKNGFFIEAGFETGLLEGAQTQEKRHTTTKNTYATYNYLPTDTILKRAASLFTNAEAISKLNFSSLSPVKVLYMYNGKLTIENFLPYNLSNVKLSFTDAQGNVIDLGVIETIPKHSKIVLPGEAFDSLKEAFDKIGPYTFFLPKFEATSTSISDANTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKDSGVVGLANGYGNDGEYGTLGVEAYALEPQKLFGNDLKTINLADLRTILHEFSHTKGYGHNGNMTYQRVPTGQTENGKPKDSDGLPYNVCSLYGGQGQSAFPSNYPNSIYHNCADVPAGFLGVTAAVWQQLINQNALPIDYANLSAQTNYNLNASLNTQDLANSMLGTIQKTFVTSSVTNHYSSSASQSFRSPILGVNAKIGYQNYFNDFIGLAYYGIVKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12925 - protein, 656 aa, Helicobacter pylori
MRKLFIPLLLFSALEANEKNGFFIEAGFETGLLEGTQTQEKRHTTTKNTYATYNYLPTDTVLKRAANLFTDAKSISQLNFSSLSPVRVVYMYNGQLTIENFLPYNLSNVKLSFKDAQGNVIDLGVIETIPKHSKIVLPGEAFDSLKEAFDKIGPYTFFLPKFEATSTSVSDTNTQRVFETLNKIKTNLVVNYRNENKFKDHENHWEAFTPQTAEEFTNLMLNMIAVLDSQSWGDAILNAPFEFTNSSTDCDNDPSKCVNPGVNGRVNSKVDQKYVLNKQDIVNKFRNKADLDVIVLKDSGVVGLGSDITPSNNDDGKHYGPLGVVASALDPKKLFGNDLKTIHLEDLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLSAQTNYNLNASLNTQDLANSMLSTIQKTFVTSSVTNHYSSSASQSFRSPILGVNAKIGYQNYFNDFIGLAYYGIVKYNYSKALNQKFQQLSYGGGIDLLLDFITTYSNKNNPTGIQTKKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 12926 - protein, 661 aa, Helicobacter pylori
MRKLFIPLLLFSALEANEKNGFFIEAGFETGLLEGTQTQKKRHTTTKNTYATYSYLPTDSVLKRATNLFTDAKSISQLNFSSLSPVKVLYIGGKLTIENFLPYNLSNVKLSFKDAQGNAIDLGVIETIPKHSKIVLPGEAFDSLKETFDKIDPYTFFLPKFEATSTSISDANTQRVFETLNNIKTNLIMKYSNENPSNFNTCPYNNNGNTKNDCWQNFTPQTAEEFTNLMLNMIAVLDSQSWGDAILNAPFEFTNSSTDCDSDPSKCVNPGINGRVDTKVDQQYILNKQGIINNFRKKIEIDAVVLKNSGVVGLANGYGNDGEYGTLGVEAYALEPQKLFGNNLKTINLADLRTILHEFSHTKGYTHNGNMTYQRVPTGQNNNGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISVPLIQRKASVVSSGSDYTNSFVFNEGASHFKVFFNYGWVF

SEQ ID NO: 12927 - protein, 652 aa, Helicobacter pylori
MRKLFIPLLLFSALEANEKNGFFIEAGFETGLLEGVQTQEKRHTTTKNTYATYNYLPTDAVLKRAANLFTNAEAISKLKFSSLSPVRVLYMLNGQLTIENFLPYNLNNVKLSFTDAQGNVIDLGVIETIPKHSKIVLPGEAFDSLKVDPYTLFLPKIEATSTSVSDANTQRVFETLNKIKTDLVVNYRNENKFKDHENHWEAFTPQTAEEFTNLMLNMIAVLDSQSWGDAILNAPFDFTNKGGEECDTNKENECVNPGTNGRVNSQNASYVLNKQDIVNKFRNKADLDVVVLKDSGVVGLGSDITPSNNDDGKHYGQLGVVASALDPKKLFGNNLKTINLEDLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSMLSTIQKTFVTSSVTNHYFSSASQNFRSPILGVNAKIGYQNYFNDFIGLAYYGIIKYNYAKAANQKVQQLSYGGGIDLLVDFITTYSNKNSPIDIQTRRNFSSSFGIFGGLRGLYNSYYALNKVKGSGNLDVATGLNYRYKHSKYSVGISIPLIQRKASIVSSDGDYTDSFVFNEGASHFKVFFNYGWVF

SEQ ID NO: 12928 - protein, 661 aa, Helicobacter pylori
MRKLFIPLLLFSALEANGKNGFFIEAGFETGLLEGAQTQEKRHTTTKNTYATYNYLPTDTILKRAANLFTDAKSISQLNFSSLSPVKVLYIGGQLTIENFLPYNLSNVKLSFTDAQGNVIDLGVIETIPKHSKIVLPGEAFDSLKEAFDKINPYTFFFPKFEATSTSISDANTQRVFETLNKIKTNLIMKYSNENPSNFNTCPYNNNGNTKNDCWQNFTPQTAEEFTNLMLNMIAVLDSQSWGDAILNAPFEFTNSPTDCDNDPSKCVNPGVNGRVDTKVDQQYILNKQGIINNFRKKIEIDAVVLKNSGVVGLANGYGNDGEYGTLGVEAYALEPQKLFSDNLKTIILADLRTILHEFSHTKGYGHNGNMTYQRVPTGQNENGKPKDSDGLPYNVCSLYGGQGQSAFPSNYPNSIYHNCADVPAGFLGVTAAVWQQLINQNALPIDYANLSAQTNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNNPTDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12929 - protein, 661 aa, Helicobacter pylori
MRKLFIPLLLFSALEANEKNGFFIEAGFETGLLEGTQTQEKRHTTTKNTYATYDYLPTDSVLKRAANLFTDAKSISQLTFSSLSPVKVLYIGGQLTIENFLPYNLSNVKLSFTDAQGNAIDLGVIETIPKHSKIVLPGEAFDSLKEAFDKIGPYTFFLPKFEATSTSISDTNTQRVFETLNKIKTNLIMKYSNGNPSNFNTCPYNNNGNTKNDCWQNFTPQTAEEFTNLMLNMITVLDSQSWGDAILNAPFEFTNSSTDCDNDPSKCVNPGVNGRVDSKVDQQYVLNKQGIANNFRKKIEIDAVVLKNSGVVGLANGYGNDGEYGTLGVEAYALEPQKLFSDNLKTIILADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLNTIQKTFVTSSVTNHYFSSASQSFRSPILGVNAKIGYQNYFNDFIGLAYYGIVKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12930 - protein, 661 aa, Helicobacter pylori
MRKLFIPLLLFSFLEANEKNGFFIEAGFETGLLEGTQTQEKRHTTTKNTYATYNYLPTDSVLKRAANLFTDAKSISQLTFSSLSPVKVLYIGGKLTIENFLPYNLSNVKLSFTDAQGNVIDLGVIETIPKHSKMVLPGEAFDSLKEAFDKISPYTFFFPKFETTSTSISDANTQRVFETLNKIKTNLIMKYSNENPNNFNTCPYNNNGNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALDPPKLFGNDLKTINLEDLRTILHEFSHTKGYGHNGNMTYQRVPTGQNENGKPKDSDGLPYNVCSLYGGSNQSAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKAVNQKFQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12931 - protein, 663 aa, Helicobacter pylori
MRKLFIPLLLFSALEANEKNGFFIEAGFETGLLEGTQTQEQRRTTTKNTYATYNYLPTDAVLKRAANLFTDAKSISQLNFSSLSPVKVLYIGDKLTIENFLPYNLNNVKLSFTDAQGNVIDLGVIETIPKHSKIVLPGEAFDSLKEAFDKIDPYTFFFPKFEATSTSVSDANTQRVFETLNKIKTNLIMKYSNENPSNFNTCPYNNNGNTKNDCWQPFTPQTAEEFTNLMLNMIAVLDSQSWGDAILNAPFDFTNKGGGECDTSKENECVNPGTNGRVDSKVDQQYVLNKQGIVNNFRKKIEIDAVVLKNSGVVGLANGYGNDGEYGTLGVEAYALEPTKLFGNNLKTINLADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINFANLDSQTNYNLNASLNTQDLANSMLSTIQKTFVTSSVTNHYFSSASQSFRSPILGVNAKIGYQNYFNDFIGLAYYGIIKYNYAKAANQKVQQLSYGGGIDLLLDFITTYSNKNSSTGIQTKRNLSSSFGIFGGLRGLYNSYYALNKVKGSGNLDVATGLNYRYKHSKYSVGISIPLIQRKASVVSNDGDYTNSFVFNEGASHFKVFFNYGWVF

SEQ ID NO: 12932 - protein, 650 aa, Helicobacter pylori
MRKLFIPLLLFSALEANEKNGFFIEAGFETGLLEGTQTQEKRHTTTKNTYATYNYLPTDSVLKRAANLFTNAEAISKLKFSSLSPVRVLYMYNGQLTIENFLPYNLSNVKLSFTDAQGNVIDLGVIETIPKHSKIVLPGEAFDSLKIDPYTLFLPKIEATSTSISDTNTQRVFETLNKIKTDLVVNYRNENKFKDHENHWEAFTPQTAEEFTNLMLNMIAVLDSQSWGDAILNAPFEFTNSSTDCDNDPSKCVNPGVNGLVNSQNKSYVLNKQDIVNKFRNKADLDVVVLKDSGVVGLGSDITPSNNDDGKHYGQLGVVASALDPKKLFGNNLKTINLADLRTILHEFSHTKGYGHNGNMTYQRVPTGQTENGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYSIVKYNYSKALNQKVQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12933 - protein, 669 aa, Helicobacter pylori
MRKLFIPLLLFSALEANEKNGFFIEAGFETGLLEGTQTQEKRHTTTKNTYATYDYLPTDSVLKRAANLFTNAEAISKLKFSSLSPVRVLYMYNGQLTIENFLPYNLNNVKLSFKDAQGNTIDLGVIETIPKHSKIVLPGEAFDSLKEAFDKIGPYTFFFPKFEATSTSISDTNTQRVFETLNNIKTNLIMKYSNENPSNFNTCPYNNNGNTKNDCWQNFTPQPAEEFTNLMLNMIAVLDSQSWGDAILNAPFEFTNKGGEGECDTNKENDCVNPGTNGLVNSQNKSYVLNKQDIVNKFRNKADLDVIVLKDSGVVGLGSDITPSNNDDGKHYGQLGVVASALEPQKLFGNDLKTINLADLRTILHEFSHTKGYGHNGNMTYQRVPTGQSENGKPKDSDGLPYNVCSLYGGSNQPAFPSNYPNSIYHNCAGVPAGFLGVTAAVWQQLINQNALPIDYANLSAQTNYNLNAGLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISIPLIQRKAKVVSSGGDYTNSFVFNEGASHFKVFFNYGWVF

SEQ ID NO: 12934 - protein, 661 aa, Helicobacter pylori
MRKLFIPLLLFSALEANEKNGFFIEAGFETGLLEGTQTQEKRHTTTKNTYATYNYLPTDSVLKRVANLFTDAKSISQLTFSSLSPIKVLYIGGKLTIENFLPYNLNNVKLSFTDAQGNVIDLGVIETIPKHSKMVLPGEAFDSLKEAFDKIGPYTFFFPKFEATSTSISDTNTQRVFETLNKIKTNLIMKYSNENPNNFNTCPYNNNGNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYTHNGNMTYQRVPTGQTENGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKVQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 12935 - protein, 562 aa, Helicobacter pylori
MKKLFSLFSTRCEDTFMQKFWVNTLLFSPAIVGLFMVATPVMSSEVPVTEAPTINQPSSFSSAETIGQVTSVSQLSDVKPTDWAFQALQSLVERYGCIAGYPNETYRGNRALTRYEFAAGLNACLDQINQLIATSTSELVNKEDLATLQKLQEEYVSELQTIRGQVDALEARTVTLESQQFSTTTKLRGEAIFALASVFGSDRAINTDAQNRGASRPNLEENVIFGDRVRLNFDTSFTGKDRLRVRLQGRNITSFNTSVTGTNQTRLGFDGNESNNVSVSALFYRFPIGESTIFNIATEGLEYIDEVPALSSNFDSSGSGAVSRFGRYNPIYRAAEGPGIIISHKFNDALTLTAGYVVPSGVGNDPSNGRGIFNGSYSALGQLTFQPTTTLGLAFTYVNAYYTEGSGVTGSTGTGFANNPFNGARTSVNNYSLSANYKLSPKFTITAWGGYTNAQAENTAVARSNADIWNWAVQLGFPDLGREGNFGGIVFGAPPYVANNQFVSGNNRRQDNDTSYHLEAFYRYKLNDNIAITPGLITIFSPEGNSENPNIYVGVVRTTFSF

SEQ ID NO: 12936 - protein, 663 aa, Helicobacter pylori
MRKLFIPLLLFSALEANEKNGFFIEAGFETGLLEGTQTQEKRHTTTKNTYATYNYLPTDSVLKRAANLFTDAKSISQLNFSSLSPIKVLYIGGKLTIENFLPYNLSNVKLSFTDAQGNTIDLGVIETIPKHSKIVLPGEAFDSLKEAFDKIGPYTFFLPKIEATSTSISDTNTQRVFETLNKIKTDLVVNYRNENKFKDHENHWEAFTPQTAEEFTNLMLNMIAVLDSQSWGDAILNAPFEFTNKGGGGECDTSKENDCVNPGTNGVVNSQNKSYVLNKQDIVNKFRNKADLDVVVLKDSGVVGLGSDITPSNNDDGKHYGQLGVVASALEPQKLFGNNLKTINLADLRTILHEFSHTKGYTHNGNMTYQRVPVMKDGQVEKDNNGKPKDSDGLPYNVCSLYGGSNQPAFPSNYPNSIYHNCADVPAGFLGVTAAVWQQLINQNALPIDYANLNAQTNYNLNASLNTQDLAISMLSTIQKTFVTSSVTNHYFSSASQSFRSPILGVNAKIGYQNYFNDFIGLAYYGIVKYNYSKALNQKVQQLSYGGGIDLLLDFITTYSNKNSPIGVQTKRNFSSSFGIFGGLRGLYNSYYVLNKVKGSGNLDVATGLNYRYKHSKYSVGISIPLIQRKAKVVSSGGDYTNSFVFNEGASHFKVFFNYGWLF

SEQ ID NO: 12937 - protein, 663 aa, Helicobacter pylori
MKKLFTSLLLFSALEANEKNGFFIEAGFETGLLEGTQTQEKRHTTTKNTYATYNYLPTDSVLKRAANLFTNAEAISKLKFSSLSPVRVLYMYNGQLTIENFLPYNLSNVKLSFKDAQGNTIDLGVIETIPKHSKIVLPGEAFDSLKEAFDKIDPYTFFFPKFEATSTSISDTNTQRVFETLNKIKTDLVVNYRNENKFKDHENHWEAFTPQTAEEFTNLMLNMIAVLDSQSWGDAILNAPFEFTNKGGGGECDTSKENECVNPGTNGLVNSQNKSYVLNKQDIVNKFRNKADLDVVILKDSGVVGLGSDITPSNNDDGKHYGQLGVEAYALEPQKLFGNNLKTINLEDLRTILHEFSHTKGYTHNGNMTYQRVPVMKNGQVERDNNGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISIPLIQRKAKVVSSGSDYTNSFVFNEGASHFKVFFNYGWVF

SEQ ID NO: 12938 - protein, 667 aa, Helicobacter pylori
MRKLFIPLLLFSALEANEKNGFFIEAGFETGLLEGTQTQEKRHTTTKNTYATYNYLPTDSVLKRAANLFTDAKSISQLNFSSLSPVKVLYIGGKLTIENFLPYNLSNVKLSFKDAQGNTIDLGVIETIPKHSKIVLPEEAFDSLKEAFDKIDPYTLFLPKIEATSTSISDTNTQRVFETLNNIKTNLIMKYSNKNPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNNLKTINLEDLRTILHEFSHTKGYTHNGNMTYQRVPVMKNGQVERDNNGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKVQQLSYGGGIDLLLDFITTYSNKNSPIGIQTKRNFSSSFGIFGGLRGLYNSYYVLNKVKGSGNLDVATGLNYRYKHSKYSVGISIPLIQRKAKVVSSGSDYTNSFVFNEGASHFKVFFNYGWVF

SEQ ID NO: 12939 - protein, 222 aa, Xanthomonas campestris
YDVNAPYVSLTFDSGKLSIDGSLRYDMGDARGNYSGTAIAQNLDVNGDGVIQPVEQRVATVDTANARPVDYDWNYLSYSLGGNYLINDDLGAFARVSRGARANADRLLFGVIRDDGSVTSDEAVNVVRQTEAGLKWRRDGLSLFATAFAARTQEQNFEVTSQRFFNRSYKAHGIELEASYRYEGFTVNGGVTWTDAEIARDQITPENTGNVPRRQADFVWQL

SEQ ID NO: 12940 - protein, 232 aa, Xanthomonas axonopodis
YDVNAPYVALTFDSGKFSIDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYEGFTLNGGLTWTDAEIARDQITPENAGNVPRRQADVVWQLTPSYRGDNYQ

SEQ ID NO: 12941 - protein, 232 aa, Xanthomonas campestris
YDVNAPYVALTFDSGKFSIDGSLRYDMGDARGNYSGTAIAQNLDVNGDGVIQPVEQRVATVDTANARPVDYDWNYLSYSLGSNYLISDDLGAFARISRGARANADRLLFGVVRDDGSVSSDEGVNVVRQAEAGLKWRRDGLSLFATAFSARTQEQNFEVTSQRFFNRSYKAHGVELEASYRYEGFTVNGGLTWTDAEISRDQITPENTGNVPRRQADVIWQLTPSYRGDRYQ

SEQ ID NO: 12942 - protein, 232 aa, Xanthomonas axonopodis
YDVNAPYVALTFDSGKFSIDGSLRYDMGDARGSYNGTAIVQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRHEGFTLNGGLTWTDAEISRDQITPENAGNVPRRQADVVWQLTPSYRGDGYQ

SEQ ID NO: 12943 - protein, 232 aa, Xanthomonas vesicatoria
YDVNAPYVALTFDSGKFSIDGSLRYDMGDARGSYSGTAIAQNLDVNGDGVIQPVEQRVATVDTANARPVDYDWNYLSYSLGGNYLINDDLGAFARISRGARANADRLLFGVVRDDGSVSSDEGVNVVRQAEAGLKWRRDGLSLFATAFSARTQEQNFEVTSQRFFNRSYEAHGVELEASYRYEGFTVNGGLTWTDAEISRDQITPENTGNVPRRQADVVWQLTPSYRGDGYQ

SEQ ID NO: 12944 - protein, 232 aa, Xanthomonas perforans
YDVNAPYVALTFDSGKFSIDGSLRYDMGDARGTYSGTAIAQNLDVNGDGVIQPVEQRVATVDTANARPVDYDWNYLSYSLGSNYLINDDLGAFARISRGARANADRLLFGVIRDDGSVSSDEGVNVVRQAEAGLKWRRDGLSLFATAFSARTQEQNFEVTSQRFFNRSYQAHGVELEASYRYEGFTVNGGVTWTDAEISSDQITPGNTGNVPRRQADFVWQLTPSYRGDGYQ

SEQ ID NO: 12945 - protein, 232 aa, Xanthomonas axonopodis
YDVNAPYVALTFDSGKFSIDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYEGFTLNGGLTWTDAEISRDQITPENAGNVPRRQADVVWQLTPSYRGDNYQ

SEQ ID NO: 12946 - protein, 232 aa, Xanthomonas cassavae
YDVNAPYVALTFDSGKFSIDGSLRYDMGDARGSYAGTAIAQNLDVNGDGVIQPVEQRVATVDTANARPVDYDWNYLSYSLGSNYLINEDLGAFARISRGARANADRLLFGVVRDDGSVSSDEGVNVVRQAEAGLKWRRDGLSLFATAFSARTEEQNFEVTSQRFFNRSYEAHGVELEASYRYEGFTVNGGLTWTDAEISKDQITPENTGNVPRRQADVVWQLTPSYRGDGYQ

SEQ ID NO: 12947 - protein, 232 aa, Xanthomonas axonopodis
YDVNAPYVALTFDSGKFSIDGSLRYDMGDARGSYSGTAIAQNLDVNGDGVIQPVEQRVATVDTANARPVDYDWNYLSYSLGTNYLINDDLGAFARISRGARANADRLLFGVVRDDGSVSSDEGVNVVRQAEAGLKWRRDGLSLFATAFSARTQEQNFEVTSQRFFNRSYEAHGVELEASYRYEGFTVNGGLTWTDAEISRDQITPENTGNVPRRQADVVWQLTPSYRGDGYQ

SEQ ID NO: 12948 - protein, 232 aa, Xanthomonas axonopodis
YDVNAPYVALTFDSGKFSIDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRHEGFTLNGGLTWTDAEISRDQITPENAGNVPRRQADVVWQLTPSYRGDSYQ

SEQ ID NO: 12949 - protein, 232 aa, Xanthomonas axonopodis
YDVNAPYVALTFDSGKFSIDGSLRYDMGDARGSYNGTAIAQNLDVNGDGVIQPVEQRVATVDTANSRPVDYDWNHLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYEGFTLNGGLTWTDAEISRDQITPENAGNVPRRQADVVWQLTPSYRGDNYQ

SEQ ID NO: 12950 - protein, 195 aa, Xanthomonas oryzae
VLVSISDEETSYYVRLQYNGEFLPLYTKVDGITGAKKDSKETKDLYAASFKAVGGAFGYKMDDIRVDIELLYSQLGKDKDVTGANPEIASDLMAASALANVYYDIAIEDMPITPYVGVGVGVAGVSTPLNTVVSEQKYKFGVAGQVKAGVSYDVTPEIKLFAGARYFGSWGANFDKDATTGKDKGDLKVLQYLWR

SEQ ID NO: 12951 - protein, 232 aa, Xanthomonas vasicola
YDVNAPYVALTFDSGKFSVDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYQGFTLNGGLTWTDAEISRDQITPENTGNVPRRQADVVWQLTPSYRGDSYQ

SEQ ID NO: 12952 - protein, 232 aa, Xanthomonas hortorum
YDVNAPYVALTFDSGKLSIDGSLRYDMGDARGSYSGTAIAQNLDVNGDGVIQPVEQRVATVDTANARPVDYDWNYLSYSLGSNYLINDDLGAFARISRGARANADRLLLGVIRDDGSVSSDEGVNVVRQTEAGLKWRRDGLSLFATAFSARTQEQNFEVTSQRFFNRSYKAHGVELEASYRYEGFTLNGGLTWTDAEISRDQITPENTGNVPRRQADVVWQLTPSYRGDGYQ

SEQ ID NO: 12953 - protein, 222 aa, Xanthomonas campestris
YDVNAPYVALTFDSGKLSIDGSLRYDMGDARGNYSGTAIAQNLDVNGDGVIQPVEQRVATVDTANARPVDYDWNYLSYSLGGNYLINDDLGAFARVSRGARANADRLLFGVIRDDGSVTSDEAVNVVRQTEAGLKWRRDGLSLFATAFAARTQEQNFEVTSQRFFNRSYKAHGIELEASYRYEGFTVNGGVTWTDAEIARDQITPENTGNVPRRQADFVWQL

SEQ ID NO: 12954 - protein, 232 aa, Xanthomonas fragariae
YDVNAPYVALTFDSGKFSIDGSLRYDMGDARGSYSGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYEGFTLNGGLTWTDAEISRDQITPENAGNVPRRQADVVWQLTPSYRGDNYQ

SEQ ID NO: 12955 - protein, 232 aa, Xanthomonas cucurbitae
YDVNAPYVALTFDSGKFSIDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYEGFTLNGGLTWTDAEISRDQITPENAGNVPRRQADVVWQLTPSYRGDSYQ

SEQ ID NO: 12956 - protein, 232 aa, Xanthomonas sp.
YDVNAPYVALTFDSDRFSIDGSLRYDMGDARGSYNGTAIAQNLDVNGDGVIQPVEQRVATVDTANARPVDYDWNYLSYSLGGNYLITDDLGAFARISRGARANADRLLFGVVRDDGSVSSDEGVNVVRQAEAGLKWRRDGLSLFATAFSARTQEQNFEVTSQRFFNRSYEAHGVELEASYRYGGFNLNGGLTWTDAEISRDQITPANTGNVPRRQADVVWQLTPSYRGDGYQ

SEQ ID NO: 12957 - protein, 232 aa, Xanthomonas axonopodis
YDVNAPYVALTFDSGKFSVDGSLRYDMGDARGSYNGTAIAQNLDVNGDGVIQPVEQRVATVDTANSRPVNYDWNYLSYSLGGNYLLTDDLGAFARISRGARANADRLLFGVVRDDGSVSANEGVNVVRQAEAGLKWRRDGLSLFATAFSARTQEQNFEITSQRFFNRSYEAHGVELEASYRYQGFTVNGGLTWTDAEISRDQITPENTGNVPRRQADVVWQLTPSYRGDHYQ

SEQ ID NO: 12958 - protein, 232 aa, Xanthomonas oryzae
YDVNAPYVSLTFDSGKLSIDGSLRYDMGDARGNYSGTAIAQNLDVNGDGVIQPVEQRVATVDTANARPVDYDWNYLSYSLGGNYLINDDLGAFARVSRGARANADRLLFGVIRDDGSVTSDEAVNVVRQTEAGLKWRRDGLSLFATAFAARTQEQNFEVTSQRFFNRSYKAHGIELEASYRYEGFTVNGGVTWTDAEIARDQITPENTGNVPRRQADFVWQLTPSYRGDGYQ

SEQ ID NO: 12959 - protein, 222 aa, Xanthomonas hortorum
YDVNAPYVALTFDSGKLSIDGSLRYDMGDARGNYSGTAIAQNLDVNGDGVIQPVEQRVATVDTANARPVDYDWNYLSYSLGGNYLINDDLGAFARVSRGARANADRLLFGVIRDDGSVTSDEAVNVVRQTEAGLKWRRDGLSLFATAFAARTQEQNFEVTSQRFFNRSYKAHGIELEASYRYEGFTVNGGVTWTDAEIARDQITPKNTGNVPRRQADFVWQL

SEQ ID NO: 12960 - protein, 106 aa, Xanthomonas perforans
APSDNTWYTGGKLSYPVMDDLDVYTRLGGMVWRTFNQETPAPVVEPAPIGLRSDVLFNYNKVVVIGYTNRIGSQDYNLPLSEKRAQSVVNYLVSKAALINCLAPNR

SEQ ID NO: 12961 - protein, 232 aa, Xanthomonas manihotis
YDVNAPYVALTFDSGKFSIDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRHEGFTLNGGLTWTDAEISRDQITPENAGNVPRRQADVVWQLTPSYRGDNYQ

SEQ ID NO: 12962 - protein, 232 aa, Xanthomonas oryzae
YDVNAPYVALTFDSGKFSVDGSLRYDMGDARGSYNGTAIAQNLDVNGDGVIQPVEQRVATVDTANSRPVNYDWNYLSYSLGGNYLITDDLGAFARISRGARANADRLLFGVVRDDGSVSAEEGVNVVRQAEAGLKWRRDGLSLFATAFSARTQEQNFEITSQRFFNRSYEAHGVELEASYRYEGFTVNGGLTWTDAEISRDQITPENSGNVPRRQADVVWQLTPSYRGDHYQ

SEQ ID NO: 12963 - protein, 232 aa, Xanthomonas populi
YDVNAPYVALTFDSGKFSIDGSLRYDMGDARGSYSGTAMAQNLDVNGDGVIQPVEQRVATVDTANARPVDYDWNYLSYSLGSNYLINDNLGAFARISRGARANADRLLFGVIRDDGSVSSDEGVNVVRQAEAGLKWRRDGLSLFATAFSARTEEQNYEITSQRFFNRSYQAHGIELEASYRYEGFTLNGGLTWTDAEISKDQITPENTGNVPRRQADVVWQLTPSYRGDGYQ

SEQ ID NO: 12964 - protein, 232 aa, Xanthomonas axonopodis
YDVNAPYVALTFDSGKFSIDGSLRYDMGDARGSYNGTAIAQNLDVNGDGVIQPVEQRVATVDTANARPVDYDWNYLSYSLGTNYLINDDLGAFARISRGARANADRLLFGVVRDDGSVSSDEGVNVVRQAEAGLKWRRDGLSLFATAFSARTQEQNFEVTSQRFFNRSYAAHGVELEASYRYEGFTVNGGLTWTDAEISRDQITPENTGHVPRRQADVVWQLTPSYRGDNYQ

SEQ ID NO: 12965 - protein, 232 aa, Xanthomonas axonopodis
YDVNAPYVALTFDSGKFSIDGSLRYDMGDARGSYNGTAIAQNLDVNGDGVIQPVEQRVATVDTVNARPVDYDWNYLSYSLGTNYLINDDLGAFARISRGARANADRLLFGVVRDDGSVSSDEGVNVVRQAEAGLKWRRDGLSLFATAFSARTQEQNFEVTSQRFFNRSYQAHGVELEASYRYEGFTVNGGLTWTDAEISRDQITPENTGNVPRRQADVVWQLTPSYRGDGYQ

SEQ ID NO: 12966 - protein, 174 aa, Xanthomonas melonis
YAAERITHNYPQATGANNTSTVSDYFRNIRAHSIHPRVSVGYDFGGWRIAADYASYRKWNNNKYSVNTKEVRRNGGNSENLKTENQENGTFHAVSSLGLSAIYDFKLNDKFDKFKPYIGVRVAYGHVKHQVHSVETETKIIFTTPTGGAKVGGTILDKSMSKPAYHESHSIGSL

SEQ ID NO: 12967 - protein, 148 aa, Xanthomonas arboricola
DVGLHQAWFFNFGSFQNTNSNEWAHRLKQPKTGISVGLARYGHDDILGYSISVLPNIELQLGASNFSIHLAFGAAYFNKTFDLDQNLQNEKIATHLNFSYRTMLFYNLSKEAKTNWRLGVGYFHQSNGHTRFPNQGLNSFSASISAEL

SEQ ID NO: 12968 - protein, 232 aa, Xanthomonas codiaei
YDVNAPYVALTFDSGKFSIDGSLRYDMGDARGSYNGTAIVQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRHEGFTLNGGLTWTDAEISRDQITPENAGNVPRRQADVVWQLTPSYRGENYQ

SEQ ID NO: 12969 - protein, 232 aa, Xanthomonas arboricola
YDVNAPYVALTFDSGKFSIDGSLRYDMGDARGSYAGTAIAQNLDVNGDGVIQPVEQRVATVDTANARPVDYDWNYLSYSLGSNYLINDDLGAFARISRGARANADRLLFGVVRDDGSVSSDEGVNVVRQAEAGLKWRRDGLSLFATAFSARTEEQNFEVTSQRFFNRSYEAHGVELEASYRYEGFTVNGGLTWTDAEISKDQITPENTGNVPRRQADVVWQLTPSYRGDGYQ

SEQ ID NO: 12970 - protein, 232 aa, Xanthomonas bromi
YDVNAPYVALTFDSGKFSIDGSLRYDMGDARGSYNGTAIAQNLDVNGDGVIQPVEQRVATVDTANARPVDYDWNYLSYSLGSNYLINDDLGAFARISRGARANADRLLFGVVRDDGSVSSDEGVNVVRQAEAGLKWRRDGLGLFATAFSARTEEQNFEVTSQRFFNRSYEAHGVELEASYRHEGFTVNGGLTWTDAEISRDQITPENTGNVPRRQADVVWQLTPSYRVDGYQ

SEQ ID NO: 12971 - protein, 232 aa, Xanthomonas sp.
YDVNAPYVALTFDSGKFSIDGSLRYDMGDARGNYSGTAIAQNLDVNGDGVIQPVEQRVATVDTANARPVDYDWNYLSYSLGSNYLISDDLGAFARISRGARANADRLLFGVVRDDGSVSSDEGVNVVRQAEAGLKWRRDGLSLFATAFSARTQEQNFEVTSQRFFNRSYKAHGVELEASYRYEGFTVNGGLTWTDAEISRDQITPENTGNVPRRQADVIWQLTPSYRGDGYQ

SEQ ID NO: 12972 - protein, 199 aa, Wolbachia endosymbiont
GPISDEETSYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKGDTAIKNVVYSTVGAEAGVAFNF

SEQ ID NO: 12973 - protein, 199 aa, Wolbachia endosymbiont
GPISDEETSYYVRLQYNGEILPFYTKVDGITNATGKEKDSPLTRSFIAGGGAFGYKMDDIRVDVEGLYSQLAKDTDVVNTSETNVADSLTAFSGLVNVYYDIAIEDMPITPYVGVGVGAAYISNPSKAGVVKDQKGFGFAYQAKAGVSYDVTPEIKLFAGARYFGSYGASFDKAAKDDAGIKNVVYSTVGAEAGVAFNF

SEQ ID NO: 12974 - protein, 263 aa, Vibrio alginolyticus
MRKSLLALSLLAATSAPVLAADYSDGDIHKNDYKWMQFNLMGAFNELPGFPDGSNHDYLEMEFGGRSGIFDLYGYVDVFNLASDPGSDKSGKEKIFMKFAPRMSLDAVTGKDLSFGPVQELYVSTLMEWGGASEVNSQKIGLGSDVMVPWLGKIGLNLYGTYDSNKKDWNGYQISTNWFKPFYFFENGSFISYQGYIDWQFGMKDEYSSSSYGGAMFNGIYWHSDRFAVGYGLKGYKNIYGIKEVNGVDSTGFGHYIAVTYKF

SEQ ID NO: 12975 - protein, 411 aa, Vibrio alginolyticus
MNKKHCSLLTISILFACNAHSAGFQVAEHSASGLGRAFSGEGAVADNASVLARNPAAMTLFKEAQFSGALSIIDPEVDVYDTVNNEHAKDVAPLQIVPAGYYISPINDNWAWGIGMFTTYGVATDYPNDISAGDMAGDTSLLSVNINPNVAYRINESFSVGGGINLVYAEAELTRHKGALAGILGGNKSDNLVGMEGETFAWGWNVGALFELNENNRFGFGYRSKVDLDFDDGEFSSYDSGRASSPKVDGRLKISLPSIIELSAFHQLNEQWAVHYGWQQTDWSTFKELKATSNECNDGVCFFKPEKYEDNNRYSIGATYILNTDWTFRAGFAYDEQAGEATLSIPDSDRFWYSAGLTYAMSENLTFDAGFALVKSKSGSFTETNALGEEIKFDSEGTAYISAVQMNYTFK

SEQ ID NO: 12976 - protein, 469 aa, Vibrio alginolyticus
MDKFFKVSALTAAMFGVVAVAPATASTESAAGGEYVEKVNEFMHDSSLNAMFLVDTRSRTRTTGKPGGENGDRWSRLNYSSYNAILDFTSGYHDGWVGADVAAYYSGDLYNDSLYNSNEGYLCNEISTCNNLDWGAGDGQQLKVYKAALKFKANENFNARVGMLQAGGNGTIGNVWSFVPGTYRGFELNAKLGDFNLSYFGADQFTAPWLLHEDDYAPALWSDTSWSYLHSLGLNGNLTDSLFFQVGLGQATGVKYANGIDWGAGQVTSYHNETDNTSYKAYLKYTVSDRTTLAFDFYGVDDDVKYDGLGFHTGLSLNQSFGKLAWMSELRYTDTDNRSDFVPRTIHTYGMNNGTWSQWWDALSDWNKAGELAWYNRLSYNQGNGWNYYLGFGYGSGADSAASGASGDWDYESEYAFNATVSYSLQSGALKGSTIRLHGTILERDEYAGAGDADETDLRLQVLIPYSFH

SEQ ID NO: 12977 - protein, 340 aa, Vibrio alginolyticus
MKKTLIALSVSAAAMATGVNAAELYNQDGTSLEMGGRAEARLSMKDGDAQDKSRIRLNFLGKQEINDNLYGVGFWEGEFETAQNGTVDGDDKSDLETRLAYAGLGGAYGEFAYGKTEGALGVITDFTDIMAYHGNSAADKLAVSDRTDNMMAYKGQFENLSVKASYRFADRMENKNTGEYYDNKQDGYSLSAIYALADTGLELGAGYADQDKANEYMLAASYTMSDLYFAGVFTDGEKMEDSNNSNTVDYTGYELAGAYTLGQTVFTTSYNNAETNNETSANNFAVDASYYFKPNFRGYISYNFNLIDAGDKFGSTDTSKTVATKIDAEDELALGLRYDF

SEQ ID NO: 12978 - protein, 140 aa, Pseudomonas aeruginosa
GLGGASGARYFGLHWRPWQRSLMETASGWTVLAYGGVQLARVSYQGDRLYKLSAGPGLWIGHRDLPLALGLGTAPTLISGRRLGSRALGGPFQFTSHLALRWQASPGFSLTYRLQHTSNAGLHSDNDGFDIQMLEAAYAY

SEQ ID NO: 12979 - protein, 662 aa, Pseudomonas aeruginosa
ALDTVTVKGDRQGSKIRTNIVTLQQKDESTATDMRKLLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGDKSSRINIDRQAPAYRETTQSNTNLAYTGKNLGFVEKLDANAYVLEKERYSADDSRTGYAGNVKGPNHTQITTRGMNFNFDSRLAEQTLLKYGINYRHQEIKPQAFLNSQFEIKDKDDATQTEKDKNRANEKIAKAYRLTNPAKTDAGVYVEAIHDIGDFTLTGGLRYDRFKVKTHDGKTVSSSSLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 12980 - protein, 342 aa, Photorhabdus asymbiotica
MKRSFIAMAAALACAGAAHAQSSVQLTGLVDAYAGSMRMAGDASGKGVVGSGGMTTSWWGMKGQEDLGGGLKVDFQLTVFMRVDTGSPGRFDGDPYFSRDANVGLSGGFGTVRLGRGMAPNFLPTILTNPFGDSFTISPLVLHANVGTTAWGSANLTTPSDTGWSNQVVYTTPKFGGLQANVHYQFGEKGGDSGKKNIGVNAMYFGGPLSLVAFYERAQISNPVSLAVMPTKTDWMLGGTYNFEVAKLYATYGQAKVKDLDRKNSTYSLGLDVPVTSAGTIKAALARTKAEIGAVDSTRTTASLGYDHYLSKRTDVYTVLMHDRITDLKSGTSLIAGIRHRF

SEQ ID NO: 12981 - protein, 316 aa, Photorhabdus asymbiotica
MYKLLNIADFYSNEELEKDMQYFSEKYGFDGFELIKFFDGDNSPLKKYIKGYHMRFFPSWMELYLEDFNSLYDELKDEKYFKSLCGGYSKKELIEYYKRELKIAKELEVEYMVFHACNVKVTEAMTYDFKYSDRKVLNAVISIINEIFEDGEYGFKLLFENLWWSGLRLTNKEEIEYLLNGVKYKNVGFILDTGHMINNNRDIKNSKEGIEYIKKNIKNIGEYKNLIYGIHLNYSLSGEYVNRAIKENKEKNLNIEEIMNNVYQHVGSIDYHDPFENEEIIDIISSLPIKYLVFELIGNTREELEDKIQRQWKIFN

SEQ ID NO: 12982 - protein, 268 aa, Photorhabdus asymbiotica
MPLFKDDTQFMNLAFNINPTLLLTFPYSPLAAGMIILPTKDPKGAVVTLLVANSVGDANTTGFSTLNKNRLSFVGGGRVRTNFFGLTGHQLAGISYSNKEFASLDQRLANIATNNIAKEKGSLAFYYNFDQYLYEPEKGSGKGFGIFGRFGVSDGNPNPLHYFFSLGVGGKGMMASRPHDQFGIGWYYIDVRNPSFTGPLATRQFLRNEQGVEAYYSVALTPWALLTPDIQVVHPAQKDTVDLSRPVPFVREGVNTATILGLRLQMVF

SEQ ID NO: 12983 - protein, 378 aa, Photorhabdus asymbiotica
MKKKWLIALTTLGTVAGVAQAQSSVTLYGVLDTNVEVATNMKAPSGGSGTRYALNGGGLSSSRWGLRGNEDLGGGLSGIFVLESGFSADDGKSLQGGRLFGRQAFVGLQNATFGKVTFGRQYTSMLDALAPFSPAALAVLYEPVIALFGAAYRQDNTVKYTGTFGPLMVGAHWSFGIGPTFSSPGGVNISGSGEVPGQIRRDSGFGGQTTYRAGSFGATLSYDQVNPSITRNGALLDIATSKKAAAAASYALGPIQIMGGYRWGKAVASGQTLVRDDLYWAGVSYEAARSLSLTLDYYYQAFHSSTTPALKPPGNPWQVAFIVDYNLSKRTDLYWTTVYAKNSGLCLDTASIGYANGYQPGGTRNNMLGAAVGLRHKF

SEQ ID NO: 12984 - protein, 159 aa, Wolbachia endosymbiont
TKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVIYDVTPEIKLYAGARYFGSYGANFGKTAKDDGGIKV

SEQ ID NO: 12985 - protein, 438 aa, Bacteroides dorei DSM 17855
MKKQFLIKLLPAAIIAASMATPAQAANWLMLQGTEADHQAPRAKVWGFIQAEYQQTDDTKLTAGPASGQSAAFNLVKPQNTSANSFNIRRARIGVRGANLPLDNKVNYFLLAEFGNNGITTGQNASKGQLTDASITLNHIPGARIRVGQFKTPGSEEGFQGIAVFNYINFTNMTDRLLLERHFDTSTTSTGRNGPVGAFRDQGIEVFDSFKHNGWDTSYAVMIGNGNGLGRIDNNDAKDTYLYLSTEMDIPGGKKGRKNGLKFYVWNQDGKRTIDGVEKNRTRSGLGTTFLNSKYRFAAEYVQADGMIFGGTKGAGAPGGEYNNGNPVTFNVFTDQKANGYYLDFGYRIIPNLELNVRYDALDSATETDAATGTGQDKYREFRTTTLGAQYFVNKKTVLRANYEIRDIKAPKAAAGAPVHDILKSVDNRIALQLSILY

SEQ ID NO: 12986 - protein, 1097 aa, Bacteroides dorei DSM 17855
MIKVMHRFHRSTSTCAAILVLCLLDKSHAQTIIGPSPPDRTTLVTVNAGNPTTIVGGTNVVPPSGNAIDVNSGGTLLFDSTAGTKPGVQINVTAQSGGIGLNTAAGGSVLSNGALSVNSAGGHAVLANGIGSSIVLNGSTNIGTSGTGGGLIGLGGGQIDATNVSINNTGASAGFGAVAESGSSIRLHGTTNISTSGTSSIVLGASGAGSLLDVTSAATITGGARSTGIYMFNGGQVGLRSGSAINMQGTGAVGMMVDNTSSTLVSDLTINLNGTGAGNGSTGIVVTRGGSISAQNLTIQGASAALGIMANAGTSVSLTGNNLIRISQAQNAGWYTATSPTLVTATGSINTGFSSTATSTRAGLATSGGTISSTGTTIEVSPTGGYGVWANGVAAGSALVTLNNNHISTTGNYSYGLKVTTNAAGANVSQITATNSQVQSSGGGGAMIIESYNGEASITLNNSIVRATGAGTSGLISSNNSAANINRFNMSGGELSSAAGDAIDAYGGLLVATIDNGARVSSPANLLYVANGAQVQLTAANNSVLTGDVRVSGVAVNLGTRIGDCFEESAGPLVGGPCAVYAAPAAGTPTADLTLLSGTTWTGASLGATNVSVNNASWNVTANSLVTQTLTNAGTVAFTPHAGTYRTLTTNNYIGQGGTLGLNTYLASDGSPSDLLIINSGTASGTSGLLINNTGPGAETTGNGIQVIKTQAGGTTAASAFHLGRAAVAGPYEYDLHRGAIDGSDPDGWYLRTRQNDCAMLGAPCPSPYIRPEVSVYTAIAPSALLYGSTLLDTLDERIGRTEGPPAQNGLSAGDAEKKDRNVWGRLLGMRGSRNGDVRGIYGYGPSYDYSFQGIQVGTDLYRKPREDGHRDQAGIYGAIGYSKTNVTHYDRTQAGDNRFTGYSIGGYWTHMSAEDAYVDLIGQLTRYDVKAGSQRGLPDMKTKGLGWAVSGEIGKPIRLQQDWIIEPQGQLVYQSLKLDDAIDAGATMQFSDMDSLQGRLGVRIAKDTKGKEEATGGGVRFSVWREFKGTPVTSISTASGYLPFRADMGGSWWEIKAGMTSKRNKRTYLYGNIGYQQTFDKAAYAWDAKIGMRMDW

SEQ ID NO: 12987 - protein, 1089 aa, Bacteroides dorei DSM 17855
MKQHAKRASWARVLLVPTLLLGSASMAAFPVHAAQVELNQIVTLQMRKVKLADVFKKLSNLSGYEFFYDESVVQKYNTIDIDLDNVSFDQALEQIRKQTSLQLSKVNNTIVVSLARQVLASSGKVQASRHRVTGRVTDANNEPLIGVSIVIQGNSGGTITDIDGRYTLEEVDADATLVFSYIGYVSQKIVVGNQQTLNVQMKEDNQTLEEVVVIGYGVQKKRDMTGSIASIKSKDITAIPTTNALESLQGKVAGLDLTNSSGQAGSTPNFTIRGERSLTASNAPLILVDGIDYGTSLDINPTDIESIEVLKDASSTAIYGTRGANGIIMITTKKGKEGKSKVSFNAFVSSTMITDYPDIMDAEEYAQYKREAYRDRTTGKYAEDAAVFAPEELTYLEKGYDTNYRDMLMHNGFNQNYEVSVSGGNTKTKHNISLGYRSEEGLFKDDNYKRYNARVALDHQLFDNVQVGTNIIYAYVDKNNRYSPLNMANKIVPISKPYDEEGNLVMYPSPGYNTQMNPLIDDQEGMRVDNTIQERFFGSLYLNWNITKDILFRTTLGLNSVNVRRGFFCDKNSLQGSGKDSQSYKEHTMTRNLTWENVLTYSKDFSDIHNLQAMVGTSTILNSKEYTYAGGKGQVYADNWFHNLYSNEKEITIKSSLVDQNLASFFGRVNYKLMDRYMLTASLRADGSSVFAPGKKWGYFPSVALAWRINEENFLKNVDAISNLKLRLSWGQSGQCAIDPYQTVGLLGNSTYSFNNEGAYGFYPKTMSNKELTWETTTQYNLGLDFGFFNNRISGSIDIYKAETRDILMNRVIPSINGYASVMENIGKTESTGVDLTLSTVNIQNKNFSWFSDFSLSHNREKIKELASGQLKDEANAWFVGEPFKVFYDYKKEGIWQLGEEAAAAANGQEPGDIKVQDVDGNGVITTDDRIIYSQRPDVTFGFNNTFNYKGFDLSVFLYARLGQWIAYDYNTTYRINALENGGNVDYWTPENPTNAFPCPNKSKSYTQVTYYSTLKYEDGSFFKIRDITLGYTFKPELLKHLNLSKLRVYATAKNFFTFSKIDNYDPEQGGSISFPMTKQLVFGLNVEF

SEQ ID NO: 12988 - protein, 401 aa, Bacteroides dorei DSM 17855
MNVKKYVGLGLVASIGFNGTAFGEGIEAAIEEGTVDGNIRAYYNTRDYDTKMDEAAFSLGGALRAETGKIGVFKMGLGYYTAQDLGTNSSDPAKVNKRLGSDIEVLGEAYISASAADTVLTIGRQRLSTPFANSGDAFVIPFSFEGGSIKNKGISNLTIELNHINTIKNRNSDEFIDVGKWSTGRYGVDVASTSGTTILGAVYSVDGIKLQGWVYDHADLFTSIYLQGNYSFPVSGTVKPFVAAQIVSQGETGDELLGEVDSTLWGVQGGAGFGKSKLTLAYTTVAEKSGTFKNGAFLAPYSFSTSPIFTNNMLATVENVDAGDAIKLTFNHSFAKVKLKLSYAEFDFDTAVDREAIDVDVIYNLGDVVKGLTARWRFESITADIDSVEQINNRFQLQLKF

SEQ ID NO: 12989 - protein, 917 aa, Bacteroides dorei DSM 17855
MSNLANGSFKLRLLCVVIAASGFSHQSIAQDTDIEEVVVTGVRASLEKSIDRKRNSNEFVEVVTSEDLGKFPDHNIAESLQRVTGVQISRGTNVSAGDNDGVGEGSEVSVRGTPPALNRATVNGQTISTTSVSGGSRSFNYNTISPELVESLEVFKTPSASQDEGSLGGTVNLKTRSPLDFKNRTAVVNIKQSFNNLRDDEGENYSLLYTDSSTDSQGRELGVLVSYNNSEEPFRRDSLESFGYRYVGFDASTGKISDAGSPAQLTAPVDGIAYGYMPKDLRQNIRLEERERSGLNVVFQYRPTDNLDIKLDYLTTDLTRFEHASNSAYRFTDAPGGVGNTLIESAVLDGDNFVAVTNSTSNKSFHQRYFVAAFDREYNYTTDAVNLSVDWTSEDWLVSARVGASEGEGKQDPALFATFGPKGSSVSYDTRGVEFSTLAATLAGGEAVSGPSDLVWQNLSRAVLQNTDEEEYAQLDFERTINDSWITSVKFGAKYRDRTKRQYKAVDSVNNRGSNTCGDDAHSCTLADYIGDSTFPVDDFSVTGGMPSSWFLPSASMILEDYSYDADGELGTPVIRAKQDGISNWDVSEEITAAYAMATFATDKLRGNFGLRYVSTDQDGNSNTYDGAALVPLNDQRSYSEVLPSLNVVYVLDDDLLLRGGYAKVMSRPSFQQLTLGYNVNQGAQTATRGNPDLDPFLADQFDLSLEWYFNKGGLLSTAAFYKDVSSYVSSTQFSEVVPGFELDDNGDAVQYLVTAPSNGEGATIQGLEFSYQQNFTQLPAPFDGVGTIFNYTMIDSSTGRDDPFGNELPLEGLSESSMNLVLFYEKEDFSGRISYTDRDDFLLFTSSLGGLPIYHKAYSQVDASMSYQVGDTGLTLTAEAINLTNEKPVTFAGDESRIISYREFGRRYALGLRYKF

SEQ ID NO: 12990 - protein, 1030 aa, Bacteroides dorei DSM 17855
MKNMKKNPKQNRESSLMRSPLILGLSIVLCIPVAYSHAKSSNIVKNESVQSILQGRTIKGQIIDENNEPLIGVSVIIKGASTIGTITDFDGNYALEVPAGKNVLEISYIGYKTQEITIGKNTQLNIKMQPDTQTLDEVVVIGYGTVKKRDLTGAVASVKSEDIVRMPTSNVLEAIQGQVAGLDITRSSGEAGSGVNMTLRGTRSINGDNSPLFIIDGMEGSYDELNPNDIASIEVLKDASSTAVYGAAGANGVIIITTKTPKKDKFSIDLDAYYGWNVISSFPEVNRGEDYINFRREAQRTVGAWNSPADDGNLFPSYMQKYIDNNQWVDWFDLASQTGITNSYNLSTSYSNDRVTSYFSLGYYNLEGLLKGDELERYSARTKIDFKANEMVKYGLNLYAMYSENDKRYSRIWNRILCMPPLGTPYDEDGNLVDYPLGDGNMNPLADMGEDQYVNNVKTLSVAPQIYVELTPLKGLSFKSLLGGYFRNMKESKYTGTKSYQGLESGLVQATIPNTFTYNYKWQNILTYNFKIKEDHDFTITGVTEWSKDQKEKATATANKFDTDSYLYHNLGAATGTPTVSSSYVGSQKMSYVARINYSYKGRYLLTLSSRWDGSSILADGNKWDMFPAGAIAWRISDEPFMQNVKAVSNLKLRASYGVTGNAGASEYATLDYSRTGIIGFQDVGVPYSGYSQSIANKSLGWEKSYMTDLGFDLGLFSDRLNVAFDWYRTDTKDILFEKNLPYATGGYGSSPFKIWSNVGETRNTGVELSITSRNFVGPEFQWSTTLAFSTNKEEVIKTTSEGPLQFGDYYLIPGEAIKTYYGYKYAGIWGTAEAEEAAKYSQKPGQVHIAENGTPDYKLNADDYYVLGSATPKWSGSLLNNFNYKNFDLSILLIARWDWTIPYGLTGWYRTDGLTPSPTVCDYWTPENQSARYPRPDASITNGQDPYQQWANYFDGSYLKVKTISLGYTFPKKWLNAVKIDRMRVYFTANNPFIFTKCDYLKNYDPEKGGNDDDAPLSKQYVFGVNISF

SEQ ID NO: 12991 - protein, 1782 aa, Bacteroides dorei DSM 17855
MGVASGNRVATGRRTMRVTTWRFMRLRRKAVPPVILRRNLTRRLLSSVGVAALLAGVSLALLPAPTRADTSWTGAADSDWNNAANWSNGLPVNTSGTTKIEGPVAATVDGVSVADSGRTNIGSAAQDGSLIVQGGGTLNAGVFELFGYNGFSGTATIRGAGSGISTSSSLFVGAYTGVGHIFIEDGGTLTTPYSTYMSQYNGSLGTVTVTGSGSTWNSNYEINLGGAEGNYDATGILTIADDGLVNINNGNRNLNVAKSTGSTGTLNIGAAEGDAAVAAGSLQAKSVVFGAGDGTLVFNHTETDYTFAPSISGNGGVHQLAGTTNLSGSNSWSGSTLVEGGILRAGAAGALSANAAYTVNGGTLDLNDFDLTATELSGTGGTVDLGTAELEVDQDGDSVFDGLIAGAGSLVKLGSGILSLTGANTYSGGTTLGEGTLRLEDDDAIGTGALTVTGGTLDYDDGIDLSNDIDLRAQATLNVTTGSATQSGNIGETGGSFGIVKSGAGILSLTGANTYTGTTTVSGGTLRAGSADALVSGAYILNGGTLDLNDFDLSASGLSGASGTVDLGSAELEVDQDSDGVFGGIISGAGSLLKLGSGMLTLTGGSTYTGLTTIREGTLALDGGSVESSDDVIIGDLAHTVGEVTVTGAGASLDTDSSVLVGELGEGTLNVENGGVVTADVVIAGHLSGSDGAIRVTGTGSQVNSTSLLRIGDEGVGRLIVSEGGAVTNTSTGYIGAGTNGEGAMTVTGTGSKLDNSGILYVGGEYNGAIGVLTVAGEAAVNVGAGSGTVRVAHHSGATGTLNIGAAEGDAAVAAGTLNAASLQFGAGTGQIVFNHLDDDHAFSSDVSGAGEVLHLSGTTILTGENTYTGGTTVSGGTLRAGRVGAFTSGGYEVNGGTLDLNDFDLSMSELSGIGGAVDLGSAALAVGSGNTDANFAGVISGIGSLEKTGLGSFTLAGANSYTGGTTVSGGTLRAGAASAFVDGSAYTVDGGTLDLNDFDLSMSELSGTGGTIDLGGATLTVGSGNTFTNFAGAIEGTGGLEKTGTGELTLTGANSYTGGTTISGGTLEGSTSSLVGDIVNNATLAFTQAFDGTFGGVISGTGSLVKSGSGVLTLTGANSWSGGTTIRHGTLEGSTSSLTGDIVNDAALVFAQAGDGTYAGAVSGTGSLEKTGAGTLTLTGANGYTGGTTVSGGTLAGNTSSLQGDIVNNASLLFDQSADGTYAGVLSGNGDIVKSGAGSLVLSGISGAFTGGLEVLSGSLVVDGTFGGGLLVSGGFLGGSGTVGSTTLGGGATLAAGNSIGTLTVAGDLAFSAGSVLAVEVNDGGDAAGVNADFVHVTGAATIASGAVVEVAPANGTDDGITYAPSTTYRILTADGGISGVFDGVTAGFAFLMPEVSYDATNVFLILTQMAAFEDVASTPNQQGVAAAAEALGAGNPLYDEIIGMSEEEAQAAFDALSGEAHASSTGVFSSSAGIVRRTIFSRLFSRFGAPRGFAAAEGYVPAAGDETPHGYTVWGELVRGWGETDGSVSAAGIERNSTGFLGGVDREIGEASRIGIALGYSHATFDVSGRASSGESDNFHVAGYAGTELGPMDLKGVLGYSYQMAESRRRVVVGGVIDDLSADYGAHTFQASGEASVDLAAGPVTLTPFAGLAVVHVETEAFTETGGPSALSIASSSNTTGISELGLRAAREAGSLTLFGSASWRHVFGDVEPLSRASFASSPATTFSVRGTPLSEDVASIGGGVELLIAEETTLEFSYRGEFASDSRDHGLKAKVSIRF

SEQ ID NO: 12992 - protein, 605 aa, Bacteroides dorei DSM 17855
MFIHRKSHRVRVGRRVHRAPASWRHCWRWRLAALAGSGAICAAPAWATGAGLDDLRQWLAPPSRKTPEVSPPGKQAAAAGMAGFGSLSAGGLDQWLAPSSRPAPVRPGSPSGSPAAPVSGASPGAPAMPSPDALPHTPPASGGDRVISGILQQDLGSWLAPDAAKRSPSEPGKAPEKIGVMPNEDLGKWLVPGAQKNNPPEPRKTLDEIRAGLEKWVAPGSKPPVEPDPDKATQEYRKDLDKWLAPPAKSGPPSAPPEAPPQAQPEAPPVVPPPAEPPAARPPAVPPARPAGDAVYLPGTRTLTPTANAAVGTASAAQGLWQAEMNALGKRMGELRLTPAAGGVWGRAFTQRQKLDNGVAREFRQTVGGFELGADTALAAAEGRWHVGAVAGYSQGSLKFRHGGTGDDDSVHVGAYATYIGNSGFYLDGIVRVSRFSHEFKVHDTQGRRVRGQYRGNGVGASLELGKRFTWPGAWYVEPQLEVAAFRAQGADYTASNGLRIKDDGTNSMLGRLGLHVGRQFDLGDGRVVQPYMKLSWVQEFDGKGTVRTNDIRHKVRLDGGRAELAVGVASQLGKHGSLYGSYEYAKGSRQTMPWTFHIGYRYAW

SEQ ID NO: 12993 - protein, 627 aa, Bacteroides dorei DSM 17855
MFYQSKTALAVCAAISFSINAQINSNEQPIERITVTANKFEQVLNHSLATVNIIDRAEIEQSNIRDLPSLLNTVAGVDLVRNGGFGQKADIFVRGATAKHTLVLVNGVRISDANSGAVSFTNIPVNSIERIEVVKGARAAIYGSDAIAGVINIITRQATEHEISITTGSNNYINYQQVGSVSAENIALSFNLGFEETDGYDATQKDPTLPVSKDHDDDGYQNKNLGVNLAYDAADLGVFALVAQYSEGEGEYDNAWGNDAYEFENYTSKLSWSKKVADFAHYASLSFSQEENTQTGTDVQQVYSTERVDLEYRGLYTLSDAVQITAGFNRLTEDLGRASAELSIAERDNQAFFVGGFYQDHKFIANAVVRTDDYEHHGRANTYTTGVGYQFNSQTTFRINHGTAFRAPSLTDAFVKNSPWYLPNEQIKPEEATNNEIGFSLDTGSAQYDVAVFRNKIDNLIANKYDVATKKYIPYNVDSATMEGAEFSANVQAFGMSHNINLTLLDAEDDQGKDLVRRPSETFNYSISKAWDLLDVSLAMQYRSSRPSLALYNAAAGKSEATTLPAFTIFNLSANYEVFNGFKFHARIENLTDKQYITAGTGYTATGEVLGYVPLGRQVYVGGSYRF

SEQ ID NO: 12994 - protein, 1023 aa, Bacteroides dorei DSM 17855
MKNRLECMQPIRFLVVLLMCCLSYTTWAQTQSNVNGLVTDFSGEPLIGVSILVKGTSNGTVTDLDGKFSLSAEMGNMLQISYVGYISQEIKVESNKLLRIIMEEDTKKLEEVVVVGYGTQKKVNLTGAVSAVSAEDLASKPVMSTAQALAGLAPGLSVLQTSGRPGQGATVKIRGTGTFSKAGTDPLVLIDGLSGNIDDVDPNDIQSISFLKDAASASIYGNRAANGVILIETKKGAQGKTTITYSNSFGWQRPTELPDFLPSWEYAEYYNMAMRNMGKQEAYLPEQIQKYRDGSDPDNYPNVNHLKWLLESGSGFQHQHNLSIQGGNATTSYNLSVGYRNQEGMTAKTSNERMTALFTMKSEIAKGLMLNLNINAYNNKYNAPNGEPQSIDGMIGYAVRQGPIYAGQKSDGSFGYQDNYSPEAWLASESFVQNVSRNISASGQLTWNTPVDGLSFIGKAGVNYWTKYDKAYRADTYFDDSKTVGPATLNVWTANNTYTTFEALATYEKQIKNHTFKLLAGTSVEQSNNKGLEGYRNTFPNNYLYELGSGDKSTATNDSSLEEYALLSFFGRINYAWKDRYLLEANLRYDGSSRFADGHRWGLFPSVSAGWRISEEDFWKNAAVSAVVDNLKLRASYGVLGNQNIGVYPYQQIYELGHDYPFGNPATLQSGAYMKTYNNPEITWEKTAITDIGLDFSLLNGRFSGTLDYFYKYTSDILAPVEVSSIMGREVGQSNVGAVSNKGIEINLTYNGQIGRDFRFSISPNFTWVKNAVEKLANGATEEINNNRIVGQPIGIIYGYETDGLFVDQAEIDAAPEQLVSKSGLKPGYVKYKDISGPDGVPDGKVDAQYDRTVLGSTTPKFYYGLNLSASYKGFDFSALLQGLGGHKRLIGSYMAYAFYNGGQIQRWQAESCWKEENPDKWAEYPRLETLNMNDTNLQTSDYWVRNASFLRVKNIQIGYTFPKAWTKKIGLENVRVYVSGQNLFSFNSFYKGWDPENEIGTGDSPSYYPVNSIYSFGFNFKF

SEQ ID NO: 12995 - protein, 135 aa, Bacteroides dorei DSM 17855
QIVPINTKELYYQRRLTPFKGSLAIPLVEVSVSQLNVGEEKGYVYGFGPAMHIPIEGSQGKLNFTAHAKVHYLTRDDYGRKRYGGPVHWTYAFGIQTKITGNTFASYLWQHMSNGDVYAYNPALETHTLSLGIHF

SEQ ID NO: 12996 - protein, 1086 aa, Bacteroides dorei DSM 17855
MKDSENKLSGSMHSFKRMLSFGILMVIAMTLFAQVKNVSGVVLDKKGESIIGASVLVKGTTNGTITDFDGNFVLRNVADNAILQISFVGYQTSDVSVKGQNNIKVVLSEDTETLDEVVVIGYGSVKKSTLTGAVAKMDSKAIEDRPLARAENALQGQLAGVTVRNTTGEPGADMQIRVRGAASVNANSDPLYVVDGVPMNTLSGLNPSDIASIEVLKDAASAAIYGSRGSNGVVLVSTKQGKSGKAKVAFNASFGVQTLEKKMDVLNATEWMEFKLRWNDANYLQEAKKLGLTSANIKDDNATRLSNLGIQAGTANSYLVVFDERWFNYLGDDMRNAHTYTPNPEQLSLLDWQDEFFRNSIVQDYSLNVSGGTENTSYLFSGGYMNQAGIVTGTGYERFSFRANIESKINKYLTIGMNMAPTYIVQDGSGQANGKDSQVHQALYATPVSEPGVGYMTNVDPNPYYLWAGSTSSPVYNMEKNIKQNRMMRLVGNAFVRITPFKDFRVELSASANYYDLDGNDYKYTSTTGSWAQGEGQNSSGGHNTERKWSTLLQALANYDHVFGNHGISVMAGFSSEQSNLGFSTAQSFNKPFPNDAITGSFDGSKVTAGTNTVTEKTANKLLSVFGRLQYNYAERYMLSGSLRYDGGSVFGANNKWGIFPAVSGGWLVSNEKFFKNWRMSWWNTLKLRASYGVTGNNSISNTAAYPTLSAGNYAGAPGYKANSLGNADLGWEKTHSTDVALDLGFFNNRIQLSLDWYTKNTTDLLYQVPVEGASGFTTVWDNLGDIHNEGFEIELNTHNLTGKFSWSTSFNMSYNKNEVKALGKDNTPVYSGFDKNNPSNILTVGKPVNTFYMYDAIGVWKNQAEIDAYSAAHGGKPVTFEGKQIVPGDIRYKDVNNDGVFDKDNDRDYLGSPTPKLVFGMTNTFTYRNFDLSILMTAQTGGKIFGVLGRAIDRPGMGAKGNALGHWREAWWSEDEPGNGKVPYILSSTTGATLDSRWLYSSNYLRIKNLTLGYKLPINPKFISYARVYVSIENLAKWDSYYGGYSPEAANTAASSSPGGSSALGLDYGGYPSPRIYTLGINVNF

SEQ ID NO: 12997 - protein, 275 aa, Bacteroides dorei DSM 17855
VKGPGLYTDIGKKARDLLYKDYHSDKKFTISTYSPTGVAITSSGTKKGELFLGDVNTQLKNKNITTDIKVDTNSNLFTTITVNEPAPGVKAILSFKVPEQTSGKVELQYLHEYAGISSSVGLKANPIVNFSSVIGTNALAFGADISFDTKLGELTKSNAAVNFVKDDLIGSLTLNEKGDLLSASYYHAINPLSNTAVGVDISHRFSTKENTFTLGTQHALDPLTTVKGRVTNSGKASALIQHEWRPKSLITISSEVDTKAIEKSAKIGLSLALKP

SEQ ID NO: 12998 - protein, 1049 aa, Bacteroides dorei DSM 17855
MKLKLLLKLQKLKWLCSKPILGVVLGMTALSGDAKATIMDRSSTTRSFYELAITGRVLDEAGQPVPGVNVHIAGTTVGTVTDVNGRYRLSIPDAYANRSLTFTFIGYVKQEVAIAGKTEVNVSLKPESTGLDEVVVVGYGTQKRINVTGAVGTISSKNIENKPVLNTFQALQGESPNLIIQQSNLNPGSDVTVNIRGIGTLGDNTPLVVIDGIVGGNLNTLNPNDIASVSVLKDAGSAAIYGSRAANGVILVTTKSGNFNTKASVSYNGNYGIQDARVLVDKVDAWDNAYYKNQSLVNSGLPPAYTPDQIQELKRAGNGTWDIEHLLKTAPLQSHNLSINGGGEKSAYYVSAGYQDQKSNLIGNGGSGADFGFQKYNLRLNQTSIVGKFRSNIILNYTKTRNKTNSVGDNNIFADANRVPHNYNWQDAEGNYLTNPVASQYNEYGVLEKGGFNQADNDEIFGAFNGQLSLTKELKLTGEFGGTLQNNGTFFRRTQVDYLPAGVYGNDLTVLDGNSKSTLLNTKLYAEYARKISDHDFKIQAGVSSESYDQRGFQLQKTLTDPLLGTPTTGTIVDPQSSTNSIAVNATSLLSIFGRVNYAYKEKYLLEALFRNDASSKFAAGNRSSFFPSVSAGWIVTQESFMESVKDQVSSLKLRASYGIVGNQNVANYQYQTTYFNYPNAYGFGNNVVGGAGTLIANRDLSWERSAKFNIGIDAGLFNNKLTATFDYFRTTTSDILAEREDVPFLFGAGSPSYNVAKVRNSGWEASLTYNLTGENLSQSFSLNVADNKNELLNLTGSATERIYNQDVFQLIRRVGQPITQYYGYQTDGFFQNQQDIDNAPKIAGNTVQPGDLKFKDQNGDGVIDERDKAILGNPFPRYTFGFTYRVAYKGFDLSLFIQGVGKRDQFLRGELVEPFHYGYGATVYEHQTDIWSPANPDARYPILANIGSASNTNNWRTGSDVYRYDAAYARLKNVNIGYNFNKQVTGKLGLQRLRISLIGQNLITLSKLKFIDPETSEFGNNLNPGSASNSARSYPLPVFYGAGLEVTF

SEQ ID NO: 12999 - protein, 1170 aa, Bacteroides dorei DSM 17855
MKRNLPAYYFFYGLIFRASLCLMLILTASVYAQSKERDRVYSFNWKNTTILNAFKEIEKEAKVHFSYNPLDLNVGMRIDLKVEKLKIHEVLDAISKKIHIKYQINGQTIMIQSYTPEVKPAGRLAFTLSGKVTDVNNAAIPGVTVTNATTSVTVSTNSQGVFSIKAEKGDLIRFRMLGFQQSSIVANEQQSTVSVVLKEEVQELKEAVVTALGIKREQKSLGYSVSEVDGKDLKKAREINVINSLAGKVPGLIITGTAGGPAGSSRVIIRGSTSVTGNNQPLYVVDGVPIDNSNYGGTGSGQYASGMDFGDAISAINPDDVEKISVLKGASASALYGARAANGVILITTKKGTGNKDLGIEFNSTSSIESQLTSYDGYQSLYGQGTKQLLNTQAIQDYNTLNQSFGARIDPDLTVITGTGKRVPYAFVPNNIDGFFRTGNTFTNTLSFTNSTENSSFRFSASNLNNKDIIPASGMNRNSFTFNGSSKFGPRITLEARAFYMHENVDNRPSLADDPANIGNSFLSLANTVDQKRFATEYKNADGTYLDWNNGNQYRLNPYWVINEMKNETTKNRLLSSLQANYKILDWLNLQGRLSNDRTQLEFDKFSPRTTPGALTGTLDQIRRTYNTLEADALLTAEKQVTPSLNLSARIGSSITRIKSDGYLMQFTNQTVLDAITPTSYTSQSVQATPYAKSFNSVYGILAAGYKGYLYVDATLRQDVFSTLLPGNNSKLYPSLSGSFVFTDAFKMDQKILSFGKFRASIAQVASDTDPYLINSYYATSPLPFKGLSFGGLSTLTQPSTDLKPTTTRSYEFGTELKFFKERIGLDVTYYNSKSKDQLNIVPTAISSGYKNQILNAGVITNEGIEVAILTKPVVSKDFSWDLNISFARNVNKVESLAEGTPFLTLSDARWMGVSVVAQPGQTYGSILAFDYQRDPQGNIILSPIDLQPVLSPTRQIVGKGIFDWTGGLSSTFRYKNFSLGTIFDVKYGADLLSLTNYFAAGTGSLKTTLEGRAEWIQSEEERLAAGQTIQQWTAAGRVRGLVPKGVVQTGTNPDGSPVYTQNTTAVDPSVYWGAILDVSNSVAQPYIYDASYVKMREITLSYRIPTSLTSKWGVKDVQVAVVSRNPFIIWKNVPNVDPDSNYNNGNGQGVEYGSLPGRRSFGFNLNFRF

SEQ ID NO: 13000 - protein, 748 aa, Bacteroides dorei DSM 17855
MKNDKRDYMKKNFIFIFLFLITSLPLFAQKMVSGIVTDEDGLPVNAIINSKDNFSQANTKKNGSFAISLKKLPDTLTITSTGFKPQFYAVTNEKYLNIVLISHIGTLDEVVIKSKKVDKQLIKIDLEKTPVNTAQDLLRKVPGLFIAQHAGGGKAEQIFLRGFDNDHGTDIAISADDMPVNMPSHAHGQGYSDLHFLIPETIQNIDFGKGSYYADKGDFNTSGYVNFHTYDSISQSYVKAEAGNFNTMRIMGMADLLKGNSLQQNAFIAGEYNYTDGPFDVKQDFKRFNLFGKYNQKIGSQGQLRLEASCFNSSWNASGQIPERAVAEGLVGRFGSIDPTEGGNTHRTNLLASYTYKASENQTFKTTFYYINYLFNLYSNFTFYLIHPDAGDEINQYDNRAVYGMNTIYTNYFTFDRFHLNLNAGFGGRFDDIKDLELSYVTARYTLNERLAWGAAKEANANSFISADLSTGKWRLNAGLRADWFYFNYYDKLQPDYAASSYNKARISPKLSLFYNASDQLTLYVKSGLGFHSNDVRDVVLQQGTNILPYSFGVDVGCILKPAKGLVLQPILWNSYLNHEFVWNGDSYGTSDAGATRRYGVDISTRYQILPFLYLDNDINWAVPRVVGAPKGDNYVELAPTLTSTGGLGFQFQNGFYANLRYRYMHDRPAVQDASIVAQGYFVNDLISGYQAKKWGINLQIQNLFNTKWNEAMFAQETRLKGESASVEELTFTPGTPFMVKIGLTYKI

SEQ ID NO: 13001 - protein, 353 aa, Bacteroides dorei DSM 17855
MKKALFALAAAGTCALSGVASAQTASNVTLYGIADAGIEFATHSPGGNGGTAVRVSSGNMSGSRWGLRGVEDLGGGLKGIFTLESGFDIDTGLSGQSSRLFGRQAFVGLQGGFGAVTLGRQQNALYDLFGAYDPMGVGPKYSLNSVDSGFNGRADNSLKYTGKFGGLTGTGYYSTGANNNGEVPGNYKAGRAFGAGLAYTAGAFSVGTAYDQTQSGTPAISDRAIKRLAVGTSYDFGPAKVFAGYRWMRDDGVATAATAAARNNVYWLGGLYRVTPALSLTGAAYYTDAHESNNDSWMFVLSADYAFSKRTDAYLNVGYVTNKGASNLGLNGAGTAIAGANQTGAIAGIRHRF

SEQ ID NO: 13002 - protein, 1245 aa, Bacteroides dorei DSM 17855
MKKYTNRIKLMPKFTKCMSLAMILTFTGYEEAFAEMSYAEQTSFTVSMENQTLKSVINWVEKNSQFIFIYRTDIDLSRRVNVDVRNKTIEEVLKQMFAGTDLEYHIRDRQVIIRKAISREETRPIVMQQDKVTVKGIVTDAKGEAIIGANIIEKGTTNGTITDIDGRFTLVVSEKTSLVFSYIGYLTQEMLVGKKTFLNVQLQEDNKTLDEVVITGYGGTQLRSKMTNSIAKVDNSTLSTGAHTNPAQALSGAVAGLRVQQTSGNPNSTPTLVLRGGTNLDGSGSPLVIIDGAVRESLSDVNPEDIESLEVMKDAGATAIYGARASNGVILVTTKRGSEGHTEINLSAKVGFNFFHSQYEFLNAHDYLYYMRSAFYRSSHIWQDKSGAWHGFASDATLSGTQPYGTGNRYFDEKGNVLNGNKDNTAVWGVMNYTDDLAFLLKQGWQTMDDPVNPGQKLIYCDNQLKDYNIKSPAITQDYNLSVSGGNDKGHYYASLGYNRSEGNAMNNWYHRLNFTINADYKIKPWLTSNSSLTFTDAKWDDGGAGYAGEGNFFSTTLSVPPTFRVKSPDGDWLAGPAVASYARGWTTVKVYEDALNYDNNTDKFNLSQSFTFNIMKGLTFKTTGTWFYFDDSREFFKGDYIVATGPVYDTNHSTSNKHERLLDQTYNGILNYQTTFRQDHSMDAMVGVEYYDSYKKGFSASGYGSPLSDFQDLNYTSTAAGVRQIDSWHYRQRILSFFGRVNYDYKSKYLLSLVLRRDGYSKLPKDNRWGTFPGISAGWVLSRENFMESCSNVLSYAKIRASYGANGNVSGVLDANGNVVTGLDYYTVQGSYGIMKDKDGKIVPNYNGKVPLMINDLPNPTMRWEKSYTFETGFDIGFLNNKYILNFTYYNRHTQDKFAEITLPSHSGVSSFLSNNGEVQNQGMELELTANVLRTKDWKFTVSMNTAYNKNKIISLPYNGLPNNMQDAYQVYTGRKLADGTYERQWVGGYQEGQEYGVIYAFKSLGIYKSESEIPGNLIDRSTYTENGADAKVLYGPEAWAKLSDAEKEKGLPIQAGDVKWQDVNGDGVIDDYDRVKLGNTIPHWTGGFNINTSWKGLTLNCRLDYALGYWVHDWKTPWIMGNMQGTFNTISLVKDSWSESNPNGKYPVYGWADFLGKRNYDRISDINCYRGDYLAFREISLSYSLPQSWIHKSGLSKVDVSVTAQNLGYITAAKNMATPEYGVSQNGGYPLPRTVVLGLNVTF

SEQ ID NO: 13003 - protein, 408 aa, Bacteroides dorei DSM 17855
MKNALFIRSFAYLFLGALSLNSYGVGFRIPEQGTAAAARANAFTATADDPSAVYYNPAGILQNDGLRNMFGAYTISLRSSVDLDTSAKNNHFTNTNNNWQIAPESYYTWHPAGQPVAFGLGVYVPFGFAINYPDDTPIRDVAHKGRLGYTTISPVVAFQVSRTFSIAIGPTINYSTATLERGIFAPGDQFKFNGAGWTFGFIAAMMWVPAPEHHFGLTYRSATRLDYSGHTYENTDAFTSGGVTIPAINTHSNADVAIDFPQTITAGYSYRPRPDWNFEFDVDWADWGSLNTATIHTSTGDLALPFNWRSSFMYEFGITKQFSHNFHTSIGYCYSQKSVPSGSFDPAVPDTNRHIFSAGFGQGYERFSWNVAYQFIYGPPRTISEGTVSDGTYRFDAHALSFSIGYKF

SEQ ID NO: 13004 - protein, 787 aa, Bacteroides dorei DSM 17855
MPFKSNVLYAALLATASISLSSQAQESKKTNEEAQSQDAKRLKAVVVTAQKREQSVQSVPLAIAVIGGDQVLERGLSSSNDVQRLAPGLSGQQSGFSRPRWFIRGIGSNDPNLTTESPLGVYNDEVFTALTSLQSFPIFDLERVEVLRGPQGTLWGKNTTAGAVNYISRRPDFATSGYVRASLGDWGAKAIQGGLGGAINEHTAGRIAFYHNSYDGYARNLATGNDGPSFEENALRVQWLTNVTDTFNALVKVHLHKREPGGGYSYQVHSEPGGADRFGFTPAYGTNPKAGDDYYAGESEDITNTEGALVKLNWALGGATLTSISSYDESEGHSKSFSGHPPTYTGTRDTTSGRGEDYSRQASQEVRLVSPQDGPLTWIGGLHFFRYSFVQDSASATFAPSTRSNYSRTWRGQDAESYAVFGSVKYEFTDSFRLNAGLRWTDEDKDITIHTVRTPTGATTFNNVSSWWNTAALNTAFNYDEAVSAADSWNEVTGDITPEWQINRDALAYFRYARGYRSGGFGASIPTLNSAQIAAGVVPYIPVVEPEYLDAYELGLKSTWLDGTLNVNSAVFYYDHKDIQLNVQAPNPLNLINPPSGSFSQNASQGEIKGLELEAHWVPTANLQLRAAYSLVDARYVDFYPLLSVSGVTQTVDRSGNRYFRTPKHQFSVDAQYRIPTDSAGTYILSTDWVYRSHQYYDAARQGAAQGEVARALDGNVYQREWQEQGAYWIGNARAAYLTRDERIEYFIEVQNAADENYVVNATAASPSYPVSLGTPRFVQVGVITRF

SEQ ID NO: 13005 - protein, 777 aa, Bacteroides dorei DSM 17855
MISTRRFHVTPLALALATLLPVVAQAASPAEPFTVAPAAEAAAPADAATNATQLDAINVVSQGSTRQVQRISRQDIEQLTPGSSAFKAVEKLPGVQFQSADPFGTYEWSTQVTLHGFDQSRLGHTLDGIPLGNMSYGVTNGLHITRAIISENLGSVEIAQGAGALGTASNTNLGGTMQFYSADPQTTPGARLVQTMGSDATRRTFVRADTGDRDGLSAYLSYANASTDKWKGDGDQTSEQANLKTVYQWGDGNRLSLFVDTSRRKEYDYMDLSLTSQRALGWDYDYLQPDWATAVQMARAYQNTGATSGVANGYPQSLAGLPSDYSWLDAMYYAGGGLRRDNLAGLSGTFVFGGATLDGSGYYHGNRGEGQWVTPYVRTSADIPLSMRTTDYRLDRFGGTSALKWSWGNHDLEVGAWAENARTSQGRNYFALGNEGQTSLYNVYEAQIPFRRDFLQRYTTQTRMLYLQDTVRLLDDRLTLNYGAKALSTTTRAQSLVPTTALAQGRIPAEDHFLPQVGVNYKLDERQDLYASFSKNIAAFGFTPFATSQAAFDRSRSTLEPEESQTVQVGYRVQDAQFQLSADAYFTRFSNRLLTTSPCTAVQTCAAILSNIGAVHSAGADLALMWHPTEGLSWLNSLSWNRSRYQDNYLNNGVVATSGKDVVGIPALMFSSSASYQIGNLRLDLDGKYVDKRYITFLNDSQVPSYWLLNAGARYDFGRVGGVADVALALNVSNLTDKRYFASTGTNGYVASDPDGYNQTMVVGAPRQYFMSLDVKF

SEQ ID NO: 13006 - protein, 1133 aa, Bacteroides dorei DSM 17855
MKGNQLMRKPKLLRALLILLFVAAPIQWTRAQIVLSTPKTTLGAVIKNIKSQSNYQFFYDDKLAEMPVNAIDVKNGSLQSVLDAALQGKGITYKIEDNIVYLSASGEPQTPQQTGQEHTVTGTVVDATGEALIGVNVQVKGNPTAGTITDFEGNYSLSVPGNGEIVFSYIGYRSETLKPDGKDVLNVTMQEDTQQIGEVVVTALGIKREKKMLGYAVQELKSDELNKTGDPSVTSALQGKVAGLQMNTSATGLGGSTKITIRGNSSLTDNNQPLWIVDGVPFSDTSTSSASRYDGVDRGSASMDINPDDIESISVLKGPNAAALYGSRAGNGVILITTKKGSKKDGFGIRYSGNFTWTAIGETLDMQRRYGQGHIDTKDAKTAVYDKTDSGSWGPVLDGSMKEAWNGETYAYSNYGDKLKDYFDTGFSHTHNVSISNGTEKSHFRTSFGYSDNDGVFPTESLSRVNADLNAGTELNKWVSMDGKISLSRTKADNRPLYGDYGAISQLMRIPNNVRLDDLKQYSDETHAHVNWTGPTASIRNPYYVLHQRQNSDERWRAFGYYSMKINFTDWLHLSAKYAFDYYRTRVQSTNAGDGINGEANTSMITNDSMDRSEENFFESNAEVILMGDRQLTDNFRLGFNVGGNFMYQRSETLGVGVGNMVDKGNWMLNAANLLRTGSEDGYKRAMNSVFGSVQMAWKEYLSLDLTARNDWSSTLPSGNNSFFYPSANLSFVVSDFLRSIDKPLPSWVTFAKARLSAAQVGKDTSPYQLYNTYSFKFDNGVLTPTKDNVKMNDQLKPEIATSYEAGLDMKFLNNRLGFDFTYYYSKTKNQIMKVPAAAPWSGGQWVNAGMVTNQGVELMLYSTLVETKDFAFDLNVNMAHNVSKVKELAPEENVNYMFFNGDGNFPVKVGTRAGHKLGEIYATSLYKRNENGDIIVNENGLPMTVTNESEYVNKPIGNIQPKLTMSVSPTFTYKGITLSALFDMKFGGDIFSYSEMLATGNGLAKRTLNRGEENNYMMVFPGVTESGEVNTKQVSASEYYGALQAEDFIYDASFIKLKELSIGYSFPSSMLKKTPVNSLNVSFVARNLCYLMKHTPGTSPEGGYDTTMFSQAIDYASLPFTRTFGISINLGF

SEQ ID NO: 13007 - protein, 686 aa, Bacteroides dorei DSM 17855
MRPCSHGEGLVMRLRLLKTMWYAPSLALVWGPACDVQAQDAALTLGKVQVSEHAQRSPSTARVLSSVDVIGGELLHDQHVDYSWELLMRAPGVQVTQFRMGTDAGRFSFRGFNGEGRINAVKLLIDGIPSNDNAGAMPYLDAVFAQDISAIEIVRGTNDARYGLNAIAGSVDVLTRTGGNDGRLSVTAGSFDAREVQLSKGFEQGAWSQNYVLAWRDSDGYRDHADARKRSVAGKWFYTDPDGAFRAGLTTRYYDNHALEAGYLDAATARAAPRSSPDYAQNDRSERRVRQTALHADGALGEQAQWSAKAYQNDYRNQRWVRFSAAGLQQERDTDETHRGLLLRSNWQPDWGALQANLEAGVDAQWQDNQSQRYRTVARVRGAKLRDWDYDLRTRGAYVQAVLTPIARLQLVPGYRIDRVDGHLHDVLAGSIAPTYDYGTIKQPKFSASYRVGEQSSVYANWGRTFQIGSGDGAYRRQPGNLGPSINDGWETGFKFAPSALVDGRLAYWEQRASGEVATVFGVNGVVGIGDVANVGRTLRRGWDAQLNVQPAEHWRAWVSYSRQKASIATPDPSAPATRGKEIENVPHWLATAGLEWQVGSSVQVSAWGNAQGDYYLERTNTLGRTGGYALLNLGARWAVDARNALSLQLRNVTDRAYVYAWYDSGSSGYSPGDGRALSVSWDWSF

SEQ ID NO: 13008 - protein, 987 aa, Bacteroides dorei DSM 17855
MNVRTPAVRLGLLPAGIALALAPAFASAQEASAPTTLDRLEVTGSRIRSVDVETSQPVLTVSHEDIQRSGLVSVGDLLQNLSVAGTQTFSKAAVLASNPEQGGQYVSLYNLGEQRTLVLVNGKRWSTSLAGFTDMSTIPTSLIERIEVLKDGASAIYGSDAISGVVNIILRKNFDGAEASAYYGQNSHGDGSKTQYSLTLGATGERSSIVFGANYIKEDPVWAKDRGLTQYSYGQGHKEDGLSPAGPWGRFTDPRAEGTAGAGEYNKAGKWVPNTWVVNHTGSWDTPVGVGQPSNNFNNYHLIGLDDYYNASQQMMLNQGAESKTMFTSASYDINDNLRLKSTAMYSERDSKRQIAGYPLTGTSQPQFPVAISKDSIYNPLGNWANPGAGVDIGGWGRRIFELPRITQNNVKSLHFDAALEGNFDFNNRPFDWDVGINYNQFDVTQTSSGNINLLALKNALGPSFINANGVAQCGTAANPIALGTSPGSCVPFDLLGGASAATPDALKYINTLLNSTGQSKSKQYFANITGSLFDMPGNAGEFAFAAGYEHREVSGYDHPDALSSSGYTTELAAQPTEGKYKTNEFYLELMVPLLRDLPGAKELSLDIASRYSDYDKFGNTVNSKFSVTWKPIDDLLVRATYGEGFRAPTLDDTFGGGSQTFDKFTDPCDAVFGQRSNPAVAARCGAEGLASDFRQTDAAGRPISARDTQGNNPFNSGVGNDKLQPETSKTRTAGLVWSPSFVSGLNVSLDWYKITVDNVITALSANYVLNQCYQNGVQAFCDQYSRGDVANGQQVTGLSRGNANLGSLETEGYNFGVRYRMPEYSFGTLSFNLDTNYLTSFRQQATKGAAWDDYAGYWNYPRVRGTLATTWTKGDLSATWTMRYYGGFRDFCYDQENGLECNQPDYYTENGGWTGGLGANKKGAIVYHDISATWQAPWNGSVTVGARNVFGKTPPITYAVTNASAVQLDPMLDYDRFLFIQYNQRF

SEQ ID NO: 13009 - protein, 70 aa, Bacteroides dorei DSM 17855
AGVEGRNYQLQLTEAQAANGGASGQVKVTKVTKAKSRIRTKISDFGSFIGFKGSEDLGDGLKAVWQLEQD

SEQ ID NO: 13010 - protein, 178 aa, Bacteroides dorei DSM 17855
IAYYTSESKLGSVLIYDPGIDAYAVQRQATRVEGFESNLRLRLGNSHLGLGYARANGRYDADIDGRLDSDLAGVNIAPNRLTAFWEQSWTPQLSTRLQASHAFDRDFDLRGAQVAEFKGYTTVDLVARYTLDKHAFTLGVQNLANKQYISYYSQTTPSNPSYFSGRGRVLTLGWQYRY

SEQ ID NO: 13011 - protein, 406 aa, Bacteroides dorei DSM 17855
SVFELANRSKDIDTLYANSGAQGRDLLQTLLIDSHDAGYARTMIDATSASEITKQLNAATDTLNNIASLEHKTSGLQTLSLSNAMILNSRLVNLSRRHTNNIDSFAQRLQALKDQRFASLESAAEVLYQFAPKYEKPTNVWANAIGGASLNSGGNTSLYGTSAGVDAYLNEKVEAIVGGFGSYGYSSFNNQSNSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTHKVALKNGASSQHLFNASANVEARYYYGDTSYFYMNAGVLQEFANFGSSNALSLNTFKVNAARNPLNTHARVMMGGELKLAKEVFLNLGFIYLHNLISNAGHFASNLGMRYSF

SEQ ID NO: 13012 - protein, 147 aa, Bacteroides dorei DSM 17855
GEGSTQGIRLAYRPFTHQVAEIPWLGKVDLYWEVSANFWEYGEQNSHQTNYAISLSPVISKQFTTLWDQYPVKWEAGIGVSLVKDRKFAGKDIGSHYQFEDRLGVKVEFGQNNTSSLALRYMHYSNGGLGSKNPGMDFLNIAYAKSF

SEQ ID NO: 13013 - protein, 147 aa, Bacteroides dorei DSM 17855
LDFNTPLGGMVWPANSTQNKLVLDIGDHDTGVSPLAAIGAEYALTKNWATRLDYQWVNNIGDANTVGTRPDNGMLSLGVSYRFSQDDVAAPVPAPAPAPVVETKRFTLRSDVLFAFNKATLKPEGQQALDQLYSQLSSLDPKDGSVV

SEQ ID NO: 13014 - protein, 1153 aa, Bacteroides dorei DSM 17855
MMLCLYEKIKLLSRLCFLIYTLNSNFMSNVVFWRQVFLGASLFLCDGYPIIAAEVGDLTPNVGTRSLQQDGRRVICTISDKAGPIVGANVLVKGTTIGNISDMDGRVILDGVPSNAILVVSYIGYVSQEIPLKSSQTNVRIQLVEDTQALDEVVVVGYGTQSKKDITGSVAVVSTDAIHETPVATFAEALQGKASGVYISNSGGPSGETTIRIRGVGSLNSSDPLIVVDGVSGVDISSVNPNDIESMQVLKDASATAIYGAQGANGVIIITTKQGTRADRVRVSYNGYFGVAKMANSGYDLLNGWESMEFEELGQQNLYNYRGLATSHPQFGQIAATGGKGISMPYAIKPAGYSEQQIIDMYGSVEAWEKSYVDDGSSSWARSAYYQMLADGYSDAEARKGTNWYDEIVQTGKIQDHQISLVGGGEKATYSVSLGYTNREGTIQNSYFKRYSLRTNTTYNPNKYFTMGQNTNLAAMETGGESGRQGDANTFAKTYTMNSWVPIYNVGGDYTGSVAPNAGRDISAVHQVAMNENDWTRMFHGQTAVFAELSNPWIEGLKLRSQFSARLNGMWSLEMTERQNMANKEASANNTLTETGNWRLNWQWTNTATYTKKIHEDHNITVVLGTEAIKQGVGRYMQGTRIDYIFESDPNTWTLDNGSSSNIGNSSRYQRKVTMFGLFGRADYSYKGKYLATFTIRRDASSKFGSKNRWGNFPSASLGWRMSDEKFMEPTRKWLDDFKLRAGYGTTGNSNIGSYNYAFQYGTGNYYMYPITGSDSETSPGYVLSNLGDSDAKWETTKMFNIGFDLTALSNRLTAGFDFYVKNTSDLLVPANWSALVGNASKPSINIGDMKNRGVDLSIGWRDKVGEFGYNITANISRYKNELTRLGSSDLFNDTRLSKVNITTVGQPVGMFYGYQIEGIYQNEQDVISSGVLPYGVATENDLVASAWVGRYKMKDVNNDGKIDADDRTIIGNPHPDLTGGFNISLTWRDFDLSTYMYYSIGNDLYKHYEYYTMFGNLQSNYSKDRLAKSWDPVNNPNGIYPLWTTTSTEGPEAGNESNSNYVQDGSYLRMQTLTLGYSLPKKLLKKIGFEKIRVYGQISNVFTITGYDGLDPEVRSHTSFENEYVSSDMNKGIDYGSYGMPRQFLMGVNVTF

SEQ ID NO: 13015 - protein, 1090 aa, Bacteroides dorei DSM 17855
MKKNLFLLLGLLMSFNVMAQTKTITGTVVDATNEPVIGASVVEAGTTNGTITDLDGKFSLNVSQGAKINVSYIGYKTQTITTGVQNSYQIVLKEDTEVLDEVVVTGYGGSQKRATLTTAISKMDNSVLEKAAYSNAAQALQGSVTGLRVVTVSGQPGSEPSITLRGGATITGANNKALIIVDGVVRDSMGDINSSDIESIQVLKDAASTAIYGARANGGVILIETKSGKAGKASVNYKFKMGVNFARKGYDYLNAEDYIYYNRIGYKKVKGYDGLDAQQGYGIGNNMYDIRYLNDETAHLQNEGWQTMDDPVNPGKKIIFKDYGGLLDNDVFDDNAFMQEHYISITGGNDKGTFATSLGYYNEDGQIIGTGYKRFNGSVNGSYKVFPFLNVKAGATYTWASKPSLWISEDQMFYRTRSQRPTWNPYDEEGNPASGGGTSDGNPAYFRDKLTQHNGERRQSYNIGFDLDILPKKLVLSGNASLLHYDYQREKFNKSYKLQSSSTATNTRQAEAWIKRYNQMQFNSTLTYTDRFAEKHNVDVMLGGEYYNYDEFQFEAKTQNSPIDDIPTLNVGAKQTYTSTTRTAYRILSGFGRINYNYDMKYLFSFVARYDGISRLKDNRWGFFPGISVGWNVMEENFWKDSKISEVISNLKPRISYGVNGNVNGIGNFDVYGAYGLVDAKNYGGSSAFYNSALVNTGLRWEQSKTLEVGLDIGFFNNKLSFIIDYFNRRTNDLLTKQALPGYLGFSDIMTNMGTLRNSGIELEVKANILNNVGGFTWDLSANLSSVANKIISLPYNGIENNRVGGYEVAVGKGTNATKWIAGRQEGGKLGEMVAYKQNHIFKSWDDVKEHANMMIDEVANLYGPGLASEYAGKEGWKPIEPGDVCWEDINGDNKINGLDREVVGNIFPKVTGGFSSTLSWKGISLYARFDYALGHTLYNDLAARTLGQYQGAFNIITEVKDMWSEDNPNSDLPAFYYADQLAKKNITRSNNASASRHNNSSRLYEKADYLALRELTLSWDLPKAWTSKAFIQNASVYVTGQNLFYVTGYTGTSPEPVLTNSDNNENLYGVDQGRYPTPRTVLFGLSVTF

SEQ ID NO: 13016 - protein, 417 aa, Bacteroides dorei DSM 17855
MALPRTPGRLASRRPLNSAPLHSRRRRIPAAPPTIRQQNPRRRRVRGRALARLRFARRRSRHHETNVRNSTLMAACCAATCMWAAPARANVQIYGALDSFLQYARIGSQTSVGLMSGGASTSRFGFIGSEDLGGGLRASFRLESGFDLMSGRPQSAASFYNREANVAIGSADWGTIKLGKQYPAIVPEAADPFYLVGQLSPFASTALIGSDLGRGAASLPGRIENAISYKTPTYGGLDVTVLYAFRNAAGASPIASNAGAVANFARGPVMLSGAYNAMWAATSSTPGGAPDGPRTDSVMASASYAFGPTLASFAYTLMRPTAPGTLVAQVYSLGAIWQRGPHAIRADLAYRTIAGQASHALGALLGYDYQFSKLTGVYVRLGGFRNTGQSALSFGSAPMSAPGMSSTVFALGLRQKF

SEQ ID NO: 13017 - protein, 990 aa, Bacteroides dorei DSM 17855
MKENNLNRVIGWSGLLLTSLLSTSALADNIGTSAEELGLSDYRHFVIYPRLDKALKAQKNNDEATAIREFEYIHQQVPDNIPLTLYLAEAYRHFGHDDRARLLLEDQLKRHPGDARLERSLAAIPVEVKSVTTVEELLAQQKACDAAPTLRCRSEVGQNALRLAQLPVARAQLNDATFAASPEGKTLRTDLLQRAIYLKQWSQADTLYNEARQQNTLSAAERRQWFDVLLAGQLDDRILALQSQGIFTDPQSYITYATALAYRGEKARLQHYLIENKPLFTTDAQEKSWLYLLSKYSANPVQALANYTVQFADNRQYVVGATLPVLLKEGQYDAAQKLLATLPANEMLEERYAVSVATRNKAEALRLARLLYQQEPANLTRLDQLTWQLMQNEQSREAADLLLQRYPFQGDARVSQTLMARLASLLESHPYLATPAKVAILSKPLPLAEQRQWQSQLPGIADNCPAIVRLLGDMSPSYDAAAWNRLAKCYRDTLPGVALYAWLQAEQRQPSAWQHRAVAYQAYQVEDYATALAAWQKISLHDMSNEDLLAAANTAQAAGNGAARDRWLQQAEKRGLGSNALYWWLHAQRYIPGQPELALNDLTRSINIAPSANAYVARATIYRQRHNVPAAVSDLRAALELEPNNSNTQAALGYALWDSGDIAQSREMLEPAHKGLPDDPALIRQLAYVNQRLDDMPATQHYARLVIDDIDNQALITPLTPEQNQQRFNFRRLHEEVGRRWTFSFDSSIGLRSGAMSTANNNVGGAAPGKSYRSYGQLEAEYRIGRNMLLEGDLLSVYSRVFADTGENGVMMPVKNPMSGTGLRWKPLRDQIFFIAVEQQLPLNGQNGASDTMLRASASFFNGGKYSDEWHPNGSGWFAQNLYLDAAQYIRQDIQAWTADYRVSWHQKVANGQTIEPYAHVQDNGYRDKGTQGAQLGGVGVRWNIWTGETHYDAWPHKVSLGVEYQHTFKAINQRNGERNNAFLTIGVHW

SEQ ID NO: 13018 - protein, 1033 aa, Bacteroides dorei DSM 17855
MKSNSFLKNRKALTALLLCTGFVATQPFSVMAEEIVTAVQTVQQQKQSVSGTIKDPVGEPVIGASILEKGTTNGTITDFDGNFTLNVAPGATLVISYIGYKNQEMKVIPGKSLNIILQEDTETLEEVVVVGYGVQKKSDVTGSVTSVGKERLGKLPVTNVLQAVQGAAAGVTITQTSSIPGDAPDALVRGQNSINANSGPYIVVDGVPISKSGGTLNDINPNDIESMEILKDASATAIYGTNGANGVILITTKRGTSGKPTIRYNGYFGVEDFSHKLDFCDGAQITQRYRDYVSQNPGETMYNDYVKNAYEAENQANGIENDWIDAVSQTGIIQDHNVSIGGGADNVKYYVSADYMSQKGVLKGFNYKRYSIRTNIDMNVTDYMKVGTNSYIVSHNRDGGRVNFLMAEAMSPYAKMYEEDGSYCINPMYSETLFTNPLMWTTTNPERRQWNININGYAEIDFGKLISPLKGLTYKFNGGYAYMPKRYNNYEGKSVNNKTGYAEIKNEETQSYTIENILAYNRDLGKHHLDLTALYAASRKKYQRSQAMASKFINDDQQWHNMGSAETPSVASYTDLYTTVSQMGRINYSYDSRYLFTFTVRRDGSSVFGDNNKYGVFPSVALGWNIARESFMESSSNWLNTLKLRASYGKAGNEAIGVYQSRVKMDSGMLALGGASNAGLWPNDLMGNADLTWETTKSFNVGLDFGLWNNRLTGNIDVYFSKTNDLLLKRNLPKVTGYNTVYSNMGETANKGVELTLNSRNIVSGDFTWSSNLVFSWNKNEIKDLYGDGQNDLGNRWFLGHPIGVIYDYTMVGIWQEDEIARGDHLNWDPIAEAGDVKLADISGPDGVPDGKIDDNDRTIKGQTTPKWIGGLTNTFTYKDFTLSIFIQTTQGLKKNNSLIGMAGDEMGRRNTTTEIGYWTPENKSNEWRSLRKNSNKHGYGFPCDASYTRIKDITLSYTFPQRMIQKMGIGGLQLYVSGRNLFTFTDWVGWDPEARQVARGNSSWDSTRGETVYDSSNYPMTKSCVFGVNLTF

SEQ ID NO: 13019 - protein, 799 aa, Bacteroides dorei DSM 17855
MQFVKTYVLAVLFLLHIGTIAQTTTGKATISGHVKDSSGVEMPGVIVMLEGTSFGSATSETGHYSIHHIPTGSYVLVTSTIGYQTQKRSVHLDEHQHLTINIEMKADSAQEEIHIEGKTEAEEIKRSAYTVDVIDATKYANTSSDLNQVLNHTSGVRIRESGGVGSTFNFSLNGFTGKQVKFFIDGVPMDNFGSSFQLNNIPINLAERIEVYKGVVPIWLGADAMGGAINVVTSTKQRTYADVSYSYGSFNTHRTSLNAGYIAKSGFTVQFNAFQNYSDNNYWVNVRNASIPGGNYSDVRVRRFNDNYHNETGIFNIGVVGKKFADRLLFGITLGQNKADIQTGAQADAVYGDLWRRGNIIMPSIKYQKKNLFIKGLDLNVTGNYNFGKEQNIDTVNRRYNWKQEFTANSAAGAPGGERGRTLYKYSNNTSIVTTNIIYQLNVKHSIMLNNVFSSFNRKGSNALDENNEANKQPKITQKSIIALGYKYDYNTRWSTSVFLKEYIQVTTISRAQEASGGWGTTEYVRYKNVFKATGYGFATTYFIYKTLQAKLSYEKGLRLPDNEELFGDLIQLEGNANLKPEISNNINVGLSYNKVIQKNHFLLMEGYFIYRNLKDFIRPELNINQTYQVMKNQGSVKNTGINGEVRYSYKRKYNIGANLSYQNLINHVQYEENGTSSNKESIVYLDRIPNMPFLYGNADASVVFKKVGGQKNSLSIGYNLTYVHFYYLKWPSQGSKDNKFDIPMQLSHDINMVYTMRDGRYNIALECRNIGDANLYDNFRLPKPGRAFYIKVRYFISK

SEQ ID NO: 13020 - protein, 1028 aa, Bacteroides dorei DSM 17855
MKNIPKKQFAGWMLMLLLCISISAFAQSPKKVTGRVMDAQGELLIGVNVTEAADPSNGVVTDINGTYTITLKGNKPSLKFSYIGFKDKVVAVGSKGVLDVALEEDVAALDEVVVVGFGTQKKASVVGSITNIEPAKLAAAPSRSLSNNLAGMVPGVIAVQRSGDPWFNNSDFWIRGISSFTGNTNPLVLVDGVERSLHDIDPEEIASFSVLKDAAASAVYGVRGANGVVMIETKRGKIGKPQVNVRFEHSFTQPIKIPDYIGSVKYLELINEMYAEQGRNPFVSEATLLNYKNQTDPELYPDVNWWDVISKDHADNTKANVSVNGGTDILRYALVAGYYNENGIIERDKNQEWDSSLKVSRYTVRSNVDVNVTPTTLFRANVGVFLQTRNAPPGDTETNQGIFYQAMRVPPYVHPAIYADGRIPRVMYKENPWAWATQRGYEKLNHNKIESLVSLEQDLKFVTPGLKFKGTFSFDKFSATSVTRSKNPYYYNPATARDAEGNIITDVQTTGQEFLGYAKGAEWGDQSIYLEGMFSYNRIFGKVHDVNAMFLYNQKEYDNGDALPYRTQGIAGRFSYTYDSRYVAELNFGYNGSENFAKGKRFGFFPAVALGWIVSSEKFMEPVSDVISNLKLRATWGKAGNSNIGGNRRFAYISTIVNTGSYRWGTDAEIYRLGRSEGEIGVNNLTWETVTKMNAGIDLGLWNGSVNLVVDVFKEKRDDIFMQRKNVPGSAGFNRPVWANYGKVENQGFDVSLNVNHKFNSDWAISAMANYTYAHNKVVEIDEPAAILGTYRSQTGKPIGQLFGLIAERLFTEDDFDENGMLKEGIPAQKFSDMSNLRPGDIKYKDLNGDGEVTAVDKTAIGGTRIPEIVYGFGATVSYKSFDLGVFFQGTGKTYQLLGGETWLPGSSLGAGNIYSNIDDRWTPENPRQDVFWPRMGDKAVANNEQASTWWLRDMSFLRLKNLELGYTLPQRWTTKIGIRGCRLFARGTNLLTFSNFKLWDPELETTDGLRYPQMKSVSVGFSINFNN

SEQ ID NO: 13021 - protein, 982 aa, Bacteroides dorei DSM 17855
MKHLFLLLTLLSFSLTALAQQKVTGKVKDSSGEPVIGASVVVKGNNTMGTITDFDGNFMLDVPAKSVLVISYIGYVTQEVPTAGKNSLEIVLKEDTKTLDEVVVIGYGTQRKGDVTSSVASVKADNFVKGAVKDVGQLIQGKVAGLAITNPNGDPTGSTQIRLRGTNTIGGANTAPLVLIDGIPGELGTVAPEDVESVDVLKDGSAAAIYGTRGTNGVILITTKQAKGVDINQVEYNGYVSTSLIAKKLDMLNADEFRTLYPDQDHGADTDWIDEISRTPVSHVHNLSLMGGNSKTNYIANLNYASRQGIMKKSDFESFQGRIEVTHRMFDDKLKLKFGLFGKKNQMESTTSGGSFRGWVYGQATRRNPTDPVRNEDGTWNENVSKFEYENPLALLYEAEGNVKKTQLRYNGNIVYNPIKDLTLSAVFSYIRDNMNRGYGETLNHISALRDGLAGWSSVGAYTKMEKLMELTAQYNKEIGAHKFSVLGGYSYNETDFEELWIDNYGFQDDYFGGWHNIGIGSALKDGKANIGSKKTPTNLIGFFGRATYSFKNRYLLMGALRYEGASQLWGTDNAWGLFPSISVGWRITEEAFMKNQKIFDDLKLRVGYGVTGSQPKDPFLGVAMLKYGSYAFVNGNWVQTIVPASNPNPDLKWEEKKETNIGLDFVSWGGRLSGSIDYYNRDVDGLIYEYGVPTPPNLYNKTMANGGTMRNRGVEVLVTVVPVQNKDFEWSTTGTFSLNSNKLISLSGSIFKSDYDYFNTGTVEYSGQVADSHRVQVGESIGNFYGFKVVDVDSEGRWIYEDRNGELVNYKDFTHAPEDKHVIGNGLPKWYAGWNNTLRYKNFDLNVTMRGAFGFQIINGGRMNYENVKNSRFENRLKSVNDLVFGKHTLSPEVEPEFNSYYVEDGDYWKIDNITLGYSFGQVGKYIKSLRIYGSVLNALTITGYKGIDPEVSTDGLTPGYDTRDRYPSVRSFTFGVNVKF

SEQ ID NO: 13022 - protein, 726 aa, Bacteroides dorei DSM 17855
MKLFTISAVILCSSLSVFAQEKVQDTTKVETLEEVLIKSVRVEADSPITHSNLTAEELEKRNLGQDIPFMLNYLPSVVTTSDAGAGVGYTYFRVRGSDGSRTNVTLNGIPFNDAESQGTFFVNLPDFTSSVESLQLQRGVGTSTNGSGAFGASLNLLTDAVQEEAGGEISNSFGSFNTRKHNVKFTTGLLNDHIEIAGRLSNIVSDGYIDRASSDLKSYFLQAAYKDNNTLIKALAFGGREETYQAYYGIDAETLANDRTFNTVGQMFDADGNFEGFYDNEVDNYAQDHYQLLWNQKINSNWRTNLSLNYTYGRGYFEQFKDAGDFEFLGAEPIVIDGETIEETDYIRRRWLDNDYYAVNGNVNYKDEKWDVSGGLFYSYYDGDHFGEILYSQYPIGYDYKEHYYDATGVKKEFTMFTKATFKINDQWAVFGDLQGRFVSHTIDGLTSDRAPLNVDVTYDFFNPKAGLSYIHNEKNQLYVSYGRANREPRNDDFEEGLFAAERLDDIELGWRFASEKVKVNTNAYYMFYKDQLILTGALDDIGQPIRASSGKSYRLGLEVDATIAVSEKIRIQPNVALSSNKNKDFYFQRDGVLTNLGNTNLAFSPAVVAGNAIVFRPIQNFEIGFLSKYVSKQYMGNIDSEGSTLDAYFVSDLNLIYTLRDIPVVKEIVFSGLVNNIFNHKYVNNGYFYTYDDDYSEPGVVTTIEGAGYFPQATINFLLGATVKF

SEQ ID NO: 13023 - protein, 186 aa, Bacteroides dorei DSM 17855
MKKNLILFISFILPFSPSLHAFENNQAIYGGYIYGKIKNHKANGAIISYHYGSDIHWGMLLSLLHIKSTHQSHFIDASSLKLGTKDEHAKVSALLIGPTYRITPSLAIYAQMGPKKLKYRVDKSYSGVAVTDTIIVDTTNVMFQAGIDYSLRKNVGINLGYLHSDTESNKHNIRLNSIQLSLGYRF

SEQ ID NO: 13024 - protein, 413 aa, Bacteroides dorei DSM 17855
MRRIAKRDSDMHLGEFVSNDTLRLRALGACAAICLAPTAYAADDASPVTAEIGGRVHWDFTVFGNDDRGAPEHNDTQFRRVWLDVSGKFYGFNYKAEADFAGLQYEAGSRGILARDVYIAKKFSAGTLTVGQFKQYFSLDDRTGSNYEPFLERGYASTTLAPIYRKAISWQANRPDATWSTSAYSLESIDNSSTKGGALGTRLTYAPEMGEARLRHLGLSLAHERYSHPGSGGAASLLIRPRPENDLANNSRITLVRFADGRDTDFDKWSLEYAEVLGPWSWQSEFSGGLLDDGAQHAKVLASYGLVSWFVTGESRGYDRKSGRFSRIATPNRPSGAFELALRYDYMRGGQHQDGQPDFINASTQSWTLGGNWYFKPNLRVMVNLIDSHNRNRLSDAVVDHTQAVTGRFQYDF

SEQ ID NO: 13025 - protein, 82 aa, Bacteroides dorei DSM 17855
MMPTRGFRRSLGTGKSLSFSNSKSNFNQVAVVTDYFFSKTTHLFFMAGWQRAGGATHQAQLSGTASSNNHQILLTAGIGKKF

SEQ ID NO: 13026 - protein, 370 aa, Bacteroides dorei DSM 17855
MITWFGDRHLSSTQKLFAFGIAMLPACACAQSSVTLYGTLDVGLLFTNKTLGSTAQGNAGKQFSLINAGLEPSAFGLQGKEDLGGGMKMTFKLESGVSLVNGGFDNSNGNFFGRQAWLALDGAFGQLKAGVQYSPFVLAIYESDPRNAGQFGTAFSVYADQTFSGTFNPNAVTYTSSQFAGFSTSIMYAPGGMPGDFRAGQQYSVAVRYQYSGLVVNAAMYDSSEGKNNAGLTTFQQPFSGRMIGVLYNFGAFTAKGSFTSYKVPTTVANGVASGGGNNVWNVGFDCYVLPQLNINSGLWYVRDPHDSANHGLVGALTARYFLSKSTSLYAEIGAANNHGHERLGLSIDNALYGVPGTTVGAVLGINKRF

SEQ ID NO: 13027 - protein, 652 aa, Bacteroides dorei DSM 17855
MLSKVEVQDSNISASLGGFMGGAVIAKTKQYSGTDSIKLKYRTTNSSWAKMEAGDSVQKILKQVRPDDSGAAELQPKYNKQTFNILAEKRLNDNLGMVLGYSRRTSSIEQNRLIGFDKDASNKAQLDKQNHQRLSDNLLLNFNWTPQEKERIEFGLRYSNYKELKYFKENIGNNVSDYHQALGATLAWVHSFDSGVWTNTLAYDRFQDKRKSSSNNVETTSVSDEDYEPLYNFEKGGYGNSRLTQDNLHFSTEYVMDPFYLASTEHSISIGGIYQATKYQFYRPQDVHQKVTLIMLNKNGKPITETLLSNSTTSKGRVKTSYQNIGIYAEDLIKWRKFEFRPGIRIERDDYLKNNNIAPRFVARYHPWDNTGFTLGLNRYYGRSFASLKLANRILKINDDSTRQHQNFSSLKSPYADELSLSFDQNMSNLALKLGYIHRDNKNRIILKRETVNRMKKSSYINGRPFGVDIYTFQLNNIEPWKLGKTYWTTSLGFDWLNTKRADVSNEFDPNELVYLDGKLMTRSQMLQQVNSSTEDWIARLGIDMTIPDYDITWSNKVYMKAPIRSYEELDGDNNDDTPRYRSYHYGRHTQWDSSIRWQPTIRGKHSVYLQVDILNVLNKTRKNKVTTISTSDEYGVYTPGREFWLEVGYQF

SEQ ID NO: 13028 - protein, 349 aa, Bacteroides dorei DSM 17855
MDNKLGLNKMNKTLIALAVSAAAVATGVNAGEIYNQDGASLTMGGRAEARLSLKDGKADDKSRVRLNFLGKVAINDSLYGVGFYEGEFTTADKGTTDEKGSLDNRYTYAGIGGTYGEVTYGKNDGALGVITDFTDIMAYHGNSAAYKIAVADRVDNMLAYKGQFGDLGVKASYRFADRSADKDVNGDWNNAYTDNNADGYSLSAVYAIGETGITLGAGYADQDNQNTSADQYMLAASYTISDFYFAGTFVDGQVKEFNDKADLTGYELAAKYTMGQAVFSTTYNYLESKSSGTKTDEADNFAIDATYYFKPNFRSYISYNFNLLDEDANKGITKAQAEDELAIGLRYDF

SEQ ID NO: 13029 - protein, 208 aa, Bacteroides dorei DSM 17855
MMKTATFAAVASLMLGAAGLGCATSAFAGEAFVGVYKHDVTFIGNAIGLGAAGREGGADIHLGYRTNRIERLDWLGKPQVHAMVSINTNNTSNFAAVGFNWKVELGQPGGFYLRPGIGLAYTDGKAGLPPANAPNLTPEERARRTWLYYNRIDFGSKVLFEPELALGYQVNDKVSVELSYTHLSNGQIFHQGKNQGLDDAGVRLVYAF

SEQ ID NO: 13030 - protein, 1012 aa, Bacteroides dorei DSM 17855
MMKTHDNRALFSKALLKAATCFFLIAGAGMSPVFALQGTAESMKMEITQQTVTVSGVVKDRKGEPIIGANIMEKGTTNGTITDFDGKYRLNVKGSQSVLVISYIGYKTQEFEVKNNRKIDVTLQEDTEVMDEVVVIGYGTQRKGDVTSAVASVKAEDFTVGKIGDAADLIKGKVAGLSIAKGSGDPNATSTIRLRGVISVNGSTTPLILIDGVEGDLSTVAPENIASIDVLKDASAAAIYGTRGANGVILITTQNGKRESHTTASYSGYVSASQFGKKLEFMTAEDIRAGKTNFTDKGYDTDWLDAVSRTGFTHNHNFNITGGSKQTTYSADVTYRKEDGVIMNTYSEDIRMRFDVSHWMLNDMLKVNLNMVKKWHKNSATNATATDQSNIYRQAIMRNPTAPIYNEDGSYNEDFNVNYYYNPVGMLEERLGNYTYEETRATGNVTFEPVKGWQTNLMVATSRFNAHDKGYNTTDYFSNQLNEWTGYAYHTQDETRTDNLELTSKYDLNVGKHRMNALVGYSYQYYTYERFYANNYNFPTDFYQWHNLGLGQALKDGKAGMGSDKNENTLIGFFARVSYAFDNKYNLLVSVRQEGSSKFGDNNKWGTFPSASLGWTISNEGFMEGITWLNNLKLRAGFGITGVIPNDPYMSLTRYNYGSSYYYDKGTWKPGLEVASNPNPDLKWEKSTEYNIGLDFSVLNDRLGGSVDIYRKKTTDLLFNYSVPTPPNLYSYTFANGGSVRNQGIEVAINAIPVQTKDFEWKTVVTVAHNASKLLSLSNDMYESNSYMDTGGLGEPISVSTHRMEEGRPLGEFYGLKSVGASENGLFLIEKPDGEVVEFSTAYLTNDEYRQYLGNGLPKVYLGWGNTFTYKNWDLSMQFTSQLGFKILNEPRAYYENNSHAYNRLKSVEEAPYGGQYTLSSSQPQTMVSYYLENGNFLKLTNLTIGYNFPFKNNKYIKNVRAYLSGDNLFCITGYSGLDPELSNPYPTYAGIDNRDKYPSIRSFTFGLNLTF

SEQ ID NO: 13031 - protein, 1017 aa, Bacteroides dorei DSM 17855
MKTFRFVLLLFLVLSISNTAWAQNQTVKGRVIDSKLKEALMGVSILEIGTSNGTVTDLDGNFTLSVPKGAVLRISYVGYLVQEVPINGKTSLDIFLKEDTELLDEVVIVGYGAQKKATLSGSVTSVGGEKLAKTPVTNVSQGLAGRLPGVVAVSNTSEPGYDGATITVRGVNTFGKADPLVVVDGVPGRSLERIDPSTIETMSVLKDASAAIYGAQAANGVILITTKRGKAGKPRVGFTYNYGIAAPTVIPEMTNAVEYATLMNEIDKYAGNKGRYTVDDLRLYADGSDPWGHPDTDWFNETLKSWSPQTYANATIDGGTENVKYFVSVSAKGQDAFYRHSGSNYHQYDLKMNLDMKINKYVDTYVNVTGRMEDRKYPTRSAENIFRMLMRSKPNSPAYWPDGRPGPDIEFGDNPVVICTNQTGYERDKRYVLNGDFGVNIKVPYVEGLTLKATASLDKTFRFRKIWQKPWYLYSWDGTSMDENGQPLLVEGKKGFSDPRLTESMEDNLGVLLSGIASYSHTFAQDHDVNILAGVERITDKGDSFEAYRRYFLSAAIDQLFAGGQDEMNNTGTGYEEARLNYFGRVNYAYKSKYLAEFVWRYQGSYIFDRSNKFGFFPGISLGYVISEEDFFKKKLPFISFAKVRASWGQTGNDLIDPYQYLASYTFNDLMYLTNNGATMNQALKEGVAPNQNVTWETATQKNIGLDLQFLNGDLAFTIDYFHNNRSDILWKRNASVPGTSGLVLPDENLGKVQNQGVDFNIDYRRNFKDFRLGINLNGVYAKNKILFWDEAPGTPEWQKSTGKPIDSGLYYEAIGIFKDQAAVDAYPHWAGARPGDIIFKDVNGDNVIDGNDRVRNDKSRTPRFTGGLNVDLGYKDFDLSFLLQGAMGGVFYQTTESGDFANFLKSFYDNRWTEENPDADFPRTYNRSNEYFINQQNTFWLHKTDYIRLKNIELGYTVPSIWSKKIGVEHLRVYINAYNLLTISPDMKDYDPENTSGSGYNYPLNKVINFGVNLTF

SEQ ID NO: 13032 - protein, 708 aa, Bacteroides dorei DSM 17855
MNKKSALPFKLKQSHCAVATLFCCSALTPIAGYAETENEAGTFRLSPIIVNDQALADDDSESVVAKELWVGGKVATSIQDTPASVSVITEKEIQQRNASTTEEVLQYSPGLVTDYYGTDDRNDYFMIRGFQATTYRDGMTLGSMRGVREDPYAFERVEVLRGANSTLFGPADPGGSVNFVSKRPKFESIRNTYVTYGSNDHKEVGIDVGDTLNENETLAYRLTGKVKDSDREYDYSKDDSEFIMGGLTWEPNSSTSATLLIDYLNTDSTPNSGGYPLDKEYDRSNFFGEPDYNNHSVERTNITAQITHRINRQLKVLGNLRYSDLTDDFGYIYLSDTAGRVGSTVNRYRYGSDTNAQEFIGNTMLQYDASFDSVDSSTTVGIEYRDASSDITTADGSVTSIDIANPIYTGKPNFPLSSDNKKDYTTKSIFLQQNLSFDDKYIVTLGVRNDALNLSNKNNLTGVKANESFSETTLRGALTYKINDKLSAYLSQVESVAPPSIDSNGSANKPERGEQLEVGIKYAPYEMNAIFSASVYDLTRNNVPIRIIRNGVISTDPESIGKSKTQGLDLEARADLTENLNISAGYSYMKSEVVKGTLRNGSSIKGNEFVTAPRSTASLWSHYTLPNQTMSIGLGARYVGSYYFDAVNTSKSEAATLFDAAFDYQITADTKLGLNIKNLLDKQYVVGSGTANYYNPGRDITLTLNHSW

SEQ ID NO: 13033 - protein, 773 aa, Bacteroides dorei DSM 17855
MKKVVMLFLSILFCSNFNLQAKDFNLKGAVYDKKTNAPLFDVSIFIQDSYNRTATDSSGHFIIPVNEGETLVFSAIGYQLHKEKIKNGEFLKIFLLKDKSYLAKDVIVTAHKKNETALKVDVPIKEIPLTVQTLDASILEEREATDMGDAMKNVGGVRPINRYGGFQTFTFRGFNDFVLLVDGVRDERHNLSSSAPQTNLANVERIEVIKGPSSVLYGHSALGGIINVIRKKPTPYSTYNLSASYGSFNSKKIFAGTGGPLNDELSYRLDLGLTETDGWRDFGQRTANAYLALNYTPSKTDNFELQIGLNKDKYDTDTGIPVLEDGSFPEIVDLSTRYNATDDFLKHDRYDFQLGYTKEINDNLQLSNKSSFYYDKIDYLSTEELTYNESLDSLTRTYPYYFNHNAYPVQNQLELSYNFKTSDIEHKLLSGYSFNYMHRKTYYGTVIGDGKNATISVVDPILNQGYVGYIPTRYSGKDETTHGLYVQDWINISEKLKVMLGLRYDIFRGTYYTDYVDENKEVTEEGEKTDINTTAFTYRFGLVYHLYEPFTLYGSYSTYFKPTRTISSYGEVFDPEKGYQGEVGFRYELNNIAQINFAAFYIKKYDIVESVGKDTSGNTIYQQVGAADSKGVEVDLLLNYNEIVNVTFSYSFNEAKYLDYDTDDASNSNEGNYIKFAPKHMLKMWATCNVGYGFGTGLGINHVSENYTNAANTYKLPGYTVTDWSVFYNFDNSQIKLSVENLFDVTYFTDAIYNNQFFPGAERNFTLSYSLKY

SEQ ID NO: 13034 - protein, 788 aa, Bacteroides dorei DSM 17855
MKFIRAQKSCLALAVASVFASGIAQAAIDEIIVTANKREQTLQDIPVSVTVTTGDTISKAAIQDIIDLQSVVPTLRVSQLQSSTNTSFAIRGFGNGSNNEGIEPSVGVFIDGVYRSRAGSSISDLPRLERVEVLSGPQSILFGKNASAGVISIVTPKPSGETGGYIEASIGNIGYKNTKALFESAISEDLSFDVSANMTQRDGYFTNIAGGPAMNERDRWGVRGQVSWTPTDNTEVRIIADYDEIDEVCCGVSNLVNGPTGAVIGLLGGQLVPEQPFAYRIAADIDPFNEVENGGISAQIDVDYGSFVLTSITSQRFSDTFEALDIDFTSAPLTQTSPNDLNVDTFSQEIRLTSTGDGDLSWMIGAFYFDESVDYTSEVMWGPQARNYFDALVAGLGAPGALGAVEAGIGLPAGTFFATGTGAQDSFSQEDQSTSIFGQFDLQLNEQLTLTAGFNYTQAEKEVTVSQVNTNAFAAVPAAFVGALSALQSSLPPVVNLPNAIEGNTTDDSDTTYTLRLAYDINDNVNVYGSYATGFKASSWNLSRDSGPNAADLAALVAAGLTANAPNLTAGSPFADPEESEVYELGLKAVFERGSFNMAIFDQTIKGFQSSIFNGTGFELRNAGMQSTKGVEFDLVYYPVESLRLGLAGTLLDPVYDEFVGGGFEGADLSGAKPAGIHEVSLSLSALYDFRLGKNDAYARADYQYADEVTIVDNLPPEVAAIATREVGSLNLSAGMNTPSGLNLSIWARNLTNDQYLTSGFPTPAQAGSFNIYPNQPRTFGVTARKSF

SEQ ID NO: 13035 - protein, 773 aa, Bacteroides dorei DSM 17855
MRTTVLGIIGSFIIMPVYGQHFVKGKIIDSENAVMPMVNVAFLNQSDSTLVTGAVSDSCGIYSTSLDGGCYIIRYSYLGYETLYKNILVNADITLPIARMEFSQTELEGVEITAYRKPFKLNRDGITADVPNTILAKQTTLNDLLCKIPGIQQRGEAIEVIGKGTPTYYINGREVTDQTELNNLAIDQIQSVRLMTNPDTRYHSEQRAVIEIKTKRLGEGLAFNVSGNLLQGNHFSQNYRMNGSYNYKDWDFFFSYNYDRGKKDSDLDIYQQTQSDTIWNLTNLSQKQIFNESHAYTGGVSYHFSPESEVGLKYEGKYSEGNTFSNETLSMIPDKGVSTFIKNLSDVSDKSVSNHFNLYYINDWKNGWKMNVFGDYLHKTDRSRGNIREWESDDAETSMDYHRKADWDLFAAKFSLSYETEKAGTFSLGYDFSHTSGTDYIEYIRALNNGRTRNTELKNSLYLSYDYAWNNLSLGAGLRYEHIRSDLRETNDSKSQNQTYHNFLPSVSLSYNTESLQQSLTYSIHTERPPFGVMNDNAVYTDRFTYQKGNLYLKQALTHDLNYMLFYKFLFFNLNYTCTHNPLVTAFYSMPGNSAVTVSYMDNFDKLHNLTGMINLQYPVKWWIPSLTLTCMKTFFNYPGPDGSMLKSGRPLMILNFNNSFTLPSGFLLSADFNYGSRGYYQLYESKSYTSLNLSLKKSFLDDRLQLSLDGYDLFNKNKIRSAARLNDIIMNSIGKEDTRKVGFTVTYRFRKERTMNNRSAAENEMSRLNMSE

SEQ ID NO: 13036 - protein, 430 aa, Bacteroides dorei DSM 17855
MPATTNKNNQRYFFMLSTYKGLLMATVVPFACSSMASGFINDSKGSLTLENYYFDRDYREGPGQSQTQEWAQGLVLDMRSGFTEGPVGFGVDALGQLGFKLDSGPGRSGIGLLSVDAETGEPGESYGKFDVLGKARLSKTQFELGTKQVLAPVARGMNVRLFPPLMRGAFLTSREIDDLTLQVTRIDAIKLRNSTNHEPMSISSPYRRFNGSATSDQFDILGVDYQWNAGLATSYYHATLQDLYRQDYISLLHTWALPQAKLVSDLRYFISREDGAGEAGPVDNRTFSSMFTLSTQGHSIGLGYMALSGATAMPYVAGTSPYVNTGGSQVSEFVNPGEKTWQFRYDYDFVALGVPGLKFMWRYMDGRQLKLPIAKFEAEESERDVELSYVIQSGSLRNLGIRLRNADYRADFTREIDETRVQIDYTLALW

SEQ ID NO: 13037 - protein, 776 aa, Bacteroides dorei DSM 17855
MISIRITVRCIGFMGINTMNQSLSISTEPKRSAPRLLCVMIGVALGSLSASSWSAAVANSTKTASAVAETNSAESSNKADTITVVGTPDTFRAGGNDLIPTYLDGQVANGGRIGFLGQQDARNVPFNIIGYTSKMIEDQQAATIADVVKNDASVQNVRGYGNPSQNYRIRGFNLDGDDISFGGLFGVLPRQIVSTSMVERVEVFKGANAFINGISPSGSGVGGMINLEPKRAGDTPLTRVTVDYGSAAQVGGGLDVGRRYGDNDQYGVRVNVLHREGETAIKDEKNRLTAVSTGLDYRSDRARTSLDVGYQKQTIHHMRTTVGVGAVTVIPEPPSTTLNYGQPWVYTDLETTFGMLRSEYDVSQNWTVYGSIGASHNEETGQYGSPILTDNSGNATISRLYVPYISESIAGLGGIRGHFDTGFITHKVNLGYATNYRTTKSAFNMSESINTNIYNPGVIPFPPTSTNPNFYSPNQDPTLTSQVRASGFSLSDTLSMMDDKVQLMLGVRRQDVTIRNFNNGVPNSAGSLDAMKVTPIYGVLVRPWEKVSLYANHIEALGPGKSAPNEFNGKPVVNKGQIPGIVHSKQNEVGVKFDNQRYGGTLALFEITRPTGTVDPATNTYGFYGEQRNRGVELNVFGEPVLGTRLLGSAVWLDPKLTKTQNGTNNGNYAVGVARYQLVFGGEYDIPSVEGLTATGTLTRSGSQYANDANTLKIKPWTRLDLGVRYTMPMKETNLIWRANLENVTNERYWESIEDSGVYLYQGDPRTLKLSVSMDF

SEQ ID NO: 13038 - protein, 715 aa, Bacteroides dorei DSM 17855
MSKKLTFIASSIFIALSPALHAEEAVSVFDEIVVSGTRSEQSIKNIPSSVAKVTSEDMENNLSNDVKDALKYEPGVTVNGRGRFGMEDFTIRGMSGSRVKVMVDGVEQPSSYNPGADVMRKNANTFEVDTLTAIEVNKGPSSSLYGSDALGGTVLLRTKNPEDLLEAGDDSHVSLKTGYASVSDEYKATIEVANRTGDLETMLIYTYRDGHETETHGDGANIEGPDRGAADPFNITSHNILGKMFYQINDANRIGFTGEYYTRSADGQILSRNGYDGGGGFMPGFVYTNNSADDKDERVRLGFEYEWLADNVAFDSLEWKVNWSKSEADHKSYDHTGNYGNRNRARSGTDESTQLDAQFQKEIQFTNNRHELTYGLSASNASFDLDYTDYFLDSGTSKPGSTEVPKSESEKRGIFVQDQVYLLDEALVVTAGLRYDDYKASPEQSSGLEDHNSDALTSRLGAVYHWNQHFSTYAQYSEGFRAPSIYELYYDKDNAAHGYKIVSNPNLKPEESQSYEVGLRANNNVGALELSAFYNDYTNFIKSSTVNTGGIDITTNENVDEAEIYGAEFKGSLWLDEAVGAPMGSYARLSLAYLDGEDKNTGKTLDTIAPFTSVVGLGYDAPNEQWGSVVNVTMVASKTDWEQDDNLDASSYTVVDLTAYYRPMKDLTLRAGLFNALDEKYWQYQDLEGQTASAQGIDIRTQPGRNWGVNLNYDF

SEQ ID NO: 13039 - protein, 976 aa, Bacteroides dorei DSM 17855
MLAFGCNQYTFGSSVTLYKSLLSLSILSAMSSAYAQQESPKIPLPDDMEVIEIRGIRASLAENLDVKRMASSVVDAITAEDIGKFPDKNVADSLQRVPGLMIERNGGEGASVSIRGLSSELTFTQLNGNFIASSPGEPSRSFDYALLPSSMIERVEVFKSSEARLDEGGVGGTVLMHTRKPLNMEANSGVLNVETTYADVTKEYQPQLTGLYSWKNDNETFGILFGYTAQERTNRTLAGGTDGNVWRYTGQGNPVDVNNNAVENNNSWDIVTDAEGNRFDGVWFPQVVRGSVFNEKRQREGVQLSTQWRATHALEFGLNYFGFSLERDSTHSVVDIPEWSLNPSFLTDVGLDESGTIVNAMQFDASASGVEHDMQLPWMRGSYVREKSTSDTLDFNVTYEGDLFKLRFVAGHTQSDGGPSESWEAAYKSSNAGENASTVENAAQTAGWSIDRNSVSLNIDPNTLTNLLNGIGGGRDPGSSNSSFVRSELAETYYQGDLDFYADWGMLKTIKTGVKYRKATLHRETANTFFLDPNFDIAAAQASDNGITRFDSYQWNNGMPLAKDVFTSEDNLIGGFSINQMPTIDWDKYRNTILTNYVPYTRIEDNFVYDIEEQISAFYIQGDFEFNDVRGNLGVRVVQTTTMTSSTDLYTYLLDHTNDQTGEAVTGDARFLDDYQLVTQENTDTQILPSFNIAWDATDDLVVRGAVAKVMSRPDYSDLGGQQHITFVSDEWAQDRAAFNEQAGFSGRGGNKNLKPFESLQSDISLEYYYGEGSAMGLALFYKKVDNFVVPLVIDSLQYFAGKDQVVAAGTITISPYSTVGNGTNAVSKGVEVFLQHAFDNGFGFNANYTYNKTNKADVSVDGQAFGQSPLIGSAKYQYNTSVYYEGDYFNVRASYNKRGETVLGLNSGLNVYQDPYSQIDLNASIHLYEGLSFTAAVINLTQSGSVTRLGNDTDARLLNASYSGRRYYAGFNYSF

SEQ ID NO: 13040 - protein, 684 aa, Bacteroides dorei DSM 17855
MNNIISLCNIIYIYVTISCIIVCYLLASKLHKKYICYDKQQKRAYYKKVLTGVFSSFLFFSVLAEPFAMNNGEGGEQIPLSEISLSGGQSLEGGATGGDGVTSVSPESIPDALYCMFLDEHGNQDIVTTNSSSIQSNCCRNICSIGMTRCLITNLIAGACGGLGVGLGGVIAEFTDPSMMLAATSGGGLACYFFSMLAAYYYGGIIVSKEKRENLEAIDRRMQSLIEESISRGRRRSILVGHQGQPVTTQPSVAAGPSAHLRGVIVTEQPVAVGASASVGASSTRGSILRSSQRGDQGTEGLQNRSRWGEQDTDPIYEDVWTYAVELIPGYSYEGQVGSLLGMQCVLTGVSIQVPQKLRRLALKAYEKIPQMYLSLQGNKVSSPSIANYGKLLKATKNFANQKQKHIPYYVFAFTDDYKANLERKVRSGQAGIIAELCNGVHFGLTYSRHNDEKKEYTGMQLGKGRGSVKAKSEIESIAAVVTFNADRPGITGHFASCYGWGTVKNKRFFTHAGRETSSSGSPAISIAGGLVQIGYNLYISKSCSVTPYVEGVLSIAKWKPYNEKRGDLPCKLSESSESIFEKSIGLRSDWRVSESSILQTWISGISGSQTSSNVSLQPLVAPMKRYEVSVPMRNKNYLRAECGATYVSKITDSLFTGATMLFSFVKRQKLHNQQINTYVQYVF

SEQ ID NO: 13041 - protein, 976 aa, Bacteroides dorei DSM 17855
MNQVIKTIALCYQKYISRASNKTFSIHNTLSLSLLPKCLLGSLIIYTSHAFGEMELAISGHKYGKDRDAFTMISSCPEGTNYMINRKLILSEFSSLDKFSSGGAFKNLAGKIAFLGKHSSSSIHFKHLNINGFGSGIFSESAIEFSDLRKLVAFGSESTGGIFTARDDISFKNNHYIAFRNNIAKGNGGVILLQGDERGTVSFTDQQGAIIFANNQALVSPSIKHSGRGGAISGDFAGSRIIFLNNQQITFEENSAVHGGAIYNKNGVVEFLGNGGTLSFKENSTRANGGAIYTGKFKANQQTAPIIFSQNNANQKGGAIYAQYVNLEQNQDAIRFENNSAKEGGGAISSSQCAITAHNSITFSNNFAGDLGGGAILLGGKQPSLSLVAHNGNIAFIGNTMLPATKKASLPRNNSILVKESPYKIQFAANKNRSIIFFDPVIALSPSTSPVEINSPEHETPFFSPKGTIVFSGANLIDDAKEDIANRTSIFNQPVLLHNGTLSIESGAHLVVQSFKQTGGRISLSPGSSLALYTTNTLFHGNVSSTDPLEINGLSLGVDTSPSNLYSEIRAGSAPLKLSGSPDIHDPERLFYENRDSAASPYQMEILLSSDKIIDVSNFTIDAPVPNKEAGFQGSWHFSWQPNTVNNTKHKVLRASWIPTGEYILEPSRVGNAIPNSLWSTFLLLQTASHNLGDHLCNNSDLVPTSYLGLLIGGIGAEMRTYSAEKESFISRSGTTGTTIIRLTPTLTLSGGATHMFGDSFVTKLPEFIASEGMVQNVGLTQILGPLTVKSTLCAALDHNAMIRLSAQKNHTRAKWDTFGIRGTLGASYSLLDYENMVRIFTFANVEATNVLQKSFTETGYNPRSFARTRLTNIAVPVGIGYEFCLSNHSFALLGKGHIGYSRDIKRKNPVTFAQLAMNNFSWTANGCQVPTSAHTIANQLILRYKACSLYVNAVATKLESTYLSSSLSCGGYVGF

SEQ ID NO: 13042 - protein, 824 aa, Bacteroides dorei DSM 17855
MKHNILWGIILLVASLSFTAKAQKAVQGQFSVKGVLLDSLSNEGEPYSTIRISLKNNPAKPVKLAVTGADGRFDERLAVPGIYLIHFTSVGKSPVQKEFSISANRRNVDLGKILIAEATEMLKGVEVVAQKPLVKAEIDKVTYSIEDDPDSKTNTTLEMLRKVPLVTVDGEDKIQVNGSSKFKVHVNGKPNNMMSNNPTEVLRSMPANSIKSIEVITEPGAKYDAEGVAGILNIITVGAGMEGYTVTLNGGASNMRVYGGGYGTVQSGKFTVTGNYSYNYQGSQKGFEDSYREDFTSQENKFLESHRRSKSYGNFQFGSLEGSYEIDTLNLISFSMNLMTGNFTNKRIGNTQMTNHAGNPVYGYGSLGNNESGFGEVGGNMDYQHSFKKKGELLTFSYRFSHSPNNSEANTDYEDTLNVPYLLQNQYFKNDASTQEHTAQLDYTNPINSIHSIETGIKYIFRRSKSDGKYYLADKTGEYKYDQDMSTQYDHKQDILAAYLGYQLKYKKLGGKAGIRYEHTFMDADYKNKDEKFDAQFDDLVPSLMFSYQLAPTQSLRASYNMRISRPGIWFLNPFTDTSNPTAISYGNPDLESEKAHSLSVTFGSFSQKFNVNVSANYSFVNNGIEQYSFIKDGVMNSTYDNIGKSKNINLSLFLNWNMSPKTRFNINGRGAYVDYRSSGLDLKNHGWEGNVFGSFQQTLPWDLRLSLNGGGGTPHISLQGKSSSFYYYAIGLSRSFLKEKRLTISLNSSNLFNKYITFKNNINTPTFCSSTATRIPMRYYGFNISWRFGELKAQVKKAARSINNDDLKSGGGNAGTGGGIPAN

SEQ ID NO: 13043 - protein, 988 aa, Bacteroides dorei DSM 17855
MKKHLKMVFMLFLFISFSTCQLAFAQQARITGKITDAETGEGIPGVSILISGTTTGVVTDLDGTYSIEASPSDVLRISFIGFTTVEEEVGNRTVIDVALSENVQALNEVVVVGYGTQEKKEITSAVTSVKSEDFNQGTVNDPTQLLQGKVAGLNIARPGGNPNSGFNVRLRGISSIGENASPLVVIDGVIGASLSTVDPNDIESMDVLKDGSAAAIYGTRGSAGVILVTTKKGKKGRSVVDFNSSVAIQNVARTISVMNAEEYKAIPNSRDLGGSTDWMDEVTDTGLSFINNLSLGGGNETTSYRVSINSRNVDGVGINSGFDQLNARLSLTQRALNDKATFTVNISNTSVDRQFGNENSFRYAIISNPTLPVLDPNPQSPDFGGYSERDIFDWFNPVSIAEQNIADGRDNSLIASIRGEYNFSSKFSGALFYSKQRETEWRGSYSPKTAKFGGGFGRNGLATIQNNERLNDLFEATLNYYETFGKTNFAFLAGYSYQEFFNQGDYTQAGNFLTDAFTYDNIGAALDFANGLATVSSYANSNKLVAFFGRANFNLDDTYLLSLSARYEGSTRFGANNKWGLFPAISAGVNIANLVDISGVSQMKFRASYGRTGTQPGESYLSLLRFGRQGNFFYNNQFVPSYGPVSNANPDLSWETKDEFDIGLDFVILNNKLDGSIDYYNRVTTGMILPINVPVPPNLFPTTQLNIGEMSNSGLEVMLNYKAIQNANFTWSTGVNFSTLKTNLRSLSAGDLSFGEVNYRSNFGSPGQNLTQLIRIQENGPLGQIWGPIQVGVSDDGSPIMKVIDGTAEDENGNPVYCNCNDDRTQLGTAYPTLNFGFNNSLRYKNWDLNFFFRGSFGHYLINSYRGFYENTESTTVQNWNIVNTKYFDPNITKAEYNSTHVEKADFVVLDNATLGYNFKIQPGKAVSRVRAYVSVQNPFMFTGYTGVDPEVRYGDSESNNDPLAPGIERRATYFTTTITTFGLNLSF

SEQ ID NO: 13044 - protein, 725 aa, Bacteroides dorei DSM 17855
MKVKLLLTAITLSCLAIDVLAQVSISGKIVSADTNEPIVGANIRIDQSLSGCTTNGKGEFSISNLPDGKHVLRITHVSYTPKSITTKGGEKNLLIKLQDSFTNIGQVVVTGTGTHHRMTDSPVPVSVITAKDLSNASVTSLDEALQKLTPSFSSMTNGMGTTLSLNGLPDDYFIFLENGKRLYGDDTYARINVAKIKRIEILNGASSALYGTNAIGGVINIITDDAKNAINVSSDTRYASKGRFTQSVNIDVNTGKFGSYTSYRRQQAEGWQLNPYEENSKTHELEETGKVASTGFYANTVNQKFTFDATDKLSFYARGGYYDNKTRRPYEAYDYNILHETFNYGIGAQYMINKGNYITADCYADHFSSSYCFFKDNKTYNGKAGEEQVRKRTRNHNLSIKGIFKLGNRHKLSVGTEYIVDVLKSQTDNIAKEDAYTLALFAQDEIKLLRNLQALIGVRYIYHENFKNHATPNVALMYKPGKFNFRASYAAGFRTPTLSELYATDIAKKNDRLTIGNLDLKSEKNNYFSLSAEYVHERFSVSVNAFYNNIRDMIDYNTIATGDKAMEQYGHKEVRQRDNIAEAKVHGINVSANAYLGAGFNLSGGYTHLNTQDVELEQPIDKSIKNAYNINAQWAHSWKIYRLNINLNGRINSKRFSKSYGYAPEYQLWNLNTRHSFNLKSVIIEPGCGMENLFDYMDDRPYNSNYATLTPGRSFYISLSLKFKS

SEQ ID NO: 13045 - protein, 802 aa, Bacteroides dorei DSM 17855
MRYLLLSSIFILFSLSIQAQKIQVLDQKGQFPIDGVAVFNDDKSKSGITDFDGYIDISDFSNSDMLTFQHISHTKKTVQKSAILAANNIVYLSTDTSSLDEVVLSVSKFGQNEKDITQSIVSINSEDITFKNPQTSADLLQSTGQVFIQKSQLGGGSPLIRGFSTNRLLIAVDGVRFNTAIFRAGNVQNVISIDPFAIDRTEVILGPGSVVYGSDAVGGVMNFYTKKPSFSFEDGMSFTGNATARYATANQEKTGHFDFNIGLKEWAFLTSATYSDFDDLRMGKYGPDDYLRNQYVVTENGVDTVVPNDDPLVQNATGYNQINLMQKVRYMPSEKWDFNLGLFYTTTSDYPRYDRLIRPDGEGLRSAEWYYGPQEWLSGNIQARNKAYNNGLFDESVATLSYQRFKESRNDRDFQDPTLFTTEELVNAYTAAIDFEKDFNKAKINYGVEYVYNKVGSEGKKTDITTNISSPDASRYPDGSTWQSAAAYTSAQITLAENLSFSTGVRYNHILVDAEFDLDLFDLPFSEANINTGALTGSAGLAWQASPILGWKANFSTAFRAPNIDDVGKIFDSEPGSVVVPNPDLKPEYAKTGEIGVNLNFSDAVKIDVTSYYTVLDDALVRRDYALDGVTEIEYQGELSNVQAIQNAAKAEVYGIEIGAEINFSEALQLTSHYNITDGYEEDDAGDRNPLRHAAPHFGTTHLIFKQDKWKLDAYGIYNSKFDFEDLAPSQQSTDYIYAQDIDGNPYSPSWYTLNISGEYAFTDALKLNVSLENITDQRYRPYSSGIAAAGRNLIMAVNYSF

SEQ ID NO: 13046 - protein, 767 aa, Bacteroides dorei DSM 17855
MKKYIFFLMGAVCFLLSSSAVHANELNKSDANIIGHVLDKNTEEHLSFISVSLKGTTIGTMTDASGHYFLKNLPEGEFTMEVSAVGYKTISRKVTLRKGKTLEENFEIEEDLIALDGVVVSANRSETTRRMAPTLVNVMDVKVFENTNSSTLSQGLNFQPGVRVENNCQNCGFQQVRINGLDGPYTQILIDSRPIFSALAGVYGLEQIPANMIERVEVMRGGGSALFGSSAIAGTINIITKEPVRNSGQLTHTLTGIGGTSSWDNNTTLNASLVTDNHKAGLYIFGQNRERSGYDNDGDGYTELPKLKNQTVGFRSFIKTSTYSKLTFEYHHLSEFRRGGNKLNRPPHEADIAEQLQHTINSGGAKFDYFSPDEKQRLSVYASAQHTGRDSYYGGGQDVNAYGATTDFTWVTGSQYIYSFDKCFFMPADFTGGLEYNQDNLTDDMWGYNRYTKQEVRIASAFFQNEWKNKQWSFLLGGRLDKHNMVDHVIFSPRANLRYNPTENMNLRASYSFGFRAPQAFDEDLHIENVGGTVSMIELAKDLTEEKSQSLSISGDLYHRWGDFQGNLLIEGFYTSLSDVFALRQKGERDGIIINERYNEKGAKVYGLTLEGKIAYRSLLQLQAGVTMQKAEYKQARAWSDDETVPMEKKMFRTPNTYGYFTLSYNPFVPMTIALSGTYTGSMMVEHKAGFIDKDIAVNTPDFFELNLKAGYDFNLYKGITMQVNAGVHNIFNAYQSDFDRGAKRDSGYIYGPGMPRSYFAGVKLSF

SEQ ID NO: 13047 - protein, 725 aa, Bacteroides dorei DSM 17855
MKKKCLLTALFGCMVVCASAQISLSGKVVDARTGKPVEGANVRLEQTTIGCATNPKGEFLLKDIKEGTYTLRTSCLNYAPVTQKVSQSQKEMVIRLKSTTFNMDQVVVTGTGTHHKLKDSPVPVEVISQRDLQNANPSSFQDALVKLVPSISVQTTAMGTTLYVNGLPDKYLLVLINGKKVAGDISGSIDYDRINMDAVKRIEVLKGASSALYGSDAIAGVINIITDDPKSALNVSSNTRVSSHGRISESVNADANDGKLSAHLNYNYRTSDGWQLNPYEESKGELVETTKKPVYKNHSHNVSQTLSYAATERLSLHLNGNLFISENDRTGAYDYNNRHQSYTVGGTAKYLLAKRASYIEGNISTTNFRSFYDYINDAKTHKTGDEVLSKDQTYTNANLKGVFKTHKNNTLFTGLDYVFEGLEPTETSKMLNNEYQSVYTLAAYVQDEVKLLDAISVVAGIRYAYNEKFKSQFTPKLSLMYQYSELNVRASYAAGFRSPTLQQMYAVSESRGQITVGDPGLDPEKSNFYNLNIEYNHRLFSIAASIYQNDLKDKIEAEDIGTTPEDIENGITRRRQYRNIEKARVKGFDIGFSVRPFTGFMFGANYIYTDGRNRTEDIRLERTVRHSGNFNASWRKTWNDYTFNIAINGRYQGTRWSKTYGNAPAHQLWDINTRHSFNLKSVALEPAVGVENIFNYTDDRPYNSNYATLTPGRSFYVSLLVRFKQ

SEQ ID NO: 13048 - protein, 808 aa, Bacteroides dorei DSM 17855
MRNTLTLHPRLSTTALAMALLAPIASQAEAQKIQFDIGAQSLPSALRQFGQQSQLQVLYSADEVQGLRSNPVRGQLSVEAALAELLRGTGASYSLQGSSVTISAQRSADSVDLGDITVTSQESAWGHVNGYVAKRSGTGTKTDTPLKEIPQTINVVTQDEIKARGSQTVTEALRYTPGITGGGFADRVKIFDEPTSRGFSPAPMYLDGLHMPYGGGSTGGALQIDPYTLERIEVLKGPASVLYGQNEPGGIVNMVSKRPTATPIREVVLGGGSQDRRYGAFDVGGALDEQGTYLYRLTGVGRDINSEIDYAEQKRFMLAPSFTWNPNEQTSLTFYGQYQKDNDVPEAQGLPAYGTVFSTPNGRIKRSTFIGEPGLNSYDRDQFVLGYEFSHEFNDVWTFKQNTRYAYIDDQYVAPLHGYNFVPNPNTGANDQRYTTRYGVDWSQTNKAFGIDNMLQAKFKTGEISHTALVGVDYYHYKSKFLGLYSYENSSPIIDLYKPAYGNKFTFTNPYRWNRTTEQTGLYLQDQMKWNQWFLTLGGRYDWAKTDTKETGGKVDAKDEKFSGRAGFGYEFSNGIVPYVSYSESFQPVGGLNMDEGNKAFKPTTGKQYEAGIKYQPPGQNSFIQMSVYQIDKKNVLTLDLENPNFYGQSGAMRSKGFELEGKASLTNNLDVIASFSRNDIKYTKDNEGRKGRHPAGTPPMTAAVWLDYTLGGDTMFAGLGAGIGARYTRGSDGTDTAVDHFTIPSYTLYDGKLSYDFEKSPLHVKGLKVQVNLENLEDKKYVSRCAGIWDCYYGQGRTITTDLTYNW

SEQ ID NO: 13049 - protein, 728 aa, Bacteroides dorei DSM 17855
MKRNCLSLMIGALLATGPVLAQESPTAGRSASPTNLDSIKVTARKREETLQEVPVAVTAFTSEALDRMNVQDISDLDAQVPNLTIYAARGASSTVTAYIRGIGQSDPTWGADPGVGIYLDDVYIARPQGALLDVFDVSRIEVLRGPQGTLYGKNTIGGAIKYISRGLPTQTEGFAQITVGNYSQLDAKAAIGGPIGGADSGLRARVAVASMNHDGFGENTFNGQPVSDKQINAARLNVGAYAGDDFDVQFALDWIDDQSGMRGSKMLAPNPFLRAYPPMDSRYDIRSGMRNLNNVESKGASATVNWRPNDDIALKYVVAKRESDSEANIDFDTAPVKLADVGGTYHDDQVSNEVQLNYDAGGRVRGVVGLYQFSGEAGGQIQNSYFSAQFADNQGKVLTDSIALYADWTFDLTSKLKLDVGARYTDEDKRAIVLNRLYADPGFSRPVAVTADFDKKTNFKNVSPKVSLDYQITPDIMVYGLATRGFKSGGYNIRANAVAVPRSAEPFDDETVDSYEVGSKMAFLDQRLFLNLSAFYNKYKDIQLSVFTGLDTNGDGVDDSFFGDFTNAGAGTVKGLEVEYQYLPSQHWLISGNLAWLDTKYDEYMDRGVNVARQMKFTNAPEFSGAFNVEYRTELANGSNLSARVSYSYQSEVWPTTDLSPVIRQQGYGLVNAGVIWRLDDAWTFSLQGTNLADKEYRTTGYNIPAVGTLIGFYGPPRQYSLSVRYDF

SEQ ID NO: 13050 - protein, 932 aa, Bacteroides dorei DSM 17855
MATQEVAIKQTVNITLKSDAEVLEEVVVTGYGNFKKSSFTGSASNVSTEKLQDIPTVSVQDRLAGSVSGVQITSTSGQPGAVASVRIRGMGSINASNEPLYVIDGVPMLNGNVSEFSYADSGNSLMATLNSNDIESMTVIKDAAAASLYGSRAANGVIVITTKKGASGKTKINLRADWGLSNMAINYRPILNGEDRREILHLGLANYALNNGNDETAAKAFADKNIEDFAARPWSGYTDWKDVLFRNGSHQNYEVSAQGGSEKTRFYTSFAYTKQEGITNVSGYERFTGRANVTHQANRLTLEANTMFTNSTQNVNNEGTSFASPIMCYAMTASPSTYPYNEDGSFSTNFPALNGANPIQTEAYNYNRSTINRFLGSLSATWNIWDNLNIKEVVSYDFNQNNERVWWDPRSNDGRSSNGVYQRVMGNRAKLNTQTQLTYNKVIAEKHTLDALIGFETEDYKYDYVYANGNTYPSYLPEIENAGNTRASSSVQRYRMTSFLGRLNYDYENKYYFSASFRRDGSSRLSRESRWGDFWSVSGSWRITSESFMENIKEVITDAKLRASYGVNGTQPSDYYGYLGVFGFGYNYNKGAGSAENRIENPNMKWEKNYATNIGLDLTLWNRLALTFEWYNRETKDLLMDRAISAVPGIIDGSGIANTLMNVGSMRNRGFEFEIKSTNIQNNNLTWTTTFNISHNKNKLTKLDGEQNEMISGVSIHRIGEPYYSIYAYEYAGVDPATGKELYYINGEDGSRETTTNSAQANKTIIGSVEPTVQGGLTNFVSWKFIDFNMTLTYSLGGHAYDYATWLQSNGGTYNYLGNVPAYYKIEDTWKKPGDNAKLPQFAYGNTNIASSRWLMSTDHLRIKNITLGFTMPSKVSQKWGINKLRAFVSANNLLTWKSDGLYVDPETPVDGLCTFETPALRTITFGLEVGF

SEQ ID NO: 13051 - protein, 466 aa, Bacteroides dorei DSM 17855
MASPGPCRVHDDDNKTNDTAGEKSMQHRLNKTTLAWAVGLALGAAPGALLAAGFYIQEQSVSGLGRAFAGEAAIASDASTIYFNPAGMTRLKAPEFQAAVHLLVPKSTVTNSDSRAITPGTGGNPLPYEGGSGGNPYEPSPVPNLFYARPLNEQTWFGLGITAPFGLANEYDRNFFARYDSTETSLKVIDIAPSIAYQLNDRVSIGGGINIQYADATLKNALPDPTRVGGPSVDTDGEFALSGDSWDYGFNIGLLVDLSDDTRIGVHYRQGITHTLEGTATTRLPFGLGGTSVSQGGEADLKLPDMVSVGLSHRFTDRWTGLAQYTWFNWSNFDEIAVKLASGDHPDPVRQNYKNSWALALGAEYQLDDRWTLRGGIQYDTTPTQDGFRTTRTPDGDRTWFSAGASYERDSRLGFDLAYTYIDVAKESLNLDREFYDGLPFASSVQLRGTTEGHVHILAAALRYRF

SEQ ID NO: 13052 - protein, 1002 aa, Bacteroides dorei DSM 17855
MKRKLMLLLTCLFVGIGLVTAQITKVTGTVISEEDGLPVVGASILVKGTTVGTVTDMDGKFTLSNVPSSAKTLVVSFIGMATQEVAIKQTVNITLKSDAEVLEEVVVTGYGVQRKASFTGAAAIIGEDVIAKKSDANFVKALEGAVPGVQMSNSTSMPGVWSEIYVRGRGSLNSGTQPLYVIDGMPVNSETDGMSTTTNNNFDPMAAINPSDIESVTVLKDAAATAIYGSRAANGVIVITTKKGKEGKMSINLDIKQGFVSMGNHNMDYANAQESMNLFAHGRSVAYGNTYDESYDYLKKVYQGYGWDGVSSYDWMDAITRKGYYQDYNVNLQGRSGSTGYYVSLGYLDTEGLIIGSDMKRYSGRLNLDSKFSCFTIGVNASYSNSTQNGFSQATSGSMSSATVAAISSMNPMMPFYNEDGSYANISNYNPLALYDEKAGEINENNNQTLNFNPYLQIDLGKGIYAKTTLGVNIADLRQYQYWSALYNPQAVDYNGLGQQYNSRYTTITWNNVLGWNYTFDKHNINLLLGQEMQRKNYFYEYYSGSDFPFAADGKTDLSTAGTPQGSEYYKKEARLASYFMDAHYSYEDKYYVSGSFRRDGSSVFGSNHRWGNFWSVGGKWRVSGEEFLKDNSIITNATLRASYGTVGNQDIDWYAARGFYSSGYNYNEKPGMTPTSISNSDLTWETSKKFDIGFDLSLINRIHLTFDYYNEETSDALFEVPLSMTTGMSTVYQNIGAIRNRGIEASINASVINNNNLTWNIYANMTWNKNKIIKLSTDEPIEYTYQIIEEGRPYRQFYMKEYAGVDRENGKPLWYLNEEGNETTSDYNAAAKRYVGDADPKVLGGFGTNLSWKGFDFNMNFTYRLGGKVFDSGASFTGFGMANRTPLKDVALNSWTEENKDAKYPQYIYGDPNKATQTSSRFLYSSNFLRISNMTLGYTVPVNLTKKIFIQKLRAYISIDNLYTFTSNDFVGYNPETYSNGVIAWQYPATRTFIGGIQLSF

SEQ ID NO: 13053 - protein, 387 aa, Bacteroides dorei DSM 17855
MATPPNGIASSGRRPPVRLASVRRQSGDHMKSSFSRALQTTFACAAVAALAAGASGARAQSSVQLYGQVDEWIGAQKFPGGQRAWGVQGGGMSTSYWGLRGTEDLGGGYQAIFTLEDFFRAQNGHYGRFDGDTFFGRNAYVGLATPYGTVRAGRLTTQLFISTILFNPFIDSYVFSPMVYHVFLGLGTFPTYTTDQGVVGDSGWNNAIDYTSPSFGGLNAAAMYALGNTAGDNRSKKWSGQLNYSSGPFAATAVYQYVNFNGGPGDLGALVSGMKSQGVAQLGLSYDFKLAKIYAQYMYTKNELNTGSWHVNTAQGGVSVPLGPGSALASYAYSRDSGGHDQTRRTWALGYDYPLSKRTDVYAAYMNDRYSGMSGGDTFGAGIRAKF

SEQ ID NO: 13054 - protein, 836 aa, Bacteroides dorei DSM 17855
MKNKFLLSLFCLFTTLAFSQSSNYAITGKVTDKDAGIPLEYATVTVTDVNNAQDVEGGITDMEGNFRVEVPQGEYNIKIEYISFQPITLKRTLNADLNLGTIQLEFAASDLDEVTVVAETTTVDIRLDKKIYNIGKDLTTAGGTVSDALNNVPSVSVDVEGGISLRGNENVRILINGKPSALAGFGSTDVLRQLPADAIERVEVITSPSARYDAEGTAGILNIILRKEKTLGFNGSINGSLGNPDLASISANLNLRTDKFNVFNTTSYRYSSSPGNGYFDTRYNTTDDITPTYERIIEDRDIQRLNRGFNTNLGLEYYLTDRSSITGSVFYRNGNDVDETTNLTQSFNNSAPVLETSRIERQKEKDDRYQFALNYINRFNDEGHQLTADLQYTTSDETQNTFINEDITLNTENTDPIIAERLLSIEKQDEYLVQADYVLPFGEGSQFEAGYRGTFENEVTDYRVNQEQIANSNNFVQNDTLTNVFDYTENVNAVYTQLGSKFGKFSVLAGLRLENTQLKGQIGSALTEAELQDIYGFEINTDFDNNYLGLFPTLNLTFELNERENVTLGYNRRINRPRGWFLNPFPDRSSRNNVFQGNPNLQPAFANAYDLGYLKRWDKLTLTSSVYFQRETESFEVVQEIIELQGQGSNTNGNTVIRSIPVNLSSNERLGAEIGLLYNPAKWLRLNGSFNFFQFNTEGFFNNVDYSAKNTSYFARFSSKVSLPWSIDWQTNAFYRGAAQNAQSDTDGILSVDLALSKDLFDDKATISMNVSDLFNGRKRSQVTTNDLFTRDSEFQWRQRQVNLSFVYRFNQRKNDRQNNRQPSMNDDDDGGDFQG

SEQ ID NO: 13055 - protein, 370 aa, Bacteroides dorei DSM 17855
MKDLTVLSRWRYSWRILDDNEAQKMKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDVYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFTFNKATLKPEGQAALDQLYSQLSNLDPKDGSVVVLGYTDRIGSDAYNQALSERRAQSVVDYLISKGIPADKISARGMGESNPVTGNTCDNVKQRAALIDCLAPDRRVEIEVKGIKDVVTQPQA

SEQ ID NO: 13056 - protein, 670 aa, Bacteroides dorei DSM 17855
MMKIKQITYLVGMALFTTHSFAATSEKLANRDVMSVWSTPLAADENIMTQAQMKQLNKTNVAQALSTMPGVVIQKSGNRNETQVNVRGFDSRQVPVFFDGIPTYVPYDGTLDLGRFMTSELASVELSTGYTSLLQGPNLMGGAINLTTATPKKPLEANINLNQGFARGADNARNISARLGGRNDLGFIQLSGSQYKQRFMGLPDSADNNPLAGSHGRRTNSATDDKRLMLKMGWTPRDADEYVVTYLKQDGDKNSAPSADNKKQQIWQWPEYNKESIYFNGTTQVTNDIALQSRLYHDKFKNTLHQYKSVQDYRAGKYNYSHYDDYSNGADMRIDFTLREIDMLSFAAHWKEDIHRARSNKIVPYDRYKDQTWSIATEYQWVATDQLDIIGGLGYDWRNSDDGKRYLYNKQNVVTGIESYEDNRQRAFNWELMARYHRANNDTVQFSVSDRSRFPTQKERYTKNKMKNNDSFIINPHLDAERALTFDLTYKGYLTADWSYNASAYYNHVSDAIMAHYIHYDPAAGSDVYQNRNSGKVNYAGIDLGSHGQITDWMAAGLSYSYIHADPKHDSVKHVAELPTHKAFVWIKFMPNEPFSITVTEEARSWAFNYIDSNEKVRGFAKTDIRFNYDLGHGISINSSVNNLFDKSYQYTSGYIEEGRNYWLGFEYNY

SEQ ID NO: 13057 - protein, 802 aa, Bacteroides dorei DSM 17855
MYVLLLLGLLSMAWSNIGLCANSPNSFSELPSPENFSFDKFNNISLKLELVINQRATGHIAEVERIGEQYFLQRQDLIAVGVTAKSLPGTEDRIDVSSIPGVNVRYLQSSLQLAIDVPPNWLPMQSLSAHDMGRFSPAKFGRGGLFNYNVFGVYENESQQKEVSIDHEIRAFSEFGVFSTTGIFKSNFHRDVQSQQSSQYTRFDTGYEYANQERRLRLEVGDYIVRPLSWSQPVRMAGIQLSHDFSMRPDVVTTPLPAFYGEVTAPTTLDLFINGFKTDSMAVGPGPFVINDIPMISGAGEATVIATDAQGRQTVMTSPFFLSSDLLKTGFTSYSASIGALREDFGNASNEYGAGGVVVAMRHGMTDWLTLETQAEAKDDLIVAGLGFVSNAFNLGTVDASFRVSNFKDQSSSYALSYSYQSRLFSFAARTQVEQADFYTLSHLPNYEKLNKGEEASLKSRHVSQVNMGVRLGDWGSLSGGYFDIQQTDSSSRTLNLTYSYALPFDINMSLSYNHSIGGQAVTLAQFSLPFGSLGGSAGLTLKREDDGDVRGRVGYSRLAPIKGGWGINLAHDLNEDPENRKQADLTYRASWAQFRGGLNGTSGNYDYFAEMAGSVSTLDGKIFPANEVYDSFAVVSTSGFDGIPVKYENQIVGVTDEDGYLLVPWATAYYTAKYEIDPLTLPANAAFSTTEQFASIHAGYGYLLEFPIELQIALSMTVVDENHLVLPLGTFGRSETGLVSQIGWDGFTYFEGLDPGSYILFYPQGQSPCKVSIEGLYERDSQKIQILNSQVCLKTEDEAAL

SEQ ID NO: 13058 - protein, 1138 aa, Bacteroides dorei DSM 17855
MENTTVQEVLTTIEQKSGFYFTYNLEQVKVTRKVTVNFKDKTVPEVLDELFAKENIHYVINDKHIALYKGNERQVALQAKKDIKGVVTDKNGEPIPGANIIEKGNPTNGTITDVDGNYTLSVFGNSVLVASYIGYNRIEIQVKDRSVVDITLSEDTQALEEVVVVGYSTQKKVNLTGSVSTVNFESMSSRPVTDASQALSGASPGLQIMQSSGQPNAESFSYNIRGVGTLNSSSPLILVDGMEQSISMVNPSDIANVSILKDAASCAIYGNRGANGVILITTKNGTEGKISVTYDGTVSYNEPFKIVHTISDYVQYMKLMNESSNNLGNSDIFSQSSIDLWEAAKADPNGISASGYPNYVAYPNTDWWDEIYTKQWMQKHTISLNGKEKKTGYSMSFSYIDNPGIMKNTGYNRYMGRVNLYSDITDWLRVGTRTSGNVTDQEVSVTSYNGSSHINSMNTEKMVPCIYPYYDGKYGAPEGPEEDPQSHNGLWDNVLNGFDKYSQLYTEWYAQVKFLKYFTYNFDFYYQDLRRERKVSDASIGKFSFSKGAYSTGADDPSTLYTRMYYTRTNRTKLNHLLNYNQSFGIHDVSAMVGYEEETYDYRETNVSKLGLTDAAVNDLDAATTPYSTAGYGTEYAARSVFGRANYAYKSRYLLEFNLRYDGSSRFSPDYRWGAFPSFSAGWRMNEELWLKPVQWLTNLKLRASWGKLGNNAIGNYDWQSVYSAANYSTGQALTSGIAITSIANAALTWEETAVTNVGLDFGFFDNKLHGNIDVYNKLTTGILYTPDMYMVMGNATAPKANIAEVTNRGVELELGWRDNIGRDFSYSIKGQFSFNKNFVSKYKGKLEKGWNKGHTEYSTNIGDVSTGSTTRVIEGRQINEFYLPNVYNGNGSYFNADGTVNINGGPKDGMIRTENDMQWLQAMQAAGYTFQPYNNIAKNALWYGEYIYADANGDGVYGNSYDSEFQGTSTTPKYNFGIQASANWKDFDFSMTWGGSAGFSIYYYGKARNSSETTYGYAIPDAVANDHYFYDPENPSDPRTNQSSKQPRLVNVSGAQSSASSSLHLEKGNFIKLRNLTLGYTMPKSISKKFYVERLRVYASGENLFAITGFSGMDPEMRVSMGYSTMRQYAFGINLTF

SEQ ID NO: 13059 - protein, 789 aa, Bacteroides dorei DSM 17855
MNLKECFIHAPLALAISAAFSAQVSADQTSPDQENDTSNDQATAYFESVVVTGQKTERSLQDTVDSVKIIDAEQLEDERLTDIYDVFDRSPNVAQVTGTGNSFTIRGIDALGVSGGGNSYLASMYLDGAPLSYRALKQGTSVWDVSQVEILRGPQSTLQGRNSLAGAILIRTEDPTYDTDAKARLIAGSHGRKEVAVAAGGSIIDDELAFRIAAEKREFDGYIENPNRDENANYSEGHNVRAKVLFEPNAIENLKVLFTHHQNDDEVGVPWQSLNSPDRYDDPQVYFNDRTREKVKGQHNILDASYRINNNLTFNAITSHSDVDYHYDWDGDTGADLNAVLIDDRNEETLTQEFRINISYDNLTGVVGAYYSDLAVDDFSKGNRLINLAEYGINADALIALGASQGVTLDENTAAFLTSQYPEYGELYYESGFETDVTTQALFADFTYSLNQNIDILAGVRYDTEEQGNQSSDVVTLETDLPDPAAVGAQVEQSQGAAAGQQAAGAIQLINGYLVNFVDGANGTKPPVDDDFAAWLPKLGVTYHFTDDVSSSFVAQRAYRSGGVGVNLAEGRVFTYDPEYVNNYEFSTRTMWLDGMLSANTNIFYLDWTDQQVEIRGDKGQFDTDTVNAGESNVKGAEIELMYYDGMFSSYFGLGHSRTEFTKFMDDEDNLEGRSFTNAPEWTANIGATYRTLNGFILNANANYQDSSYVRVNPNLGQGTTFDPKNDARTIVNTSIGYEWSKFKITLAVDNLLDEEYVLAASRDPSQRTASEVIGAPRTYSVTLQASMW

SEQ ID NO: 13060 - protein, 1028 aa, Bacteroides dorei DSM 17855
MKNNNTPAQSGGGFRLKTLNVALLCAMATWGSAHAAPYVESGRAGDPGSWRSAEFQADWGLGAIGADHAYAAGYTGKGVKLGIFDQPVYAAHPEFSGSNKVITLVTSGIREYTDPYIPVKAGDAFRYDGSPSVGSDGKLGAHGTHVGGIAAGSRDGGPMHGVAFGAQIISADNGDPGPEDGIVRGNDGAVYKAGWDALIASGARIINNSWGIGITDRFDLGGRDPAYPHFTVNDAQLQFNEIRTLLGTKPGGAYDGAIAAARSGIVTIFAAGNDYNLNNPDAIAGLGYFVPDIAPNWITVAALQKNPDLASANPYIMSTFSSRCGYTASFCVSAPGTKIFSSIIEGTNADNLTTGYKNYNGTSMAAPHVAGSMAVLMERFPYMTGDQVASVLRTTATDLGAPGIDALYGWGMINLRKGIDGPAMFVTEQDIPEEFRIQGAYGSGQFVADLPGIGAIIDAGKPTERVCNDITCGLDTWRNDISGHGGLTKQGIGTLVLTGNNTYSGPTLVNQGRLAINGSLQSAVTVNDGGILGGNGRIAALTANRGGTVAPGNSIGTLNVAGDVTFAPGSTYAVEVSPTSSDRIVAGGKALIEGATVTLSLENSPTLLTTGEVKSLLGTQFNILQAAGGIEGQFGQVLPDYAFLGGTLAYSASGVQLDVGRNGASFASVGLTPNQRAVGTAAERLGAGNALFETLLLSPSAAAAQDAFQQLSGEIHPAIGTLLINDSRYLRDAVGERLRERDLFDAGAPTDDRSNAWLKVLGAWGKSDGGSKYADSTSSIGGLLAGVDGLIAEDTRLGFVTGYSDSSLSMGEGTHSSASIDSYHLGAYLGHQIDALRLTAGAAYSWHRIDVKRDLQFGGVSGKQKTKRDATTAQLFTEAAYDLGLQPMNLEPFANLAYVHLNSDSFTEKGDAAALKGGEDNRDVVLSTLGVRAKRTFALSEKHQLELGASLGWQHNLSSVDSDSHLAFANGNSAFTVQSVSMDRDAAVVGVRAGLALNRDVRVNLDYNGLIGSNEKDHGVGLTLDWQF

SEQ ID NO: 13061 - protein, 1182 aa, Bacteroides dorei DSM 17855
MKNILYQESIVEIKHLFRMMRNTLLALFVFAGTAFATESYSQTMKVTVVADNMSTGKVISEIEKQTDYLFVYNVNEVNLKRNVKVNAQNKSVAEVLNKVFEGTDIYYAMEGKNIMLMSKAKDGEVAQQANKVTGIVKDTNGEPIIGANVTVKGQSIGTITDIDGRFVLDAPKEAVLQITYIGYVSQEVKVSGKREINVVLKEDSEMLDEVVVVGYGTMKKKDLTGAVSQIRPAELSNEAPKTVQDVLRGTAGLRIGFDGSAKGGGSMQVRGQRSVYSDGGHNDPLIILDGMIFYGELSEINPNDISQIDVLKDASSAAVYGAKAANGVIIVTTKKGRSEKPVINFSANIGFVTIGDSRKVYDSHGYLKYREDFYTTDTYGINAQTGNYEAYQTGNTPVGYYSRPTETNLNKYGITLEAWKAQSNQDGSMSTEEIWGRRLGLQASDITLNNFLLGKTFDWYDHSFHTGLNQDYNVSISGNNEKVNYYLSLGYLSNEGVARGNEYSAIRSNMKLNAQITSWLNVGANINFQNRTDGDIATNWESQILDNSPFTSPYNENGELVPHPMGENAYWKGYNFDYDRQYLDLDKGFTVLNSILTAKVTLPLGITYSFNVSPRLQYFHDRYYRSSEHPDWQAETDDRVNREQSKRFDWSLNNTITWEHIFAEKHHTILTLVQEAEERQSWADRIEARNILPSEALGFHGTANGDKNLSSFRSTDTRETACGYLARLFYSYNDTYMATFSFRRDGYSAFGTTNPYANFFSGALAWTFTNENFWNWKPLSSGKLRVSFGQNGNRSLADSYIALANLSLGKYTQGYINSASGALMDLKYLFVSRLANPNLQWEKTTSWNVGLDVGFFNNRINASMEYYVMPTTDMIMNQSLPDFTGFNSITTNLGRIENRGFELSINSRNIEKANFQWETGFTFSVNKNTIKKLYGEYETIVDALGNTIVKERDDVTNGWFIGHPVSAIWDYKVTGIWQKDEVKEAAKYSQRPGDPKVQNIYTDDDKVNADGSVTPVYNNKDKQFMGETTPPIHWSLRNSFTIFKDWVFSFNMYSYMGHKSLDTNYLNNDNNYSQITNCRNVYTKEYWTVDNPSNTYARLSAQGPTGISAPARVIDRSFIRLENISLAYNIPMKFLEKYKIQNAKIFTTVRNVATWSKEWEYGDPETGGLAPRTYSLGINLTF

SEQ ID NO: 13062 - protein, 842 aa, Bacteroides dorei DSM 17855
MTWTHLPLGNKTSRFTQSALALMIAGTLPAYAGTFNPRFLEDVPGIDQHVDLSMYESNKAEHLPGKYRVSVVVNEKKMESRTLEFKAATEAQRAKMGESLVPCLSRVQLEDMGVRIDSFPALKMAPPEACVAFDDIIPQAASHFDFADQTLIMSFPQAAMKQTARGTVPESQWDEGVNALLVDYNFSGSNASYDAHDSETSYNSDSYYLNLRSGMNLGAWRLRNYSTWTRNDGNNTWDNIGTSLSRAIVPLKSQLTLGDTSTAGDIFDSVQMRGVQLTSDEEMLPDSQRGFAPVIRGIAKSNAEVTVEQNNYVIYRTFVQPGAFEINDLYPTSNSGDLTVTIKESDGSEQKFVQPFSSVALLQREGHLKYSLSAGEYRAGNYNSAEPKFGQLDAMYGLPYGFTVYGGAIFSDDYYSLAGGLGKNFGYIGAISIDVTQAKSKLANEENSEGQSYRFLYSKSFNSGTDFRLLGYKYSTSGYYTFQEATDVRSDADSSYSQYHKRSQIQGNVTQQLGAWGSVYFNVTQQDYWNDEGKQRSLNAGYNGRIGRVNYSVAYTWTKSPEWDESDRLLSFSMSIPLGRVWSNYHLTTDQHGRTNQQLGVSGTALEDHNLNYSVQEGYGSNGVGNSGSVNLDYQGGVGSASLGYNYNRDGQQVNYGLRGGVIAHSEGITLSQPLGESMAIISAPGARGAHVINNGGVEVDWMGNAVVPYLTPYRETEVSLRSDSLNNQVDLDTASVNVVPTRGAIVRARFDTRVGYRVLMNLTQANGKAVPFGATATLLDTTKESSSIVGEDGQLYISGMPEKGALQVNWGKDQAQQCRVAFTLPEQQDNTGVVMANAVCR

SEQ ID NO: 13063 - protein, 451 aa, Bacteroides dorei DSM 17855
MKKLLLISAATLIVSNSTFAGGILTNTNQHAAFLRMLSRGATTEIDGALSNPAGLAFLPKDGFHVGLSIQSAYQTRNIDASFMTYNGVNATGPTVADKPFEKYYEGTAAAPVIPSLFAAYKKGEWTISGFFAITAGGGKASFDDGLPMFDASAMAGIFQEGLKAEKPTVITPDMYDITSAMDGKQYIYSLQLGLSYKATEWLSVFGGGRMNYFTGGYKGFLNAIVKGTDTNLLPLALDCDQTGWGLTPVIGVDAKLGKLNIGAKYEFKTNLNIENNTKNLQYPPSAKDMVAPYEHGVNTPNDIPAMLSIAAAYEFLPVLRASVEYHFYDDKNAGMANGKQKYLTKGTNEYLAGIEFDVTKQLTLSCGGQITDYGLSDNYQSDTSFSCDSYSLGVGAKIKMNKHLYLNVGYMWTNYEDYTKKSTNYNGTGLPGTNVYSRTNKVFGLSADYSF

SEQ ID NO: 13064 - protein, 702 aa, Bacteroides dorei DSM 17855
MSTKDIFRVSLIQIAILSVFTQTVYAEESTPNIEHLEVKGIRQPFRGDVPLKAQPQAVESLSMEQISDAGISTLMDALDLSSSVNRQNNFGGMWDSFAVRGFVGDENVPSGYLVNGYDAGRGFGGTRDTANVESIEIMKGPGSALYGRAEPGGTINIITKKPKFFQEGYLQASAGRWDNYRLEGDYTNAITDDLAFRVNGAIEDKGSFRNPVNSEKRILTPSLLWVASDTTRLSYELEYTNQKVPFDRGIVAIDGDIKALPIDRYLGEASDGATQIGLLAHQFTLEHDFGNWSLLSGISYRDTGLEGYASDPELVKSRQMLNIDGETLSRQHNYRNFTSTDLSGRVELSGKVETGDISHHLLIGADGYHFHFDKYWERFRPAAGDTTYSINVYNPVYGQIAPEGALLYNQVETQDNYGIYLQDQLDLSEKWKLTLGGRFDSFEQSIENHKNQTESNQTQNVFSPRAGIVYEWQPWLSLYGSYSEGFRPNTGSDYRGVAFEPEESKSYELGTKFELENLTGSIALFRAEKSNVLTADPVNSGFSAALGKADSQGIELDLAAYLTADTQLLLSYAYTDAKTANDILNADWGVSIPEGSRLINIPKHNGHLTLKHDTSLFGSDASAGATLLYVGDRLGETIDPNYILPAYTLVNLFSTYALNQDLSLQFNITNLFDEVYYQSSYSSMWTMPGEPRSYKVSVRYNF

SEQ ID NO: 13065 - protein, 210 aa, Bacteroides dorei DSM 17855
MIKKLFLTCFVYCSLSTAWAEESPWTYRIGMSNIAFDTSAKVYLDGHRVPGGSADASNNNALTFDFGYAINDQWNARLIVGIPPTTKVKGAGTLPGIQLGKITYAPTILTLNYNLPAFGPVRPHIGAGVNYTRILESKDANLKSFDADHAWSPALHVGADIDVSRNWFVSIDIRKLYLKTDASGYLGPQEAKAKVTLDPLITSIAIGRQF

SEQ ID NO: 13066 - protein, 1089 aa, Bacteroides dorei DSM 17855
MKEKTNLFPSLIRLRETSRLKMAIAASIMLWCATPQQATADTNEEHAIEAVQQAKVKVKGTVVDETGEPMIGVAVKVLANNTGTITDLEGKFSVEAPLGGAIQISFIGYKTVTVKASSEPISVTLKEDSQQLDEVVVVGYGSQKKVNVTGSVSMVDSKVIESRPVQNVSQALQGVVPGLNMSVGNSGGALDSSLSINIRGAGTIGEGSSGSPLVLIDGIEGDMNTVNPNDIENISVLKDAASSSIYGARASFGVIMITTKSGKSGKTRVNYSGNVRFSDAIQIPEMVDSYTFAQYFNRANTNDGGGLVFDEAALERIKNYQTGKYTDPNTPEYYGAKAGNDGKWQNYTGSFANTDWFKEFYKNWVPSTEHNLNISGGTDKLTYMISGSFLDQKGLLRHGEDQFNRYTMNAKISAKLTDWVTLNYTSKWTREDYDRPTYMTGLFFHNIARRWPTCPVRDPNGHYQQKMEIIEMEDGGKQTSQKNWYTQQLQAIFEPIKDWRIVAEGSMRTYTRKQSWAVLPIYAYDADNQPYLLGWGDNAAGYSEVQDSRESEDYFSTNIYTDFAKTFGDHNFKIMVGFNGELYRPSGLTGFGTDLISPEVPSLGLTQDNKKASSWASEKAIAGFFGRLNYNYKERYMLEANLRYDGSSRFIGDKRWGLFPSFSAGWNISREAFFEPLTQVVGTLKLRGSWGQLGNNNTSETNAWYPFYQNMPTGSASSGWLINGKKQNVAGLPGIVSSLMTWETIESWNVGIDWGLFDNRLTGSFDYYNRYTYDMIGPAPTLPSVLGASAPQINNCDMKSYGWELELSWRDRIQQFNYGVRLVMSDNMQKILEYPNKTLSLGEKYYTGKTIGEIWGYKTIGIAQTQEEMDKHLANGGKPNWGSAWGAGDIMYANIDGKDGVNSGANTVNDHGDLKIIGNSTPRYNFGLTLDGSWKGLDFSLFIQGVMKRDYMLDGPYFWGANGGMWQSCVFKEHLDYWRPEGDPLGANTNAYYPKPYFSSNKNQKTQSGYLQNAAYCRLKNAQIGYTLPKAWTKKAAMESVRVYVSGDNLLTISGISDIFDPETLGGDWGPGKLYPLQRTISIGLNVNF

SEQ ID NO: 13067 - protein, 195 aa, Bacteroides dorei DSM 17855
MNYKMKKAVFLLAAVSAFAQANTNDIEKKDVSGFYLGGGIGTTTAFDDGVGTNDLNLKSSDSTYKLYGGYQFNRIVAIEAQYTRYGDIYSKDDADRHMVKPESIALMANLGYTFDSGWRPFATVGLGRTELDFGPLSKTETSFRAGVGGEYSPKAIENLNFRVAYEVDSFMFDNGPRDDVNIVLGSLYAGVSYKF

SEQ ID NO: 13068 - protein, 808 aa, Bacteroides dorei DSM 17855
MRKNILFITSCLLAATTFAEDINTLPKDTTKVIDIEEVVVIASPKETGKLRELPTAVSLLSQKDMQANQITTLKNVSSLVPNFFMPDYGSRLTSAIYIRGIGSRINTPAVGLYVDNIPYIDKSAFDFNFYDIERIDILRGPQGTLYGRNTMGGLIKVHTRSPFSYQGTDVKLSYGTKSNYRSASLTHYHRWSDCFAFSAGGYYEGSDGFFRNSLNGKKVDNMEAGGGRIHAIWLPSENLKLDFTIGYDYNDEGGYPYYYTGAIDGYDKENEKYKNYIGKISYDQDCTYRRGLFNTGLNIEYQAQKFILSAVTGFQNLNDRMFMDQDFLPVSIYTIEQKQRLNTISEEITFKSKNNKRWQWVTGVSGFYQWLHTTGPVNFMEDGVTDMIEGNINNTFKKIHLDDPRRTPEMSLDVLNNRIRVSGSFDTPVFSTALYHQSTFNDLFVKGLSVTAGLRLEYEKMSMNYFSDSNIDFDFFLKMAMPPLNIPFRNLNAAPLLEGKEKNDYVQLLPKLAFKYDFSPANNMYVSITRGYRSGGYNVQMFSELIQSDMQQKMIEAILDKAPESMAGMIEGMIKQHMPNYGKELNVQETTVYKPEYSWNYEVGSHLSLFNGKLKTDLAAFYMDTHDQQIAKFVNSGLGRMMVNAGSSESYGVEASFLASINKNLNMNVSYGYTHSTFKKYDGGTTSSEEQIDYSGNYVPFVPRHTMNAGANYSFFFDKSNWMQSLTLGMSYTGAGKIYWTEKNNVSQSFYGTLNGRISLQTKALQIDVWGRNLTNKDYTTFYFETMHRGFEQKSRPLQLGVDIRYHF

SEQ ID NO: 13069 - protein, 114 aa, Bacteroides dorei DSM 17855
MKGNAVPDAPKVMFSVNGGWEGAHFFANFDAKYTGKRYGDTFKTDQVDATFIVNGSVGYQGEDSGLLAGGRQQLSVYTLFDKHDTIGAVFPNESSGSYQLIAPRQLFANLADTF

SEQ ID NO: 13070 - protein, 961 aa, Bacteroides dorei DSM 17855
MKDSDEIEIIAVTGMLSSIKESTRIKRDASGVVDAISAEDIGKFPDTNLAESLQRITGVSIDRTNGEGSKVTVRGFGPDFNMVTLNGRTMPASGLPAGGGVANSRAFEFSNLASDAVKSVSVYKTGKANIATGGIGAVIDIVTGKPLDNPGMHVSVGAKALMDTSNRVGDDVTPELSGLFSWTDDDEMFGASLTVNTQERHSSTSGAFVNQWRTGAFDGTIPQAADDIQLNNAPDIGQLYSMPSDLRYFITDQERERTNAQLTLQFRPVESLTATLDYTYSKQDTFQARAEQSIWMDTYKSSLGFDDETTATPIDYNEDRGDQPPRDLGLAQQELNQVNENDSIGLNISYDVNDYFNITFDGHSSTADSSPDAEYGSWVNAGLGANISAGQGVDFSNDYPTMRVDFDDCDPRRGLNCNGILDQDDVGTSILDMNYASQKTDINEFRLIGAYEFEEGSIEFGVESRSMESHSVQSLTRHTMGNWGVENPGELPADFLTPVNFTKEINDFDKNGAFNQGFTGSASQIGAWAAGEYGFDFVANGASATNRTIKEDITAAFFQLDLSGELGGRPYNISAGLRLESTDVTSSANVALPNAVAWEGNNDFNVRFGNGMQDFSADASYDHALPSFDFDIEVVDNVVARFSFSKTIARPTYDQLSAAASDVSGPTGPTSLPGVQLGTASNGNPGLLPLESNNIDLSAEWYFAETSYVSIGYYEKRVNNFAGRQPVEENVYGLRDATAGPRAQAAALALTALGEEITDTNLFAMVAATENNVDFYSMPAEDFEVQYDVLPNGEDPLMDFTVTKFVNNKEAKIDGFEFAVQHFFGETGFGFQANYTTVNGDVGFDNNGDPSVTQFALVGLSDTANLILMYENDDFQARIAYNWRDKFLNTQAQYINEPGYTEEYAQVDFNVAYQVTEQLSVFFEGINITGEDTRTHGRTTAQLWNLSEQEARYALGGRYTF

SEQ ID NO: 13071 - protein, 743 aa, Bacteroides dorei DSM 17855
MAIPVRGGAGKAPSASALASTQVVPFAHWLSGAACRSPRSAVGLAVLLALSAASQAQTPPRTVQPQEKRLSEVTVSDRQDSVGLPALAPGAQVAKGAALGLLGNVDVMDAAFNITAYSEELIRDQNAATVAAVLENDSSVRFTTNTGHVNENYVIRGFDVNASEVAFNGLYGLAPDSHVPTEMIERVELLKGPGALLGGMAPNGAVGGVVNVISKKPLAGDLTRLTTTFTSGSQLQEHVDVSRRFGPERRLGIRVNGALSSGETEVDDQKRRRRLGAVALDYQGDRFTLGLDAYHYKVNLDNGSPVMVSFGKMKNLIAAPDASNNLFRGVNTEVENKSVALRGSFELSDHWQLYGSLGKAWHDYAGQPTGTRVVLNAVGDGSAVGQTYNLQGYTNSTALDAGLRGRFKTGDVGHQLVFSFNELQQQSGRALPIVVSSSYTTNIYDPVLPVLAGPRNAVRQENDNVIRSLAVADTLSLLQHRLQLTLGARHQRVNQKMKGYDESAVTPMLGLVAKPWGEDLSFYANYIEGLSPGLEVGSTYANAGETFAPYKSKQMEAGVKWRRAGWTNTLSLFQIEKPSTTIDTAANTLKLNGEQRNRGVEWNTFGALSSSLRVLGGITYLQPKLTSTQGGSNDGHDAFGAARWAANLAADWDVPAVAGLALNARLVHTGKQWVNSANTLRAPSWTRFDVGARYTTRIADKKVVLRGTVDNVFGRNYWAGAFADNFLTVGAPRTVRISAAVDF

SEQ ID NO: 13072 - protein, 1111 aa, Bacteroides dorei DSM 17855
MRKIQISYKQRYLKYIVLLLLFYPLNILGAQGVISVKGQAMTIKQAIQLIEKNSNYTFFYNAADLKNTTNKNLNCEGTIEEVLKEVFKGSGITYMIKGNEIILKVNKEEAAQQQPKKKRTVTGTVVDAENGDPVIGATVVVKGQKDGVITDLDGNFTIAISGSKAQLEFSYIGYRKKTVDVGDLGVINVKMESDNQLLSEVVVVGAGTQKKVSVTGSITSVKGLELKAPSSSLTTSFAGKLAGVISMTSTGEPGAASEFYIRGVSTFGGRATPLILLDDVEISTADLNNIPAETIESFSILKDASATAIYGARGANGVMLITTKTGKENEKTRINVTVENSFNKPMNFPDFVNGATWMEMYNEAQLTRNPGATPKYSQLDIDNTRNQVNPYIYPDVQWKDVIFKNMNMNQRANVNISGGGSKASYYMSLQANHDTGLLDTKKVYSYNNNINNWGYNFQNNISYKITSTTKIDLHMNAQIRNKKGPNYSTSDLFAQMLYCNPINFPVTFPAQPGDTHIRFGNAIWTGSSVRTNPYAYMLSSFKEYNENTLNTSLKINQKLDFVTKGLSVQAMVNWKNWASSSYNRTIEPYYYGIKGGSYNPSNPTDYEIERLGTSGTDYLKTSDISKASDQTFYLDARVNYDRQFNLHHVTGMLMYMQREYRSSVLPERNQGFSGRFTYDYGQRYLVELNFGYNGTERLAKKERFEFFPAVSLGWVISNEKFFEPMTKYIDNLKIRGSYGLVGSDETGLSAGAQHFLYIDQVSLNNIGFTTGVDMNYTLYGPLVTNYAVVNGGWERVKKLDIGIDLELFRQLTITADYFNEKRYNILLHREAWPESLGYYTAKPWSNKGKVDNWGIELSVNWRKEFTKDLYVDFRGNFTYTENKYVNLDEPVYPYVWKTSTGKPLSRTTGYIAQGLFSSQEEIDNSPTQNLGSTVKPGDIKYRDVNGDGKIDGSDQVMISPYGTTPRIQYGLGMNVTYKKFDFGVFFNGSAKRTIMISGISPFGQSDYNVMQFIADDYWSESNPNPNAKYPRLGLTSSQTANNTVASTYWMRNGNFIRFKTLELGYKFKYGRVYLNGDNIAVFSPFKLWDPELSWNAYPLQRTFNIGVQLNF

SEQ ID NO: 13073 - protein, 623 aa, Bacteroides dorei DSM 17855
MKRQLLFIFLGIVTNTICSQNVSTGTILKEVVVVADQRIAENSTGYKIRTLKDSILLKNTESFTALLRFNAPIYFKEYGAGGTSTASFRGTSASNTAVIWNGININSINSGQTGFNSLTVSLFDQIDIRSGGGSIEYGSGAIGGTIHLSDALVYRPKKTIQNQFVASVGSFSTYRGLYKFKMSSENFSLKIGFSYNQSENDYKLLGTRFKNTNGAYHNSNTTVTFGYRTSLFSQLKLYSTNYKGTRFFSGELPNPKAANDKYKDINQRNLLVYTHEKDNISQELKFGFLTQEYQYFGDKDSDNFNFGRTKRYLSNYSIAYRLPEWHSTITSYSEYESVFGKTDGIVEKNRRQFSQSFEYQQRVQNLFSFDIKVRKDLNSDFKVPVSLALGVQSKKINHVSFRANGSKNYRVPTFNDLYWPGQGNQNLIPETAMQGEFGVVFKKNKMNIDVSVFYIDAKNKIVWIPNGDSERPGVWTPMNLANTENRGIELASNYTEVFGHHAVTANVNYAYTIAKDKRTNTFLMFVPKHLLNSSFAYRFKQVGLFYQQLFTGKTFTTASNSKDFIISSFFVANIGGDYSIIQNKNQKVSIGFKVNNVFNENYVTQPRRPMPNRNFNLNINYKF

SEQ ID NO: 13074 - protein, 911 aa, Bacteroides dorei DSM 17855
MICKIAYIFLFIICSNVSLLWGQTFVFRGTVLDEQTHKALDYATVQLFVDKQIVYGGITDANGHFELLHIHPGTYRVIVSYLGYDSTEKEVKVIGDISAIFYLKPSVMALNEVVVTASESKRATSASIVDRTAMKHLQPSSFSDLMELVPGGKSADPQMGQANLIRIRETGKTEDISSLGVGFYIDGISQNTDANLQYMPNSTSAVNATSTMSKGIDMRTISTDNIEKVEIIRGIPSVAYGNVANGAVIIQRKMNESPLSARFKADKTSKLFSVGKGIRLDGNGRYVLNADLNYLESKIDPRNSVKNYTRLTASARLDGKWLWNERNIHWNISSDYTGSFDDAKRDKDATVKEDSYKSDFNSLKIAGKWSMKFPAHLWIREVGVATSVSQQWEKMREIKSVSLNRPAAIATQTETGEFDGIYLPYNYVAQMDIDGKPLYVTASARTRLAFPLGVLQNAMNMGMEWNYQKNLGEGQVFDVTRPISESLSTRPRRFKDIPELQPFAFYAEEVLNLPVNRHKLAFTAGIRLQSLLGLDTKYKMQGKIYPDLRLDLQWSLPVSNGWDVSFSGGLGWISRMPTTAQLYPDFKYVDLIQLNYYHTNPDYRRINMMTYKWDNTNYQLEPARNMKWEVRADVSYKGNRLSITYFRERMNNAFDDITYYRSLAYKLYDPASIDGSALTAPPELSQLTYTNEYNLDVYSTQGNVMKVCKEGVEFQFASKRIESLKTRVTMYGAWIKTIYNSDSPQYKASSILLDNKQLKYVGLYNGDNGTESQAFNTNFMFDTYIQRLGLTFSTSAQCTWYTNRRNLWNNGVPVSYIDQSGETHPFREEDKNNIQLQHLVEKYSATYFERTTVPFYMDINLKASKRIGKYLNLAFYVNRLLGIYPDYTLRGVLQRRTSESPYFGMEMNLTF

SEQ ID NO: 13075 - protein, 297 aa, Bacteroides dorei DSM 17855
MKKTLLLFLPFSFWLHAERNGFYLGLNFAEGSYIKGQGSIGEKASAENALNQAINNAKNSLFPEQNTKAIRDAQNALNKVKDSTKIANRFAGNGGSGGLFNELSFGYKYFLGKKRIIGFRHSLFFGYQLGGVGSVPGSGFIVFLPYGSNTDLLIIGPTDKRASQDYVERRVKGLSIFYKDMTARPLDANPLKKVSRHIFRKSSGLVIGMDIGASTWFASNNLTPFNQVKSHTIFQLQGKFGVRYNSDEYDIDRYGDEIYLGGSSVELGVKVPAFKANYYSDNYGDKLDYKRVVSVYL

SEQ ID NO: 13076 - protein, 875 aa, Bacteroides dorei DSM 17855
MFFGDGGQLLSDKSLTGSAGGGNNRMKFNILPLAFFIGIIVSPARAELYFNRRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDTYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPDGWTVYGGAWIAERYRAFNLGVGKNMGWLGAVSLDATRANARLPDESRHDGQSYRFLYNKSLTETGTNIQLIGYRYSTRGYFTFADTAWKKMSGYSVLTQDGVIQIQPKYTDYYNLAYNKREGAGEYQPADGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTASCR

SEQ ID NO: 13077 - protein, 713 aa, Bacteroides dorei DSM 17855
MTIFSLRTPPASPSACARPAPRMLKLAVPALTAGVLSATAAAADADAPAHRADVPPDTPGMLLLPVEVVASPLSTPLVVVTDPKAPRQPLPASDGADYLKTIPGFTSIRSGGTNGDPVLRGMFGSRLNVLANGMPTLGACPNRMDAPTSYIAPESYDKVTVVKGPQTVLYGPGASAGTVLFERTTPRFERPGMRFDGSVVGGSFGRNDQNVDVTAGTPDFYGRVIANHAHAQDYRDGNGRTVPSQWDKWNADAALGWTPDVHTRVELTAGTGDGYARYAGRGMDGAHFRRDTFGLSFDKRHLGDVLDRIEARVYYNEADHVMDNYTLRQPDPASSMPMRMASEVRRRTLGARAAATWRFGDAFKLVTGVDAQSNRLDSRAAMGRQNYGDQPWDAQATMWNAGAFGELTWYAAEAARVIGGARVDYASARDKRATTGGMMTSRPNPTFDDDRARVLPSGFLRYERDLASLPVTWYAGIGHAERYPDYWELFSAKRGPAGSVNAFSAVQPEKTTQLDIGAQYKSDRLDAWVSAYAGYVQDFILFDYASGMMGPTTRASNVNAQIMGGEAGVGWRPVAPLRIETSVAYAWGRNATSGDPLPQMPPLEARVGLEYTRGAWSAGGLWRVVAPQHRYAVNEGNVVGKDFGPSAGFGVLSLHAQYNVSKTVQISVGVDNLLNKAYAEHLNLAGNAGFGYPANAPVNEPGRTAWVRVSAKL

SEQ ID NO: 13078 - protein, 1024 aa, Bacteroides dorei DSM 17855
MNKSRYVFFILACLFGLYVQAQNRTVKGRVLSAEDKEPLIGATVKIPGTSIGVVTDIDGNFSLEVPDKDKTLVIEFLGMSTLTAKIPANGVLNVSLHPDTQRLDEVVVTGYGNFSKSSFTGSANTLRGDLLKNVPVVSVEQKLQGMTPGVSISGNSGQPGANQSIRIRGMGSFNASKEPLFVIDGVPVTSGSLSGGSADAAYMNNSKTNIMSTLNPSDIENITVIKDAAAASLYGSRAANGVILITTKKGTKGRAKATLKMDGGFSNAAVEFRPTLNGEQRRELIYEGLMNFQQDEIAKNPEAGLASPTEYADLHINDYASIPELGYTDWRKELMRTAHHQSYEASVSGGNDKTTFYSSLGFNRQEGLVENSNLDRYTARLNVTQKVGSRGEVGANVMFSQLNQEMNEERGSSINPFLCVALNTTPSFPVRDAEGNYVGSYPSSNVNPLRDIRTDYNRTRMTRMFSTGYASIDIIKGLKLKETLSYDYNIQKDSRYWNPLSGAGAKSGSDAQTAKGFIEYSKLISSTSLGYNTTIAQLHHVDALVAYEIENYQTDKAMGDKSKLPSDYLVEPDNAASLNSFVSSTQDSRMISYVSRINYDYDDRYYIAGSFRRDGSSRLSPENRWGNFWSVSGMWNVGAEKFMQSIKSVLSDLKIRASYGVNGNQPGALYGYMGLYSYGQNYMGGGGSYESALPNPNLKWEKNYNLNLGLDLAFINRIFVSLEYYNRDTKDLLYNRPISSTTGFQNYLGNLGQLNNRGWELELRTINFAGNNFNWTSVLNMTHNKNKIVSLDGKLDQSIEGSWFIHKVGLPYSTFYVKEYAGVDPQTGKALYYMNTQDANGNYDRTVTTDASAAQAIPYKSVDPKISGGFTNIVNYKWFDLALTLTYSLGGYSFDKTGTYNETDGAKEQNYNLPIYELDRWQKPGDVTDVPRFVLGQAAGPQNSSRYVHSTDHLRVKNLTLGFTLPDQWLTKLGVSKARLYFSGSNLLTWAKWDQYDPEVPVSGEVFCETPPMRTYSFGIEVSF

SEQ ID NO: 13079 - protein, 678 aa, Bacteroides dorei DSM 17855
MKSLSNALFSLFLKGFYFTFFMSLLFVFNRIGFILYTGYYKHALKNPVFDEIIKTLFNGARYDNRVVSSLAILFIIIGLLGLFIPKHQTKMLNIVAYFSIAIILFLNIANIVYYGIYGNVFDENLLEFLHEDTLTILKMSGEYPIFSSFSLFLILSVLTSFIYFKLQNDLFKPKNAYQAAHTKPLKTFILFALFSLTQMFYINAQLSFVGASLDLSIEPAKDPFLMKITPGAFRNLYLLARNYRQSHNLKFSDFAKETPLEVAKNYFHLKENPSNNLYELLTQTSRNNSNQTIQHVFYIVSESLSSWHFDPKFDAIGLTSALQDLVKKEHAHMLSAFIESAPRTVKSLDVQITGLPYINDNNLVNSGVILPSFPMAIGNITKTLGYKNNFYYGGSGIWNKLTSFTKKQGFHALYFNNHLLEFAQNKPYPKPIESNWGVHDNILFDYILENTNPHEKTFSMVMTLSNHAIKNVNLKAFGVPLEKIQQFVEKTPKSENLPDANSLGHIYWYDKVIVSFIKKASQKFPNSLFIITGDHFDRSYEYAKNDLYIIKSVPLILYAPTLKPKKISQVGSHLDIAPTIIELVAPKGFQFVSFGKPLFSNNTTNPPSHPNYALGYEAIATKDYFYNPSLGLRYLNESPKEPKDKQNDKIEASKFYQQLESLKALSYYLLYHGANLKD

SEQ ID NO: 13080 - protein, 1117 aa, Bacteroides dorei DSM 17855
MDKKHNYTNHGKSSKRLWITFLFFCIITTGFMQAANKVFAQATVTASFKNATLSEILWEIQRQTDFTFVYSTNDVKQIKVQNLNVNNEKIANVLDKCLMNSGLTYSVHNGVIAIKQIEEKESAVPQQKTTLTGTVLDETGEPIIGANILVKGTTNGTTTDLDGHFSLDVDRIPATLIISYIGYGKQEIKATAGKILKVVMAPDNNVMEEVVVTGYGTFKKSAYAGSASTVKADKMKDIPAVSFKDLLQGNAPGVQFSSSSGQPGASSSLNIRGMGSFNASNSPLYVIDGIPMRSGSINTMSSDAGLDIMSTINSSDIENITIIKDAAAASLYGSRAANGVVLITTKKGKSGKPQISFKADWGSSDFAMDYRPVMGGEERREYIYNGLVAGALRDGNSHDEAIAYANENIDDYAPVPWCGYVDWDDIMFKKGNHQTYEASISGGTDKFKYYSSISYLKQEGIAINSGLERISGRLNVDYQATDKLKLGANMLFATVNQDVYGEGTSYTSPFYSSRNAVVPSDTPYNEDGSWNRDFIRNGDRNPLLSATYDYQREYVNRAFNTIYGEYEFIKNLKFKSTFSYDYTNTKGKDWSDPRTSNGEDVNGGMSKKFYEYKKMVWANQLSYKFNIANDHHFDALVGYEIDDQYRDYLSGYATNFATADKDEISNGMKTESVGGSSTRTRMVSYLTRVNYDYKNKYYLGGSFRTDGSSRLHKDSRWGSFWSVSAAWRMIEEEFMNPAKGWLTDLKIRASYGVNGTLPSDYFGYMGLSSLTNGYLEQPGIIQSQIKNTDLKWETNYNLNLGLDFSLFNRINATLEYYTRTTKNLLMDRPISMTTGFGSYLMNIGEVKNKGVELEISSTNIKTKDFSWNTTFNISHNKNEIVTLDGMQTEIISGTQIRKVGKSYRTFYMIEFAGINPETGAPQFYTNDLDENGNYIKEITEKYSEANAIVLDKHAEPNVIGGLSNTLRYKWFDLNFMFSYQFGGYSYDNWAQKTEHGGNDLEANIPTYYRDSWKQPGDITKYELFIESPDVAMNKSTTTRRLHSSDFIRLKTLTFGITLPQVWTQKIGVNNVRVYASANNLWTWAAYDYYDPEAVSGGSAIWGTPPLKTVTFGLSVNF

SEQ ID NO: 13081 - protein, 335 aa, Bacteroides dorei DSM 17855
MRIRTTVWKVAPAIIAMTSEVALAQSNVEVFGIVDTAVEWARSGDGVNVNRLVSGQNSASRFGMRGSEDIGGGLKANFWLENGFNTDTGALSDSARLFNRRATVGLSGPWGRVDLGRQFRPEARAVFGMDPFDGGSTASPSNTYSNTVFRTDNAVVYETPNVNGFVGRLMYAFGEAPGAFNGANNDVGASLQYYNGPVYLAYAYDARTNATNSDKRRWHSLGGAYDFGVAKLYAAYRTRKEGAVGLDESSYWLGVSVPLGAWTLSATATRVNDKTPADKGATGIGLGADYALSKRTTLYGRFGKVNNKNGATFNLDNGINGPSPSSLALGLRHKF

SEQ ID NO: 13082 - protein, 777 aa, Bacteroides dorei DSM 17855
MKQYILLLVLMVMGAGIHAYAEDVNPVKEGNVISGHVVEKGTENSLPYATILIVETGQGTVSNEDGEFRFKKVPAGKYTLRVQLLGYETQEKKVTVSNDFTVDVHFLMSDESIMTDEVVVSANRNETSRKVAPVVVNVMNARLFESVNSTDLAKSLNYQSGLRVENNCQNCGFPQVRINGLEGPYSQILINSRPVVSALSGVYGLEQIPVNMIERVEVVRGGGSALFGANAVGGTINIITKDPINNSFQVSSTMSNMNGKVWEQYMGANASLVSKDNTYGIALYQSYRNRNPYDADGDGFSELGKLNMNTFGLRTYYRPTQFSRISLEYHTTNEFRRGGNKFDLQPHETDITEQTKHVINSGGLSYDLFWKEYKHKLSFYSSIQHTDRNSYYGAQQDANAYGKTKDLTWVAGGMYVGNFEKVLFSPATFTAGLEYQNNSLHDVMTGYHRDMKQDVRIASAFVQNEWKMNQFVFLAGFRLDDHNLIDNPIFSPRLNLLYKPSDKLQARITWSTGFRAPQAYDEDLHVTAVGGEGVLIKLAEGLKPEHSNSISGSIDWTANIGHFQTNLLLEGFYTGLDDVFVLEDMGHDQNGNKVKERRNGNGARVYGVNLDGKIAHGRDAALQVGFTVQRSEYTELEAWSENPEVAPVKRMPRTPDYYGYFTLTSAPFKNFDCSLSGVYTGRMHVPHFAPTELPEEYIGQYIAKDEMVHTPDFFDLNVKLNYTFVLNDHIKLQLNGGVQNIFNAFQKDLDKGGYRDSGYFYGPTQPRTYFVGIKITN

SEQ ID NO: 13083 - protein, 248 aa, Bacteroides dorei DSM 17855
MVKRMILLGALGVVASAEESAAFVGVNYQVSMIQNQTKMVNDNGLQKPLIKFPPYAGAGFEAGYKQFFGKKKWFGMRYYGFFDYAHNRFGVMKKGIPVGESGFIYNSFSFGGTTLTERDSYQGQYYINLFTYGVGLDTLWNFVNKENMVFGFVVGIQLAGDSWATSISKEIAHYAKHHSDSSYSPANFQFLWKFGVRTHIAKHNSLELGIKVPTITHRLFSITNEKGYTLQADVRRVYAFQISYLRDF

SEQ ID NO: 13084 - protein, 865 aa, Bacteroides dorei DSM 17855
MRNHLKHFLLLAVLTICFTATAVAQGTVKGKVVDAENNEPLIGATVSVSGTTLGTVTDIDGNFVLKLTSSKATLVFKYLGYNEITHQVKGSNTIDLGEVKMSPDAIGLGEVSVIASIIKSDRQTPIPISNVKLAKIEEKIGNLEFPELLKSVPSVYVTRESGGYGDSRINMRGFDSSNLGVLINGVPINGMENGKVYWSNWSGLSDVSQFIQVQRGLGASALGISSVGGTMNMVTKSTEAQKGGSAYFGIGNDGFRKYSVSFSTGLMDNGWAITFMGALNTGDGYVKGTNYEGWTYFGNISKVINDHHKLSLTAFGAPQWHNQRSTMHYIEDYKNSPDGGRFNNGYGYINGEAVGSGYGYNYYHKPQVSLNHYWTIDDKSTLTTSLYGSMATGGGRRARGAMSNWLTIDNNTGRPKDGAMMTPDGLFDYERAMAANAASQNGSQVIFTNAVNDHDWYGMLSSYKNHLTENLTLTGGVDLRYYKGYHTEEIDDLLGGEFYLQTSPLAFQTKNQLLKVGDKFNYYSIGEIFWGGVFAQAEYNTDKWSGFLSASLTEEAYRYDDRGGTDSRYSATGADKLDRVSSLQNFLPWSVKGGFNYKFNDNHNVFVNAGYFTRAPFFNSVFASNTAAPEKDVPYEKITTFELGYGFSTEQVNIALNGYYTQWMDKSLRRKIGQEYANLTGLDAVHMGVELEATYRPVKSFELKGMFSLGDWKWKDDIHFTMYDEANNPIGTYDAYLKDVHVGNSAQLTSALSASWEPFKGFKISADYNFFGKNYADFDPQNRVNEADAGIDSWKLPDYGTIDLGMNYRFNITKDIRAIVYSNVYNLTNTEYIADAKDGTNHDWKTALVYYGFGTTWSAGFKVIF

SEQ ID NO: 13085 - protein, 679 aa, Bacteroides dorei DSM 17855
MENDLFKPHPLVLSLLVALSCSSVAAETNPAAQLNDDDVITVTAPVLSPLEVVTSPKTPRQPVPASDGSDYLKTIPGFSQIRNGGSNGDPVFRGMFGSRLRLLTNDSEMLGACPSRMDAPSSYISPESYDLLTVTKGPETVLWGPGNSAGTVRFEREPPRFDKAGIKGNASFLAASNDRFDENADVSFGNEDGYVRLNGNNSTSGDYKDGNGDRVASKWDKWNTDMAIGWTPDADTLLELTAGQGNGDASYAGRGMDGSQFKRESLGLRFKKENIGEVFDSLDMSLYYNYANHIMDNYSMRSSSDMSSGTMGGMPMGTMDMSMPMNKQVDRRTVGGRMMGTWLWSDFQLQSGVDMQTNTHRSNEEDEDAGWQEDARFHDYGTFGELTWNATDLSKIIGGARLDKVEVDNYSGVGSSSRDDTLPAGFLRVEHNLGSAPAMVYAGLGYTERFPDYWELFSPTYGPVGTSDVFDNLKPEKTTQLDIGAQYKGERTTGWISAYVGRINDYILFLYDPDDSHVSQADNVDATIMGGEMGASYQLNDQWKTDATLNYSWGENTDDNQPLPQMPPLEARLGLTWEKGDLSSTGLLRMVSPQHRVALNEGNVVGKDFDQSAGFAIVSANAAYKVNKNLKLSSGVDNLFDKSYSEHLNLAGNSSFGYSSDTPVNEPGRTFWAKMNVSF

SEQ ID NO: 13086 - protein, 1070 aa, Bacteroides dorei DSM 17855
MRKDMKKCPKPLGYGIRRTPVVLGLSAALCMPAAFSYANVGGRMDSESVQSVLQTHTVKGTIVDETGEPLIGVSVIVKGQATVGTITDFDGNFVLDIPTGKGMLEVSYIGYKTQTVTIGKNTQITIKMEPDTQALEEVVVIGYGAVKKRDLTGAVSSVKNEDITLTPATNPMQALQGRVAGLDITQASGQPGEGPKLQLRGTRSFTASGDPMFIIDGMPGDYSTLNPNDIESIEVLKDASSTAVYGAAGANGVIIITTKSGKAGKININLNAYVGFNGWATVPEMRSGDSYINVLREANQIAGTYSTDEALFSSPEAYKAHLNGQYIDWADELLQTGVTQNYSLSVSGGTEKTKAYFSLNFSDEQGQFTGDDYKVYSTNMRIDHEIKKWLSVGVNMQGSYVYRNKAYSRFINSLVSVPLGTVYNEDGSINVTPVPGDGNTINLLLNQDKSVYRDNNQNFKLFLNPYIEIRPFKGMTIQSRLNASLGYDKKNYFQGIGSYQYYASDGPNASGTSASVYAQIDQNRSYNYKWENIFTYNFNIKKDHEFTVTAVTSWNHNQTDKSWQKQDNIKNNSYLWHNMDGTGIVYSNYTMSKGLGLVGRINYSYLGKYLFSASVRQDGSSRLAKGNKWSTFPAVSLGWRISDEKFMQGTSNWMNNLKLRLGYGVTGAASIDPYSSVATVELDGYYSLGGQKTNSYKFSENVANADLTWERSHNWNIGLDASFFNNRIDLSADYYITNTDGVIWKQNLPVVNGAYNASKLYYMSKNIAKTQNHGLELTLNTRNIVNKEFTWTSALTFTLNNEKVKSLIGGTADHVKNEDYYLSIGYPVNSFYAPKIDGMWQLGEETDAAAFGCAPGDIKINVPGMIKEADGKFYKVGDDGQPLTDKNGDIIYYTKDNKYTYSDADSQVLGHNAPKWTMGFQNSFTYKNFDLTIYAYFRWGQMINYEMLGWYDSTGKGNFPTYFNYWTESNPSNDFPALNANRETKSYIGYGSLNYVDGSFFKIKNITLGYTFPERLLKNAGISKCRLYATITNPLTVAKSHLLKDYDPEMNGALKYPLSKQLVFGVNVSF

SEQ ID NO: 13087 - protein, 1034 aa, Bacteroides dorei DSM 17855
MKSMKKSPKQNWESNIRRTPIILGLSAALCMPSAFSYANASDPVAGELVQSVQQGRTVTGKIIDDTGEPLIGVSVLVKGTTVGTITDFDGNYSLEVPSGKHILVISYIGYKTQDITVGKSNQLNIKMEADTQALDEVVVVGYGVMKKRDVTGAVSSMKNKDVVIAPTNNVMEALSGKIAGMDIMKTSGQVGEDVEILLRGSRSIYGDNTPLFIIDGIPGSYNQINPSDIETVDVLKDASSTAIYGSAGANGVVIITTKRGAVGKATVNFDAYYGFSGTPDYYHGMVGDEWTRYQRESYKYINGQYPADMSAILTDPVKLEAYNQGKWIDWVDEAAGNTATTQKYSLSVTGGSEKTKIFASAAYTREEGLLSNDNMGKYAMRLNVDQEIFSWAKIGFTSNLTYTDRNQGVKNTFTKALSVFPLGDAYDKDGNINHEYAPNEYSPLGDFIPNQYVNNTKGTYINVNGNLELTPLKGLSFKSVISATLNNSRAGTFLGAQCNANLPTYASSPHASILNSYTRGYTWENILSYNMTIAEDHSVGGTFVTSWSHNQEESNMAAGSGQDLDSWSFWRLTSATSPHVESDFSQTQKLSYAVRFNYSYKGKYLFTFSNRWDGVSWLANKWDSFPAAALAWRISDEAFMESSNDWLSNLKLRIGYGVTGNSGGIGAYGTLTNAIIYSSSGISIGGNNVPFAQYTGTYSNPDLGWEKSHNWNIGVDFGLLSNRIDGSIEWFTTKTKGLLFKRTLPVTTGNTGWGRPLDIWENLAETSNMGVEATINSHNIKTKDFSWDTTLSFTWSKEKINSLPTGDLIKENLFEGQPIHALYDYKYAGIWGSNVPQETLDAYGVKPGWVKIETLDKDGDGGVHKYGEDDRQILGHTNPDVILGLNNTLTYKNFDLSIFAMARYGQTIKSSLIGWYRASSNYSINQPAGVDYWTENNQGAYYPVPGSGDEQKVMSALTYRDGSFIKVKNITLGYTLPQSVSRKVLMEKCRFYATAYNPFLYVKDKELRGTDPETNGSDAFPLYKQFVFGINVTF

SEQ ID NO: 13088 - protein, 469 aa, Bacteroides dorei DSM 17855
MRNMKKVLVVGLALLGSLVVGSTGAQARNPEFALPEKVEVKHKACQEILRLAATYQVEGLFSKEFEAGQVCYTRTDLAVVLELLTEKLAEKVVKEGSAAVAKEDLVLLAELQDELRGEMLLARTRTFQQRREGLGTRLTAITKNISLSGGLVGVLQGSIGNEPSDHVDVVGRGDLVFSFKVGENTIAVIDVEATGGNGIDTRVPSFSLLNAVAGSTGDTVRFREAWVEHAAFDERLILTAGKIDLTNYFDANGVANDENSQFLAGAFVNSAVLGAPGNGPGARLQAKLGEPLTFGLGYGSGDTDTEDVFSHGYGIAELDYTLKVGELEGNYRVYGSLDGARADGEVKLQEKNAFGFGISADQQVTDKLTLFVRYGQRDEDVYATKMAWSAGGQYAGLLPERKDDVLGFAYGQVKAVGADSQEKLAELYYKVQVNEQISIAPVVQYLINPLGDSSRDDVVALGLRSLISF

SEQ ID NO: 13089 - protein, 1017 aa, Bacteroides dorei DSM 17855
MKRMTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLGYGTGQKLSTVSGSVAKVSSEKLAEKPVANIMDALQGQVAGMQVMTTSGDPTAVASVEIHGTGSLGASSAPLYIVDGMQTSLDVVATMNPNDFESMSVLKDASATSIYGARAANGVVFIQTKKGKMSERGRITFNASYGISQILNTKPLDNMMTGDELLDFQVKAGFWGNNQTVQKVKDMILAGAEDLYGNYDSLKDEYGKTLFPVDFNHDADWLKALFKTAPTSQGDISFSGGSQGTSYYASIGYFDQEGMAREPANFKRYSGRLNFESRINEWLKVGANLSGAIANRRSADYFGKYYMGSGTFGVLTMPRYYNPFDVNGDLADVYYMYGATRPSMTEPYFAKMRPFSSESHQANVNGFAQITPIKGLTLKAQAGVDITNTRTSSKRMPNNPYDSTPLGERRERAYRDVSKSFTNTAEYKFSIDEKHDLTALMGHEYIEYEGDVIGASSKGFESDKLMLLSQGKTGNSLSLPEHRVAEYAYLSFFSRFNYGFDKWMYIDFSVRNDQSSRFGSNNRSAWFYSVGGMFDIYNKFIQESNWLSDLRLKMSYGTTGNSEIGNYNHQALVTVNNYTEDAMGLSISTAGNPDLSWEKQSQFNFGLAAGAFNNRLSAEVDFYVRTTNDMLIDVPMPYISGFFSQYQNVGSMKNTGVDLSLKGTIYQNKDWNVYASANFNYNRQEITKLFFGLNKYMLPNTGTIWEIGYPNSFYMAEYAGIDKKTGKQLWYVPGQVDADGNKVTTSQYSADLETRIDKSVTPPITGGFSLGASWKGLSLDADFAYIVGKWMINNDRYFTENGGGLMQLNKDKMLLNAWTEDNKETDVPKLGQSPQFDTHLLENASFLRLKNLKLTYVLPNSLFAGQNVIGGARVYLMARNLLTVTKYKGFDPEAGGNVGKNQYPNSKQYVAGIQLSF

SEQ ID NO: 13090 - protein, 469 aa, Bacteroides dorei DSM 17855
MDKFFKVSALTAAMFGVVAVAPATASTESAAGGEYVEKVNEFMQDSSLNALFLVDTRSRTRTTGKPGGENGDRWSRLNYSSYNAILDFTSGYHDGWVGADVAAYYSGDLYNDSLYNSNEGYLCNEISTCNNLDWGAGDGQQLKVYKAALKFKANESFNARFGMLQAGGNGTIGNVWSFVPGTYRGFELNAKLGDFNLSYFGADQFTAPWLLHEDDYAPALWSDTSWSYLHSLGLNGNLTDSLFMQLGLGQATGVQYANGIDWGAGQVTSYHNETDNTSYKAYLKYTVSDRTTLAFDFYGVDDDVKYDGLGFHTGLSLNQSFGKLAWMSELRYTDTDNRADFVPRTIHTYGMNNGTWSQWWDALSDWNKAGELAWYNRLSYNQGNGWNYYLGFGYGTGADSAASGASGDWDYESEYAVNATVSYSLQSGALKGSTIRLHGTILERDEYAGAGDADETDLRLQVLIPYSFH

SEQ ID NO: 13091 - protein, 904 aa, Bacteroides dorei DSM 17855
MKNTYKLILFLLLITHASFGQDVKGYIKDAESKEALAGVNVFYKDKGGTRGTVSDINGYYELKVTDGDAVLTFSYLGYETLSVPVKVDPGEFLTHDVSLRTNSNMMDEVVVSVGRYEQKLSDITVSMELLKAKDITRQSPKDLTDVLKNISGVDVTDRQPSVRGGTGWTYGVGSRCLILVDGMSVLTPGSGEINWNMIPMENVDQVEVLKGASSVLYGSSALNGLIHVKTKRPGLDPVTQVNVQGGLYGKPRQDGTPLYGGLDLSHSRRIKNFDLTVGANTFLDDGYRQDNYNRRVRVGGNLTYHDPRVQGLNYGVNVNYLYNDYTGFFIWRSPEEPYIQSPLANMGRRENTFYIDPFLNYTNSEKGTTHRFKGRFFHRGSRIITHTTDKSLFDITNNMGFDISSVPEIINIAQNWQTELLPTFLPYLPEVMNGKVSGLMAELGKLGNHFFPTATSADYMDLISWVMGRTPLPDKNNVGAWLVDAMKPMEKKAPEATDHTYSYNLDYQFSKKFEHSQLTVGGTYERIHADSKVTGQHSSDNVATFLQYDHKFIDRLNVSVGVRLEYYRVDDFYREAETKIFGAKVPVKPVFRGGLNYELGEYSFIRASFGQGYRYPSVTEKFILKDIGGVGAFPNAELKAEQGYNAELGFKQGYKFGNLKGFIDVAGFYTRYKDMIEFRFGLFNNKTFDYIDGLSKLFNAFSSGDGLGIGAQFTNVGRAEIYGVDLSTSGVYEFNRDTRLAYTLGYVYTNPIDMDVDSRNAEEEANDDLMAMRSKSNDSKYLKYRQKHSVKGVFDLEWKQFNIGTNMSWKSKTLAVDYFMVDERTKAELNLMDYMRSMLFGNLHDYWAENNKGYFVMDMRVGMKVTKNIHVQGLVNNLLNKRYSARPMDVGAPRTFILQVGANF

SEQ ID NO: 13092 - protein, 512 aa, Bacteroides dorei DSM 17855
MKKISFFIFTALFCCSAQAAPSSLEKRLGKSEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 13093 - protein, 328 aa, Bacteroides dorei DSM 17855
MKKIIGLVSLASVLFAFDASKIEITPTFNYTTPEGNLNLKNYGGVGLRFGYHYDDLWIDQAELGLEYYDNAKYNNPNDNTHTDTSVSRFYVNAIKGIDLANHVYLYGLLGTGYEYLSHGAYENKSGMFAQYGAGFKFALGEDLALRLEARDQIKFNNGEHNLISSVGLSFYFGNKAPKTPQTTTKQIEEKPQAKQIDKSCPEPRKGALLDHIGCEKTIALEGHFGFDQISINPEFAQKIQEVGKVLEENPQYYTILEGHTDSTGSKVYNQKLSLERAKAVAKELEKSGVAKEKIATKGYGFDKPKASNDTKEGRAQNRRVEAKFFIKE

SEQ ID NO: 13094 - protein, 378 aa, Bacteroides dorei DSM 17855
MKKQMRMKKQTLALWVGLVLAGQASMALASNQVGEFYVGGKAGLTQFSDECGANSLDCEEQSEGFGVYGGYQALDWLAVEVGYDSLGKSKADYSALMKPGEVAHYDATVQGIELGLKADYALTERAGLFAKAGTLLWQVEKSGSEPGLGSVNQEEDGSSLMLGAGVEYRLTEHWNTRLEYQYFNEVGGEKTGGSDIHFIGVGLDYRFGGAAQTAMSEPMDVRPVDEVVMSEPEPVMETVAEPEPQVIETYTQVVSSAFGEALFETGSTSLSPSLMLQLQPLLARLKQYPETVVEISGHTDSKGSDTLNQRLSEQRAQSVANYLISKGVDPERITRVVGYGESLPVASNDTESGRAQNRRVEIVSPEAMSSHSTRSDQE

SEQ ID NO: 13095 - protein, 1100 aa, Bacteroides dorei DSM 17855
MKMKARTKMKTLLLLGVLLFGFTVSAQSQKVSLDFKNERVEKVLASIKSQTGMSLVFSDQLVDVNRKVTMQLKDVTLKEALTRLLSGINLTFEIRNNKIYFIEKKAVSQPGSRKKRVTGVVKDVMGEPLIGANVVEKGRSTNGVITDFNGKFTLEVDESASLVVSYIGYLAQDIPTKGKGDFHIILKEDTNTLDEVVVTGYGDFKKATYTGSASVLTTEKLEALPVVSVGQMIESNIPGISVVAGTSSQPGAKTTLRVRGVASMNASTEPLYVLDGVPIPSYDLSNFTSMSEAGGMGFIETLNPADIESITVLKDAASASLYGAKGANGVVLITTKKGKEGKLRVNMAAKYGITDFAYTYRPLMGGEERRELIHEGLVNFQLDKGVSEQEAQQYADANIDQYAKRLPQGYSDWESALFKTGYQQDYNLSASAGNQNSSFIGSLGYTKQTGVSLNSEMERFTGRVDASNKYKKVEFGMNASFSWTKNVHLPEGKFYGSAIYASKVNLTPSTPIYNEDGTYASGYRENNGYNPILEAEVNDYYARTVRAMGTAKIAYNVWDNLKVSSVFTVDYSLTKDFFFQSPDGRDGATYQGRGRMQMTDRIRYTSQNNLTYSKTFGKHSVSAVTAFEVMKYDYEDLYAAKKTYGQDINTSLGNAADPIDADQKLQEDALMSYVASVNYSYDDKYYASFSFRRDGSSRLSPDTRWGNFWSLSASWRLSQERFMQPLKSVLSDLKLRASYGVNGNLPSSYYGYQSTYTTGAFYSGKPSPWESTLGNEELTWEKNYALNLGLDIGLFSRVNVSLDWYTRTTKDLLMSKQLNSISGFSSLLTNVGQMRNTGVELEVRSNNIKTKDFSWTTAFNLSHNKNKILKLADLPWFVDGRYVRKEGYPFNTIYLREYAGVDPETGSALYYDNQQDENGNYTKNKVTDPGQASPIPLKDITPTISGGFMNTFNYKFIDLSFNLSYSFGGYSYDNASYILQDDGYSVISNKSTEQRRRWQKPGDITDVPRFVYGNKKGGNYNSSRAIHSTDHIRLKSLILGLNAPKAWLQKLGIGNARIYFSGTNLLTWAAYDQYDPEMSGVVGFYTPPLKTYAFGLELKF

SEQ ID NO: 13096 - protein, 687 aa, Bacteroides dorei DSM 17855
MLAPTLRLLGALICQLGSLGLAIAQTPEPVSVSAANATALSETDFLTEMPLVLSVSRLPQRLDETPGAVTIIDRDMIRLSGARDVADLLRLVPGFQTSTSFETGAPLASYHGSFDAYSARMQVLVDGRSVYSPYLFGGTATGLQSVAMADIERIEVLRGSNSAAYGARAMLGVINIVTRHTVDTLGRQAAVTTGENGIRDAQASIGWGQDGATFRLGLDRRGDDGLSGSNGHNLINRVNLRADLRASARDEVGLRAGGLTIDSGEGYVGKPDNPPHDRSFGAGYAQLDWRRSLGADEDMALSLSHTQESLRNSFAYSLLSYKNQVAAYPDGGNAALIQFKNLVAGIDDSIDIDTSGRASSSTLSLQHTLRHSSALRVVLGGELRREEVVSRALYNTDAVLRTDYTRLFGNAEWRFADNALLNAGGMYENNNVRGDNFSPRLMVNWHVAQGQTLRFGVSKAYRSNSTFEQFADARYTSNGVLLKVTALASGAVQPESLLVREFGYLGDFPWLRAGLDVRVFHERIAGFVRGRKSVLPAGTTLLASAPWDYVNDEDFTIKGFEYQLKWRPWRDAQFIFNQTYTNINSIDTGTVLPAPEVASSLTYLQKLPGGVDLSLMHQDSGPVVLTGSSGSHLAMTRTDLRLALPVQFGATRGEVALVVQNLGSPYLDFDQLFRFQRRAFVTLRLEN

SEQ ID NO: 13097 - protein, 1004 aa, Bacteroides dorei DSM 17855
MLNVQSESKRTFTQSLFFVLFLLSSTLAFAQNRVTGVVTDKTGEPLIGVNVLEKGTTNGTVTDIDGKFTVDMPQGKTLVFSFIGFVTQEIKVTSNVVNVVLNEDTKTLDEVVVIGYGSMTRKDVTSSITTVKAEDLNVGVYTSPAQLLQGKVPGLTIANTSDPNGSPSISLRGASSLRSGEAMEPYYVIDGVPGVSLSLVAPEDIESIDVLRDASATAIYGSKAANGVIIVTTKKGNKNGKTNVSYSGYVAWDKTMKTLDMMTADEVLAYADANDLDLSGYYDVNNPANTDWQSEVLRTGFSHNHNISINGGNEKTSYNASLNFLERQGTVRGTGMDRLTARSFLQTKAFDDRLDISISLNGSITNNENGPASNEGRSALDAMNYYLPLNPVKNEDGTWYGRTTSQYYNPASLINEDRYETTQKLLQGVAKATLHICDGLDWNLNLSYQNEQYLYNNYHSSKSQIVDYASRNGQAERSTAENIKKQMETYINWDHTFNDVHKVGVMLGYSWEQADNNNGFGLIAYNFYNDALSYYNMALANSVSMDDISNINSGYLLSTLRMISYYGRINYSYKSKYLLQATLRRDGSSAFGVNNRWGTFPSVSASWRIIEEDFMKEQDVFDDLKFRVGYGVSGNSLGFDAFYSRQVYGSTGWFTSADGDNYRVLGATRNANPDLKWEKTAMLNVGLDFGFFNNRLSGTVEYYDKRTSDLIYNYRVSTLLYPYSEMWANVGDISNKGVEITINAVPVQTKDFTWSTTLNLSHNKNKVESMSNSEYTVNFIDMADPNINSYSGQHVQRLMEGAPIGQFYLWEWAGYDENGMSIFNDYDEEGNLVGTTDAPDDGDRRMAGSAQPKLTYGWNNDLTWKKWTLSAFFQGVAGNKIFNATRATYSDPSLLSSFGKNILSEVATEQHANDSRAQAPSTRYLENGSYLRLSTLTLAYNFGKLGNYVNNLRVYATCNNVFTLTGYKGIDPEVNLGGLEPGMDMRYSNYPRTRSFMVGVNMNF

SEQ ID NO: 13098 - protein, 1012 aa, Bacteroides dorei DSM 17855
MKKQILLLCLALTSLCSYAQTITVKGVVTSASDKEPMIGATVQVKGTGTGTITSIDGDYSLNDVAKDAVLVFSSIGYETQEIKVNGQTVINVVLKDASELLDEVVVIGYGAVKKSDLTSSISTVKGKEITETVTGNAMDALQGKINGVQVTSGGGPGAQPKVLIRGVTTVNGTDPLYVVDGMPVGTNINFLNSNDIESMEVLKDASAAAIYGTRASNGVILITTKKGMAGKTNISFNASAGFQTLSKPKMANAAEYKEVFNTRYTNDGGTSIWNDTGATTNPGGTDWWDEVINKTALVQNYSLNISGGSDKLVYNLSMGYYRNNSQYDYGYWDKINARLNTEYTFNKYVKMGFDIAPRVESWDDTPDLFSAAMSMDPTTPIFKPEDQWVDNEFNNYQRSYNNQEWNPAGSLARQNSHSREMGTIVNTYLQINPIQKLTLRTQFGANAHFRRTDKFTPEFYIDALEQSTLSNVSREMQEWLDWNWTNTATYITTFAEKHNINVMGGFTAERFAEFQSKASRDDVPNNMDQMQEVNAGTQNQKSEGKTAYSTLVSYLGRVMYNYDNRYYLTASIRADGSSRFPKGNKYAIFPSVSASWRIISESFMQDQKIFSNLKLRGGWGRVGNQNIDNDATLTLLGQSDYVFGTAPGRVSGTMVSGVGNNLLKWETVEDWNVGVDMSFLDSRLDMTFEYFQKKSSDMLYQKQNIFAIGYPDWNSTVWMNIGSMKASGWELSLNWHDKVADFRYNVGLNLSAVKNKAVKFSGDGPIQTGGFNSDQIIRNEDGGLISRFYGYVADGIFQNWDEVYAHTNENGKLVQSNAQPGDIRFKDLNHDGVLDENDKTWIGNPYPDLMVGLNLGFSYKNIDFTANFYGTFGNDIFNKTKGLYSGVSGQNVWTGTLQKAWHGEGTSNDIPRLSYNDLNQNYTRVSSFFVEDGSYMRCKLLQVGYTLPKKWLNGTELRLSLSAQNPFTITSYSGMDPERPQIGKDGSVIETGIDGIAYPNPRTFLFGIDLKF

SEQ ID NO: 13099 - protein, 722 aa, Bacteroides dorei DSM 17855
MVRRNCANPCTQASRGVSARAVKISLILAPVFLPSSGSAQSAVDSAQEIELEELSVAGIGDGNTRVDGYRVARAVSATRTDTPVREVPQTIVAVPQEVLEDAAATRIDTALDLAGVGRGNNFGGLGLTEFTIRGVATGEYYRNGFPINRGYPNSPDIVSIERIEVLKGPSAFLYGRGDPGGTFNIVTKQPLAARSLTIGTQYGSFGAKRSTFDATGALDESGQVLARVTGAVEDNGSFRDFVTSDRYALAPVIAWKPNADTTITLEGDFISTAQTFDRGIVPLGGNVRALPRSRFIGEPGLPPAHVDNALGQLRVEHRFDQDWVLNAGAQVLGGNLSGYGVGAIGLLPDGRTQRRTLEWRDLTWSDLDLQANLAGKFETGPFRHTLLLGLEYDSYRYREVFNRSNVATNPFLLDLLAPRYGQPLPPITARVTNFLQKTESYAGYVQDQIDLTPRLHALLGVRVEDLGLVSTNNLTKGTTSLQGLVATPRFGLLYDLTDTVSVYGNYARSFRPNIGTDRSGRPFAFEEGEGYEAGAKVSLLDGRLDATAALFEIRRSNVLSTDPVDPNFSVATGAIRSRGFDLTAAGYLAPGWRVIGTYTRVDAAVARDNTLPVGTRIANVPANSLAFQTVYEFQSGELKGLGLGGGLDFVGRRAAGTALATFNLPQYTLVNLISYYQIAPGVRIYLNVDNVFDATFYDRAFQNRYATPGQPRTIIGGVAARF

SEQ ID NO: 13100 - protein, 989 aa, Bacteroides dorei DSM 17855
MKSMRLSTIAAALMVAMPLYAQTADPVQPKVENNTQKTTTNAEQEPTKSAQIVEDDIEIIAVTGVYQADLKARAMERDSKAFSSVIATDDMGNFVDQNVAESLRRIPGVTLERSEGEGKYIAVRGLGPKFVSVSMNGAELSGAGDERKIGLDGITSDSLGAIEVFKTLTPDMNLNSIGGAVNVKAISAYDRGKNTLKMKLQNSYSELREEHSPKFSLDGTQLFLEEKIGVGFALSYEDRKNQVDEVRHHSTRELNFLQGGIGLSEEQLGVAPEILIPAQLENRREIADRTRTTATLNVEFKPTANSFYYIRGNYSNYTDDDVAQREFYNFYNGDQADEIIYVNADTKEFVLSDIDIYNQFFIQEGETTTTNYSIGGENYITDTLRVDYEYAYSKTDDKSVGDRRVQFRERENIVYGQATKNNIVAQVLTPEEAAALGGFALDPDNDVFAGEADGDISDLSNMEYDNLFMEDSVRTDEVTSIKLNLQKDFDIEYLNFIKIGGTYNEREHFRDKDRWSYAINPLDCGTDETCITVANSNVTDYNFAVPEGGLFSYPFVSNEDLEYIVDSTKITRDSATGGEVSIDSTKEDYTLYEDTYAAYIMTELQLSEQVSVITGVRYAHTEFSSTGFMSLENDDWDFGNDKMLDLAIPLPESSITYSEFFPSIHVRYEPSDQILVRTSLWTSYTRPSFKQARGFAKFDDDISLCNPTTNNCYSSPDGQSAIDLQGYILGPDNAVQVGNPNLVAMTSDNFDASFGWYPSKELFMEAAVFYKNIDNFIVDVTGIQMGIDELPLTLPVNQVSDFAIPQDLVLNQVDITLNGDKATVYGIELSYNQFFENGLFWQSNMTFVKSEAELDATIRHDKMPLPGQADVTGNIAVGWEDESFSLRLISNYRSDILEEVGSCPVSASVSDPHTCKSWADIYQDDILTFDMKVKYDFTKSLSVYFDAINLTDESDLRYFKGNDLSGGEILYQREDYGRTFQLGMNYKFY

SEQ ID NO: 13101 - protein, 172 aa, Bacteroides dorei DSM 17855
MKNLTVLALAGLFSASAFAAPVGNTFTGVGVGVDLTTVKYKVDGVKGKQSTGPALVVDYGMDYGDNFVGVVQGKVKVGSTKVFSDVKQKTKYTVAYQQGYRVASDLLPYVKVDVAQSKVGDTNFRGYGYGAGAKYAVSSNVEVGAEYTRSNLRKSGAKLKGNEFTANLGYRF

SEQ ID NO: 13102 - protein, 437 aa, Desulfovibrio piger ATCC 29098
MVGFKHTLWALLLTMVTGMAIAQNNTNSPYTRYGYGDLSDQNFGNSKAMGGIAFGLRDGAQINPLNPASYTAIDSLTFLFEGGVSLQNMNISGGGVKLNAKNSSFDYLAMQFRLHRRLAMSIGLLPFSNVGYTVSDTQNATDPATGNTTAYARNYTGDGGLHQLYVGLGVKVFKDLSVGVNASYFWGDITRSRTIYYPNVSGAYNFVQQATASVSSYKLDFGAQYTKDIDKKHSVTLGVVYSPKIKLGNDYDVTTQLVSNSTGTVETSTSVAPDATLALPNTYGVGFTYNYDKRLTIGVDYSLQQWSKADFGVRTTDESIRGDFDETYAYCDRSKISVGAEYIPNLLGRSYLAHIKYRLGAYYTTPYYKINGKKATREYGVTAGFGLPVPRSRSILSISGQFVRISGQEATFVNENIFRVSIGLTFNERWFFKRRVE

SEQ ID NO: 13103 - protein, 730 aa, Desulfovibrio piger ATCC 29098
MRVHACFIPCAAILIGLPAGVVSAQDLEGGADRLQHIPKASPSRKQPSSSRAGAVETVRVHASHASHASLLAASGNAATKTSTPLEDVPQNLTVITQARMSMLNSRSLSEAVRYAAGVSDYGSKDDPRGYLGTIRGFSPDIYLDGIRTPDASSSQSFSIEPWGLEEMDVLRGASSALYGSGQLGGIINAVSKRPRVDQQNQVAFQTGSYSRVQGAADVGGALNASKTLLWRFNGLLRKSDTYAKNIKNNEVYVAPSLSWRPDDRTDFTILASYEQLDAGSTAQFLPADGTIYASPYGYIARNFLNSDADYDVYSKRQAAIGYSFTRRLTPNWTISQNMRYAHLDLSYRYVTAVALSADQRTLTRQALLQSANYNNVTLDTRSDLKLRTGPVRHEILFGVDFRSDFMANRRGQKTAPSLDLYNPVCRPISWPSYGTKTNTNETETQTGVYAQEQARWHDFYLTLSGRGDFTQSLTVNNLTAGRTPQQDNAFTGRVGLLYKSPIGLSPYVSYATSFQPQVGTTRLNTPYLPTRGRQIEAGLKYKPPHGTPWGEDFMLTADFFDLVETNVLTTDPEDSTYDIQTGEQRTRGFEAEGVGRLPYRIDMLASFTYQDPRITKTTVAAQLNQRPVAIPSHMASLFLKRDFRLTKDWMTGIGGGVRYTGNTAGALPETFSVPSQLVWDLQAHVDYQRFGVQFNGTNLANRHYVAVCTRSVACAWAPGRAVFVTLSYRW

SEQ ID NO: 13104 - protein, 707 aa, Desulfovibrio piger ATCC 29098
MKRTILAACIGAASQAMAQAPDTRLEHVLVTVPIHKKAAETALPVTVLSGDELQRLASSTLGETLGDKPGISNSSFGPGVGRPVIRGQAGPRTVNLSNAIAAGDVSSLSPDHAVGIEPMLAETVEVLRGPSTLLYGGGAIGGVINTIDNRIPAKRIDGIQGAVEYRYDDAPEMNTGVLKLEGGAGDFAFHVSGTFRDFDDMSIPGLAIDEEAVEMQEELLGGHDEDHEGEEHDEEEFENSDGFIANSNGDSDVFNIGGSYHFGERDFIGFSYNSFETNYGIPPGAHEHGHEEEHEGEEHEGEEHGEEEEEEEIIRINLQQERYDTQLHMHDIVPGFIDVARAYLTYTDYEHVELEGTEIGTQFSRETYEGRMELVREGANHGVLGLQFKGDEFSAIGEEAYVPETDSVEWGGFYVQDFHAGDWQFEAGGRLDYVERDPATGLEEDFTSHSLSGSALYPINESLSLGVSLSRSERAPSTEELFSNLNNSEEELVTHAATGIIEIGDPNLDTEVSLNGDLSLTWQGEKSFAELTFFYNSLSDYIFLLNTGGEVDETPVYEYEQDDADFYGVEFESSFDLATLAGGNLALGIFGDMITGEFDSAGDVPRLPPMRVGSELSWRSDSLGAYVRVLNASDQDNPGDFETETEGYTRWDGGIDYNLQFSGGTELLAFLKLKNISDEEIRLSTSFLRNFAPQAGESVEAGLRLTF

SEQ ID NO: 13105 - protein, 863 aa, Desulfovibrio piger ATCC 29098
MKRCDLTAGIRLWLFVSIWAYLAQPGLAEEKILDIPQLGNIDFPATSAKLLVQKPSPTNPPATSGEVIGITGVKANPTEKGVEVILETTAGDKLQVANRSTGNNFIADITGGQLSLPDGNAFTFKSEKPIEGITEIIVTNIDANTVRVTVVGQKALPAVELFDDNTGLIFTVASMATTAQKPEEKPEEQPAAQQDDPIELVVTGEADSYRVPNASAATRTDTPLRDIPQSIQVVPQQVLKDQQVNTLNEALQNVSGVIQTASNYSQFASFTIRGFNSFDQGGNNFTRNGLGYRFGSQGTNFSNIERIEVLRGPGSVLFGSGNPGGTINIVTKQPLSEPFYSVEAAIGSYDFYRGAIDLSGPLDDSKTALYRLNASYEKADNFVDFNDRENFSVASTLSFALGENTTLTLDQEYNKVNQGYYNGVPAVGTVLPNLNGRIPRNRSIGQADSTYSPEIVRVGYNLEHKFSEDWLLRNAFYYSHFYNKTRDTYFANALDPDQRTLQRGVQDADDRYQTYDLSTNVVGKFSTGSIKHQLLFGVDLSRYDQYQSEYEGRTGTPLDLFNPDYRPERFEVLFAGNEATLTDSLGVYIQDQVTFAENFKLLLGGRFDIFEQTKTDRLSNTEQFQSGSAFSPRVGIVYQPIPPISLYASYSRSFTPTIGRASDGEQFEPGRGTQYEIGVKADINEKLSATLAFYDLTRSNVTTNDPANPEFSIQTGEQNSRGIELNVAGEILPGWNIIAGYAYTDARITQDNSLPIGNRLNNVPEHSLSLWTTYELQKGNLQGLGFGLGLFYLGDRQGDLANSFNLPSYLRTDAAIFYKRDRFRAALNIRNLFDLKYFESAYSDLTVYPAEPLTLQGTVSWQF

SEQ ID NO: 13106 - protein, 426 aa, Desulfovibrio piger ATCC 29098
AWAYTINDTKAAVLRAEYDLTDNLTAFIAWGQRDGGYSALITRNTLLNDAGDINAMAVRSERDGTQRSGEAGLRGTFGTGPVDHAWSLAATRYTSEQTFRDKMFFNHAMTNYDRLDFGPAPDLAGYGAVTSRSEATLASVALVDTLSFLDGDLQWTLGARRQTVESSNFNGSGDQTARYEESRVSPATTLLVKLRDDFAVYTNYIEGLSQGGAAPNTASNAGEIMKPYQTKQYEVGAKLDLGHFAHTLSLFQIAKPSAYTDPSSNVYGVYGEQRNRGIEWDLFGELTPELRLLGGASYTQAELTKALNESNVGHQATGVPKWMAKLGAEYDLAAVPGLTLTGNTQFIGERFVTDDNRLSLPSYTTFDLGARYTMRIADHALTVRAAVQNLTGRDYWIGSWSGGDGSGLSGGLGAPRTFQLSTSLTF

SEQ ID NO: 13107 - protein, 703 aa, Providencia alcalifaciens DSM 30120
MAIPVSAQRIISGTVFDENKEPLMGATVSVKEKVTLGTTTDTQGKYTLKLPDNREYTLQVSYMGYISQTHKVSVSKTGKVDFILKEDAVNMETIVVTGTRTPKLLKDVPIVTRVITADEIKKVDATHIGDLLQAELPGIEFSYSMDQQVSLNMQGFGGNAILFLVDGERLAGETLDNIDYNRLNMDNVERIEIVKGAASSLYGSNAVGGVVNIISKVSAEPWTVNLNGRYGAYNEQRYGGTIGFNAGKFNSVTNVQHTQVDEKDLADGKTNEETEDWAFKKVYGDKTWNFKERLVYTANDHLKLTARAGYFFREREKSQTSKDRYRDFSGGVKGNYVFDKDKDLEIAYSFDQYDKSDYLPQDANDVRDYSNVQHSVRTFYNHTFVGKHILTLGGDYMRDYLMSYQFANNGSKHQYTVDGFAQFDWNPTKYFNVITGLRFDYYSDSDINHFSPKLGLMYKIGNCSLRGSYAGGFRAPTLKEMYMNFDMASIFMIYGNPDLKPETSHNFSLSAEYIKGRYNLTVTGFYNIVDNRITTAWSEALKGQVYTNISNIKISGAEANASAKYPCGLSARLSYAYTHENIKKGQPVISSTRPHTATVRLEYDKHWKNYAFNIALNGRFLSKVNTEEYTSNTSYEETEKVTYPAYTMWKLTLSQKVWKGVDMTLAVDNLFNYVPSRYYNNSPATKGTTFSAGLSLNIEQLFK

SEQ ID NO: 13108 - protein, 277 aa, Providencia alcalifaciens DSM 30120
MKKTLLCAAAGAAVLAPLAAHAQSAGSNVVTLGWFHVMPQQSSTPMTTNVAPTPINTPLRLPPSFTSPGTGLRTSGADTVGLTVSHFLTDHIAVTSVAGVPPVFKVSGQGTIKPPGPAGALGTQNIGLASVNPIVKSVRQWSPAVLLQYYFGQATAKFRPFLGLGVSYNWFSDLQLNTNFIKQTQDNLGAILAAGAGKPGTTSVEAKASSSWQPVFNAGLQYNMTEHFGLIASVTYIPLKTTSTVTIKAADGTVLSESKSDLKADPIISYVGMTYKF

SEQ ID NO: 13109 - protein, 375 aa, Providencia alcalifaciens DSM 30120
MRVIIMMKRNILAMVIPALLAAGAANAAEVYNKDGNKLDVYGKVDVRHYFANSESGEDGDDSRVRLGVKGDTQITDQLTGFGRFEWETKTNKTEGNNDNKNRLAYAGLKFKDFGSVDYGRNYGVVYDTNAWTDVFPLWGADTMAQSDTFMTQRNRNLLTYRNNNMFGYVDGLSFALQYQGKNTDSNKSGVDKADKDNGDGYGFSTAYDLGWGVTLGGGYSNSARTEAQKAIGSTARGERAEAWNVGAKFDANNVYLAAMYGQTLNTNHYGDLNRIANKTENVELVAQYLFDFGLKPSIGYNQSKGKSLGFTSKAGDKYENQDLVKYISVGSYYYFNKNMSAVVDYKINLLKDNDFTNEAGLMTDNVVGLGLVYQF

SEQ ID NO: 13110 - protein, 353 aa, Providencia alcalifaciens DSM 30120
MKKTAIAVAVAVAAFATVAQAAPKDNTWYTGGKLGWSHYEHAKFTDEAGDTVGTGKKTRDQLGAGLYAGYQYNQYMGFEMGYDWFGKMKYKGTNPGSVSSMGVSLTTKLSYPIMEDLDVYTRLGGMVYRTEAKVNNSGKETDTGVSPVYALGVEYAITPELATRLDYQWVSGMGDKDNIGVSPDNGMLSVGLAYRFGQEATPVVAPAVVAEPAAPVVENKRFTLRSDVLFNFNKASLKPEGQQALNELYNELSNIDPTQGRVLVVGFTDRIGSQNYNLPLSQKRAQSVVDYLVAKGVPASAIAAEGRGKEDPVTGNKCDAVKGRAALIECLAPDRRVEIEIQGTTEVVAQPGA

SEQ ID NO: 13111 - protein, 937 aa, Providencia alcalifaciens DSM 30120
MSQTLRMRSLLVMGASAVAISGFAVPAFAQQNTTVIEELVVTAQKKEEALQDVPIAVSAFSQDSLEAQKIDGGPNLQLAIPNVTFAKSNFTNSFNFQIRGIGAKAVGASADQGVGVHMNNAPQQSGNLFEAEFYDVERVEVLRGPQGTLYGRNATGGVVNVITAKPTDMFEANLRAEYGNYNSMKLRGMLNVPIFGDKLAVRLSGTSLKRDGFVTNTFNGNKVDDRDLYSTRVQVMFNPTEKLRTNFLWERFHENDSRARTGKQLCTKDNGPATVGGVPTGASRVFLTQGCLSASLYTPAAYGTVNTSGSLTGLLGNIFGFTSGDVNAGDTTSTNLREIETALDPIYQSKSNTYQFTLNYDITDELTFTSMTSYGKGDVWTKQDYNRNVATVPFNNTPFTPGGFFTDPQVGRTNKFTTIDVSSGRSEQFSQEFRLQSAFDGPLNFTVGGIHFTYRTLTDYYVIGNSLTLSSLALNFSNTGNPNCNPATTARCIGIDTSADPTGDGHNYYLNRTPYNLVSDALLGEVYYQVNEDLKFTLGVRQTRDKKAVKNYSTVLLAPGYGLTLNPTNPDQRARFNETTGRVGVDYKARLGFTDDTLLYAFYSKGYKGGGINPGVPANSVGIQQTFDPEFVNAIEVGTKNTLLGGSLLLNATAFSYDYQGYQISKIVNRTSVNENVDAKVHGFELESIWSPVRNLRLNANIGYLKTKIGDGVSSIDTMNRTQSNPAYTVVKVGPNASSVGANCVLSTVGVATILGAGAGATLPFACSGAAAYQGFLAAPAAAGGAGLPAPTAAFLANATGLYTYGAGYSIEGTAANLSGNELPNSPHWTTSVGAQYTFELSNGWSATLRGDYYRQSKQYARVYNTAYDQLKSWDNGNITLKVEKPEWGVAIDAYVKNIGNKTPIVDAYTTDDSSGLFTNVITAEPRLYGIAITKSW

SEQ ID NO: 13112 - protein, 964 aa, Providencia alcalifaciens DSM 30120
MTDIDGKFFLSVPDSAVLQVSFVGYKTVEVNVTGRNVLEIRLQEDAVMLEHVIVTALGLEKDEATLAYSVQKIKGEELNRVKEVNMIAALAGKAAGVQINKNSSGMGGSAKVSLRGIRSVSGDNQPLYVIDGVPMSNTSSEQAYSAIGGTANAGNRDGGDGISNLNPEDVESISILKGAPAAALYGSMAANGVILITTKKGNSAGQRNINFSTGLTFEKAFSMPKMQNRYGVSDVVDSWGEKENLMAYDNLNDFFRTGLTSMTSVSISYGNENLQTYFSYANTTGKGIIDKNKLKKHNINLRETATMFDKRLKLDGSVNVMKQTVENKPVSGGFYMNPLVGLYRFPRGEDLSYYKDHFETYDEERKLGVQNWHTFTEDFEQNPYWITNRIQSKETRTRVILSLSANFKVNDWLTIQARGNMDYWADKLRQKFYASTATALCGANGRYIEMDYQETQMYGDVMAMVKKTWGDFTLDAAIGGSINDKVVNSTRYDSKNASLKFANVFNIANIVMNSSASIDQRIDQRRQLQSIFGTAQIGYKEKLFLDLTARNDWASTLSYTKHEKSGFAYPSVGLSMLLDKWVKLPEWVSFAKLRGAYSKVGNDIPPFITNSFSHINAGGEIQANDAAPFKDMEPEMTHAIEFGTEWRFFQHRLGVNLTYYRTNTYNQFFKLPALAGDKYAYRYVNAGNIQNRGWELTLNGTPVLTPDFNWKTSVNFSTNKNKIVKLHEDLKEMIYGPTSFSSSYAMKLIKGGSIGDIYGKAFVRDDAGNIVYETEGDNKGLPLVEGDGNTVKVGNANPVFMMGWDHTFSYKGFTIYFLLDWRYGGEVLSQTQAEMDLYGVSEITADARDRGYVMLDGQRIDNVKGFYKIVGGRAGVTEYYMYDATNLRLREVSLSYNFSKKWIQKTKVLKDVQLSFVARNLCFLYKKAPFDPDLVLSTGNDNQGIEVFGMPTTRSLGFTLKCEF

SEQ ID NO: 13113 - protein, 710 aa, Providencia alcalifaciens DSM 30120
MNKAPIALAIASLLSSPLVIAEENTEIETIKIIGSTEQARQIAGSSAVIDEEQMRVEVPTDINQLMKTLPGVYVLEEDGFGLRPNIGIRAANAGRVSKVTLLEDGVMMAPAPYSNPAAYYFPTTMRMASVEVLKGAPLLRYGPQTTGGVLNLVSTPIPEQAISGQVLAQWGEFSSNDIHAYVGGTQGAWGFLLETVQRESNGFKAIDRSHGDSGYDIQDYTAKLSFDQGPHHLLFKAQYSEEISNETYLGLTDADFAETPNRRYGISSIDQMDNSHKGFNLAYGFDVNSDVTLNAVAYRNEFKRDWFKLNGGGSYVSAANQGDMLAQGILDGTEDAFDLEYKHNNRAYESYGIELNAQWQLGAHALEVGGRDHTDEMDRFQPVEIFDQINGSLVYQSTVSPSGSNNRIEGADATSLWVTDSWQVNQALKVNLALRYEDVSSFRNQYDEAARTTAPAFRSNSSDEWLPGASFTYDLSDSWQVLAGIHKGFSPLGGGATENQEPETSINYEAGLRYQQQNTFVEAIAFYSDFSDTTQLCSIATPCDNGAESGTYVLGESVVQGLEFQAQHTFAAGKFLIPVDIAYTYTQGEISKDNAVSGLMDGDRLNDIPEHTANVRISLDNNTGWVNYLNFKYIDSMCVSVGCNNSTAAFNETESLFVTDAVSRYELNTQTSVYVKVENIFDQQAIVARTPDGARPNKPQTVWMGIDYKF

SEQ ID NO: 13114 - protein, 285 aa, Providencia alcalifaciens DSM 30120
MLFVLILSHRAASYGAIMAALPYMQLYIADYLADTMHLSAEEHGAYLLLMFNYWQTGKPIPKNRLAKIARLTNERWADVEPSLQEFFCDNGEEWVHLRIEEDLASVREKLTKKSAAGKASVQARRSRKEADVQTKQERNLTGVQTDVEVVFEHDVNTKATNKDTDKDLKTDPPLNPPRGNRGVKKFDPLDITLPNWISVSLWREWVEFRQALRKPIRTEQGANGAIRELEKFRQQGFSPEQVIRHSIANEYQGLFAPKGVRPETLLRQVNTVSLPDSAIPPGFRG

SEQ ID NO: 13115 - protein, 253 aa, Providencia alcalifaciens DSM 30120
MTMKHAWWRATVVCLAGTLGTAAQAQNYIGISAAVAPRYEGAKDYRFLPVPLIHYENGPFFISPRAGLPSAGLKWQLGEHVHAGVFVGAHLGRDADDSDILHGLDDIDMHATYGAYIEWQYGALGLGAAYRQAARSGYGGVGELRATYRVWQTGRDSVSVGARTEWASDDYMRTWYGISASQAARSEAGLRRYSASSGFKSGGIFASWTHRLDQSWAVNATAGVNTLFGDARDSPVSERSTNYFGGVGLTYAF

SEQ ID NO: 13116 - protein, 747 aa, Providencia alcalifaciens DSM 30120
MNNKIHSLALLVNLGIYGVALPVMAEETTDSAALHEDTIVVTAAQQNLQAPGVSTITADEIRKNPPARDVAEIIRTMPGVNLTGNSTSGQRGNNRQIDIRGMGPENTLILIDGKPVTSRNSIRLGWRGERDTRGDTGWVPPEMIERIDVIRGPAAARYGNGAAGGVVNIITKKFDDQWHGSWNTYLNAPEHKDEGSTKRTNFSLSGPLGGEFSFRMYGNLDKTQADAWDINQGHQSERTGAYANTLPAGREGVENKDINGVVRWDFAPMQALEFEAGYSRQNNLYAGDTQNTNNDNALVKKNYGKETNRIYRQNFAVTWNGGWDNGITTSNWAQYEHTRNSRLGEGLAGGLEGLFNSDEFTDTDLADVMLHSEINLPLDFIVNQNLTLGTEWNQQRMKDSASNTQAQQGGAIPGMSDDRSPYSSAEIFSLFAENNMEITDSTMLTPALRFDHHTIVGNNWSPSLNLSQALGDDFTLKMGIARAYKAPSLYQTNPNYLLYSKGQGCYASSDGVGCYMMGNDDLKAETSVNKEIGLEWKHDGWQAGVTWFRNDYRDKIEAGYAPVGHTSSGKVQTDIYQWENVPKAVVEGLEGSLNIPVSDAINWTNNITYMLQSKNKTTGDRLSIIPEYTLNSTLSWQVHQDVSVQSTFTWYGKQQPKKYNYKGQPATGSEKDEVSPYSIVGLSATWDVTKNVSLTGGVDNVFDKRQWRAGNAQTTGNDATGAYMYGAGAYTYNEPGRTWYMGVNTRF

SEQ ID NO: 13117 - protein, 191 aa, Providencia alcalifaciens DSM 30120
MRVNKNIQLVVGASIIMSASICMSSPALAEEESVGLWDKFTNNVSATWDSDKYELYVPFFTWHNRFMYDKEKTDTYNEEPWGFGIGKYRYDEDNDWHALYAMAFMDSHNKVEPIVGYGFQKMWIPGEIDGFRMGAGFTLGITAREEYSYIPIPVPLPLVSIEYDKLSVQATYIPGTYNNGNVLFAWLRWQW

SEQ ID NO: 13118 - protein, 723 aa, Providencia alcalifaciens DSM 30120
MRGVPPPPGRAAPSPPPSAPSGPAAARASAPVWAVVAGCALWAGIPPEAVAQAAGPDPELPAVEVSGGQAAAQRRFDAAASHTAISLDPFTATTPLVNLSELLAGQPGVAVSDRQNYAQDLQIAVRGFGSRSTFGVRGVRILVDGIPATMPDGQGQAATAQLPSASQVEVLRGPLAQQYGNAAGGVLQVTTRDPREGGGASASVAAGSYGQRMAEASFDAGDRILGGLVDISRFETDGWRDHGAARRTHLNAKVVARPSGDTRVTVLMNLFDQPLAQDPLGLTREQWRADPRQAPAVAYSFDTRKTVRQNQLGLVVEHALNATDSVRARLYGGIRSLFQTLSFSGAAASSAGGVVDLDRDYYGLGAAWTHSDRTAAGLPWSWTVGLDADRLSEHRQGFVNDAGVPGALRRDEQDRAGNTDLFAQVDAWIAPTVRAIAGLRATRVRLAVDDRFPASAANPDDSGERTWRGTSPAVGLVWAASEHLNLYANAGGGIETPTLAEMAYSRTNSGPNYGLEAARNRQFEVGAKWQDGVHRLEAAWFDARTRGEIVPAATVNGRTVYQNADRVRRRGMELGWSARMGAFVPRAAYTYLDAFFASPYTGAGGVAVPSGNRLPGTARHTARLSLDYAPDARWTLGGAVDFSSRVQANDANTEAAPGRAVAGLHAGYGWKTGGTVRWQAWARLDNLFDRRYAGSLIVNDGNGRFFEPAAGRRIMVGLRAQLP

SEQ ID NO: 13119 - protein, 1159 aa, Providencia alcalifaciens DSM 30120
MKKHYCIQSFREKSVLMRCMKKIPLAMRCTLFMLFCLVGMTFANEGYAQKTMVNIALENKTVDEVLTELEQGTEFVFFYNNKQIDVKRRVSVRANNKTIFKVLNDVFKGTNIGYKVLDRNIILYDKAVGADGVQMALQAATVKGSVVDATGEPVIGASILVQGTTNGVITDIDGNFILTNVGSDATLIISYVGYKTQNIKVAGRNSFKIVLVEDAEILDEVVVVGYGVQKKESLTGAIAAIGADEIATTKTENLISNIQGKMPGLLIRQKTGEPGTFDNMVSIRGYGDPLVVIDGITREGTEELAQLNSEDIESISILKDASAAIYGMNAANGVIIVTTKKGVAEKTRVSYSALFGMKNATGMEETVDAYTYRMLANERARNDQAAPEYTDDILELYRTGAKGYTDNNWIDMFMNKLAFQQSHTVSVRGGTDKVKYYVSFGYNGDNGLLKSGIQYYHRYNLRSNLTAELTKGLKLNVNLSGRWDETQRPREDFMWTFKTLMVNDRGIGTHTINNPNHLSAIGPENKNPFALVDPDIDGYRKNRGLTYSADVELNWQVPFVKGLALSLLGSFDGNNRNNSSLNRSYPLYDYYTDAPAGTGGSTDAYSNTMRIYQKIYGRLQANYMRSFNQHNLNVTAVAELNSTRRDELSGSRQYSELFTNDILNQASPGTATNSGYRSFGRLAAYLMRANYDYAGKYLLEVVGRYDGSYRYAPSKRWTFFPSVSAGWRLSEESFIKDNLPFITNLKIRGSFGQSGYDAGDPFQYVSAYNSASNGYVFDGASQIMGMVAPGVVTDRLSWVTSSISNVGLDFDLWNGKLSGTIEWFNRKNEGILADRAQSAPDTFGASFPKENLNSNRNRGFEIELGHRGQIGKDFSYSVSANFTYARERSLHVEHAEYTSSMDRWLNGKENRNSNVMWLYKYDGQYTSLEQYETAPLIGGNLGNSKMLPGSYRLLDLNGDGRINSSDRVPEFWATGANPPIQYGLTLAASYKNFDLNMLFQGASGYSIGYANDDVWGYGGKTNKSYLIAKYVDRWHPANITDDPYNPATQWVAGYYPALRHNFSNTSDNGSRWNYGISVWLPQATYLRLKSMEIGYNLPKSFMKRIGLNSARIFVNGSNLLTFCNKALKDADPEREERDWGANLAYPLMRTYNFGLNINF

SEQ ID NO: 13120 - protein, 1039 aa, Providencia alcalifaciens DSM 30120
MKYMRNNKFKFRKIPFLLMLLLIFSAVVMAQGKRTITGVVTDTNGEPIVGANVVVQNNHSIGAITDIDGNFRLSLPQETKALVVSFIGMREKVIRITDKVDKIKVILEDDSQALEEVVVVGYGQQKKKSLVGSITQTNSKTLERAGGVTSLGQALTGNLPGVITYTSTGMPGAEDPKIIIRAQSSWNNSDPLVLVDGVERPMNTVDISSVESISVLKDASATAVYGVKGANGVILITTKRGKEGKANIQIKANATMKTVSKLPEKYDAYDTFIIKNRTLERELGLSPELWGDYKPMGIIDKYRHPANATEWDRYPNVDWADVLFKDYAMSYKASVNVSGGTKWVKYFAAVDFTSEGDMFREFENNRGYTSGYGYNRINARSNLDFSLTKTTTLSVNLFGSNGVRQLPYGASDSDNSYWKSAYRTAPDAMRPIYSNGVLGYYKPSSYDVPNSVATLATSGIEKKTNTQINTDFTLNQSLDMITKGLSVRGTVSFDNTFVEEKRGIEDTEGPQNMWVDPVSGVIYYKNEVDGGTQLDFSDGIDWVNKAGNVDPKSTYRKLYYQLQLNYGRQFGKHDVGAMALFSREKYAKGNEFYHFREDWAFRATYNYAQRYFAEVNGAYNGSEKFGPNNRFAFFPSFSLGWMISEEKFMKGLKFLDMLKLRGSWGRIGDDNVGGRWLYQDSWGYQNSNTYLGLIPTATPYSYYRITSLGNENISWETVEKRNVGIDYSFFKGLIAGSVDIFSDKRKDILVSGGSRSIPSFFGATAPTANLGSTKSHGYELELRLNYMFANKMRLWANTNYTHAVNEVIFRDDPVLRDAHRKAAGHAIGQTNSYINNGIYTTWDEILGSTERESYNGNKLPGEYNIIDFNADGIINDDDQAPYQYSGVPQNTYSATVGFEWKGFSASVQFYGVSNVTREVTFPTFHTQSNVAYVEDNVWSKENGGAVPMPRWSNPIKENGTRYLYDGSYVRLKNAEVAYLFKGKKIQKCGIKSLRLYLNGDNLLLWTDMPDDRESNFSGGSSMGAYPTVRRFNLGIDITL

SEQ ID NO: 13121 - protein, 733 aa, Providencia alcalifaciens DSM 30120
MKVTTHRGYSLLWLAMLACAYQSQAADNARADAQAEEQATQMQAGATGASPSAIDTTKSDIERIQVLSSRGLISFVSASASKSNVPVVETPVSVSVLTEKRITDLGAETLQDALGYVAGVYNGPYGMDSRGDWSQIRSVSPVSYLDGLQLLFGNYNNARPNPYLLQQVEILKGPSSVLFGQGSTGGIVNMVTKQPTAARSNEIWAQLGNYQRKQLAGDFTGAFDEDANVLYRLTALVRDANSQTEHVADDAFFVAPSASFYISDNTKLSLLSYFQDNHTGSSTQFFPHEGTILPAKYGQIPSERFVSEPGWDRYDTRQHSVTLRLEHEFESGLQFNWAARQMDSSAEYRTLYAWPPKFQDNKRELLRSVYLSDASASAFTTDLQLHGEFDTGALTHRVTVGADYQDVVTDNDSAYLSGQGGLIDVYQPVYGQVSLPGDEVIRDNPSASQRQLGLYVQDSMRWNDWVLSLGLRHDSLDVKNTAGIKTSPSATTARAGLMYAFSGGISPYISYSESFNPIAGVSKSGEVYKPREGQQWEAGVKFQPEGTEHLITLAGYRILESNRVTQDTPEAMNQLGEVEIRGVELEAQLEWEHWDLYGSYAYSDSEIKVTDKVYEQGARLAAMPDNMLSVWATYRPEHWLPGLKLGLGYRYVGQTSDGSVDVLLPDGSYAHKSLETDSYQMWDMMLGYEWESWDLTLNLDNLSDKTVITSCLARGDCFYGQQRQITANVKYRF

SEQ ID NO: 13122 - protein, 423 aa, Providencia alcalifaciens DSM 30120
MNQKNIINSGLLLTVLTSPLALSANFESPDSVENTIEKESSSKPHWREELSNKGITFGADYLALGLSSPNGSQGNSVNRSSGIARFYGSWHIVGKGTEDTGGVVWKVEHRHVYSSTPPKNMAFIDDISNGPEGLGYVGMIAPAYNDQRARVTNLHWKQKFNNGKTSLLIGWQDVTDYVDTYALASPWTGFTNLAFSTGSGVMGLPDDGILAISAGHMVTDNFYVVAGIADAKGKSDDIIEGFDTAFHDSTYFKTLELGWTDSQDQIYTDNFHVTLWHFDEGSRHSLSSTVLSDGSVIGGESGQGVNFSWSQFVTAQIMPFVRGGISEGDVALFDKSLSVGVGYFGLGTDNNNLGFAVNWSETNSDTLQKFMGAEKHQTTAELYYNMQIGEHFQITPDIQYINNPALSSESSAWVFGLRARIFI

SEQ ID NO: 13123 - protein, 1887 aa, Providencia alcalifaciens DSM 30120
MLNKKFKLSLITLSVIYALTPYTEAALVRDDVDYQIFRDFAENKGKFFVGATDLSVKNKQGQNIGNALSNVPMIDFSVADVNKRIATVVDPQYAVSVKHAKAEVHTFYYGQYNGHNDVADKENEYRVVEQNNYEPHKAWGASNLGRLEDYNMARFNKFVTEVAPIAPTDAGGGLDTYKDKNRFSSFVRVGAGRQLVYEKGAYHQEGNEKGYDLRDLSQAYRYAIAGTPYKDINIDQTMNTEGLIGFGHHNTHYSAEELKQALSQDALTNYGVLGDSGSPLFAFDKQKNQWVFLGTYDYWAGYGKKSWQEWNIYKKEFADKIKQHDNAGTIKGNGEHHWKTTGTNSHIGSTAVRLANNERDANNGQNVTFEDNGTLVLDQNINQGAGGLFFKGDYTVKGANSDITWLGAGIDVADGKKVVWQVKNPQGDKLAKIGKGALEINGTGVNQGELKVGDGTVILNQKADSNQKVQAFSQVGIVSGRGTLVLNSPDQINPNNLYFGFRGGRLDANGNDLTFEHIRNVDEGARVVNHNTSNASTITLTGKSLITDPKGLSIHYIQNNDYDDDGYYGYYYRPRKPIPQGKDLYFKNYRYYALKPGGSVNSPMPENGVAENNDWVFMGYTEEKAKKNVMNHKNNQRISGFSGFFGEENGKGHNGALNLNFNGKSAQNRFLLTGGTNLNGKISVTQGNVLLSGRPTPHARDFVNKSSAYKDAHFSKNNEVVFEDDWINRTFKAAEITVNQSASLSSGRNVSNITANITATDNAKVNLGYKNGDEVCVRSDYTGYVTCTKDNLSDKALNSFDATQINGNVNLSQNAALTLGKAALWGQIQGQGNSRVSLNQHSKWHLTGDSQVQNLSLEDSHIHLNNASDAQSANKYHTLKINHLSGNGHFHYLTHLAKNLGDKVVVKESASGHYQLHVQDKTGEPNQEGLDLFDASSVQDRSRLSVSLANHHVDLGALRYTIKTENGITRLYNPYAENRRRVKPVPSPATNTASQAQKATQTDGAQIAKPQNIVIAPPSPQANQAEEAKRQQAEAEKVARRKAEEAKRQAAELLAKQKAEAEAQALAARRQAEAERKARELAEREKAEAERKAAELAKQKAEQAKAQPKRRRRRAAPQNNVAIAQAQEARRQQAEAERVARLKAEEAKRQSEMLARQKSEEERKARELAEREKAEAEKVARRKAEEAKRQAAELLAKQKAEAEAQALAARRQAEAERKARELAEREKAEAERKAAELAKQKAEQAKAQPKRRRRRAAPQNNVAIAQAQEARRQQAEAERVARLKAEEAKRQSEMLARQKSEEERKARELAEREKAEAEKVARRKAEEAKRQAAELLAKQKAEAEAQALAARRQAEAERKARELAEREKAEAERKAAELAKQKAEQAKAQPKRRRRRAAPQNNVAIAQAQEARRQQAEAERVARLKAEEAKRQSEMLARQKSEEERKARELAEREKAEAERKAEELAKQKAEEASHQAKVQPKRRRRRAILPRPPAPVFSLDDYDAKDNSESSIGNLARVTPRMKRELIDDFEEIPLSALEEAETTTNITDNIGKDIQEILDDEFENTDIEPLIDSLGQVVRLQPRTLSPMENMSQAQAISKNTNTALSDAMVSSQFILLDTGSSLVQQITQTELSANKENNVWVSNTTYDRHYSSTQYRQFSAKRSQIQIGIDHYLSKNTQVGTVLSYVRNSNVFDQASGKNTFVQANTYGKYYFDYGWYISGDIGVGQLRSQLQTQQKAKFNRIATQAGIMIGNRIDINRFEILPSIGVRYSYLSSIDYKLGSDSLKVDSISIKTALAKLDLAYQFNIGEFALKPILSMAYVINSGEGIVNIGGQNYRYKSDNQQQYSAGMALNYRSLTFNINGGAIKGRQLSNQKFLQIKMQVSF

SEQ ID NO: 13124 - protein, 746 aa, Providencia alcalifaciens DSM 30120
MTRCVGNDRRERPMSAAIAPLGLLSAALLCALSTLAPAAAHAAEAADATNATTLDQVSVNGTVSRAQPATTTRLPLTLQETPQSVSVIGLQRLEEQSLFSIDDVMRHVTGVNVSFYDTQRPLYFARGFQITDFQVDGLPTYSGATNQEYDTVFYDRIEVIRGANGLLTGAGIPSATVNLLRKRPGKDFDASFGVSTGTWDFRRMQADVNAPLTEDGRFRSRVVAAWQDRDYYYDRYHDNKMSGMAVLEGDLTESSTLTVGYQRQDNTPVGSTWGTVPFFAADGSFANLSRSTNMAPEWTRWQRETSTAFANLEQRFGQDWLLRVNTAHTKGAVQSLRVYGTGYPAADGSGVFLRANAGETQDTRDSVDVYLSGGFALFGRQHDVVIGGSWQDLQSTTYTVAQAYPDDWATCGSERCYFIPNIRNWNGDASEVTYARTGARRQARTTQRGVYASTRLRLADPLSLIAGARLSSWETRTQAFDASGSYTGTSGRYEVSDEVTPYVGLVYDIVPDVSVYASYTEIFNPQNYRDKDNNLLAPVEGSNLEAGIKAQLFDGHAMATAAVFEAKQDNYAVRDMTQPEASLPDGSSAYIGVDGTKSRGWEVDVNGEVRPGWTINAGYTHVKVTRAPTDAIYANLPEDYLQLSTQWRLPGTWDRLSIGGGVSWQSAVRGFNIARPTGDGTGATRPVTVEQNPYALVHFNANYRISDQWTATLAVRNALDKTYWANLDYQNYGEPRFVSVSLRWRY

SEQ ID NO: 13125 - protein, 731 aa, Providencia alcalifaciens DSM 30120
MEFILRKLVRCIHITFFLIIFFSSKIVYSADFTFPTSLTTDTSDFVLLSDTGTTPSVSGFSTEVLITITTTAGYIKVTTVTGLEQIHGLCGYTADSSSVPTNCTDSDRSEIGFQGTQAEVNTALATLSFKGDGATSNTTISVSATPEGASYNPVNGHYYRVLGSFTTPPQAVDWADARTEAKSDAKKFNGLTGYLVTITTEQENNWIKEKISTNAWTGGSDSETENIWKWMDGPEAGQTYTCQKYVEASVGGTGATISGCSEQSYLNWVPGEPNSHRTASDGWDEDYMHLYGDRTDVKFGQWNDFPSPATVGNNVVTKYIVEYGGMGGTATVFGSASLSINSTEVDFFVDKDLVGIVEGQSESAKRFIYSSTYPVLERMEWYRTTKKNDNIKFQDLGIDIDITNKDTYPYAKLLDAYLLKGDVNKEQKLSNKNIEKFISELPLSQYLKNEFGMVPRKWKIWSSGYFKKGKIKLKSGKVNKEFDSDALTLGMDKIIRKNTLFGIAIRLQDEDTDVGQSGTQIKSDAKSATIYSSWHKNSSTFIDSLIGYGYIENDLTRVVQANPSNPLTGNRGVKQYFTSIKFNKIRDKDNFTSLLFGRFDYGLSKLESFSELGNTHALRFEEQNLKNKSISIGALTKYKKKIKKGYFLPYGRIEFFENLTPDSEAKASYISDPNTTYYYTVKEDYSNSLKLELGFDLNLIDSWYFSTSIRRLIKNNKDYENEFAIKVSKPF

SEQ ID NO: 13126 - protein, 1070 aa, Providencia alcalifaciens DSM 30120
MKNLLKVFLMCFITLFAFAGQMMGQQKTITGRVVDALNEGMPGVNVQVKGTTSGTITNIDGDFSISVPNTKSVLVFTFIGYVKQEVAVGNQTKLNIQMKDDTQSLDEVVVVAYGTARKGDLTGALTTMRPDANEAAKAVSIDNLLEGKVAGLVVSTASSNPGAASSITIRGASSLRGDNQPLYVIDNIPQASTGEFSSSGISGDFQIAQDPLSSLNPADIEDITILKDASSTAIYGSRGANGVILITTKKGKEGKAKVNASATFTIANASRLLEMMNLEEYAAYHNSRITDGKVPFHIVGDEVRYVFNGAYDKYDPADPETYNVVNYRNWQKEIYTSAFSQNYSLSVNGGAGKTTYYISANFKDINGTVKQTGLKQGDLRANLSAQLSKSVDLNMALSGSLRQNNMMAGGNTLGGATGAISRTALDYAPFELPENDPSFTNENKTNVFSWLNDYVDLTDDKTFKASLNLNWKINKFFTYSLRAGGNINTNDRKRWYGMQLYQGMNNQGYLATSNLSKSNYSVENIVNYNTKLGSVGTLAATVGMTYDDYNFLNKNVIGKNFTMFEFRENGMHMAGDVITSQPIQKDYQLLSYLGRVNVSLLDKYLITASLRADGSSKFAKNNRWGYFPSASIAWRMEQEEFLKDVSWLNQLKLRFSYGATGNQSIDPYTTFSMYGQGSGEISYADGTGNKTTAMVVTNLSNSSLKWEKTSSWNVGLDFGLFNSRLSGTLDIYQKKTTDLLISRNLPGSAGFSSTYYNQGSLNNKGVEFSLNAQIIDSSSWKWSVSGNIGVNRNEISDLGLLPADFGCLGERVGYYGNSLGDHFGVGHIFLAGEAPGLFYGYVTQGIVQKEDITENGIKYIKQDGSVGYYQTVNKTTPVAGDVKYVDRNGDGVVDDNDRDIIGNPNPDFTYGFQTKVSWKSLSLSASFNGVQGRDILNVGNRYNNTPGTKSNNVTRKAFQNMWTDENPSNLYPKSTFVVQNMVMDRYVEDGSYLRCSDITLSYVLPAKWTNKIGIKNTSVYASVKNAFVITDYSGYDPEVNSFAFDGLRPGVDMNSYPTPRSFVFGLNLTF

SEQ ID NO: 13127 - protein, 326 aa, Providencia alcalifaciens DSM 30120
MNKIILMIPLALFVSNSVHASTDNPWYVGARAGASHITNMDDAVTSVTKLEDTNFAGGVFAGYQVTPWFALETGYTHLGNAELDNKQGSYEAQGADLVTKFSYAISDSVDIFAKAGAFYYDWNAIGSGVSNSDNGWSPTAGAGIEYFINKNVSTRLEYQYYNDVAGPDIHFAGLGLAFHWGAPAPVVVEEPIYVNQVTIATLEELRLTVPFAFDSSTITKGDAAKLAPFEQRLKEQDAAKIYVVGHTDSRGAESYNQTLSVKRAEAVADALRQHLKMDSTRIIAQGRGESEPVASNQTEEGRAQNRRVDIISPSLDIETLTQVIAE

SEQ ID NO: 13128 - protein, 202 aa, Providencia alcalifaciens DSM 30120
MNYKDIINACILSGVFLLHSPSALADTPSVGVSKGQESLQPAAEGNLWQRLIRNVSLAWNSPHQELYIPVNTWHNRWTYDDEKIASYNERPWGVGYGKYRYDEDNNWHSVYAMAFMDSHNRVEPILGYGYQKMWIPGEREGWRFGAGFTASITARYEYHYIPLPLPLPLISIEYNRLSLQTTYIPGTYNNGNVLFTWIRWQF

SEQ ID NO: 13129 - protein, 659 aa, Providencia alcalifaciens DSM 30120
MVVFTKRKIAVSIIAAISVAPAFADDSKDKIYVTTAAGYQQKIEDAPASISVVTREQLENKAYRDVTDALKDVPGVLVTGGGSSSDISIRGMDAKYTMILIDGKRVDTRSIRPNSDGSGIEQGWLPPLPAIERIEVVRGPMSSLYGSDAMGGVINIITRRVQQEWTTSLRADTTITERKNSGNTGQGSFYTSGPLVDGLLGMKLQGQYSHRSEDKIIDGFGRQIMTSGGGTLSFTPNEQNAFDLDFKKDNQHRDYREGYTAERGDGSEFNKYDMTHAALTHTGIYDIASTDTYLQYDEAKNPGRKMTSEDLIFRNQSVFLLGDHSLSLGGQYRKEKLKDQSNKIPGNSELDRYSWALFAEDEWLITNDFALTGGLRMDNDENYGTHWTPRMYGVWHADEQWTIKGGVSTGYKAPSLRESSANWGQATGGAKGNAIIYGNPDLKPEKSVTEEIGVIWNNQDNLTAGVTIYNTDFKDKITEIRRCDNSIDTIRDCTLADGEGNIPNKPYRFVSDKANVDKARMQGVEVTFNWGILDNLEFATNYTYTHTEQKSGVNKGKPLSKQPKHMVNSTLTWDTTEDLQTWTRMNFRSETSDYQGRGQQMAKGTPSYALFDLGASYKLSKNANIVGGVYNLLDRRIDNETYGAELEGRRYNVGINYNF

SEQ ID NO: 13130 - protein, 795 aa, Providencia alcalifaciens DSM 30120
MKVKILLPLLSFCLMLLTSVTSFAQTATIKGMISLSTNEAADNVSVTLKGTRVGTTTDAQGNYEIKNVKPGTYTIRVSAVGFSSKEKSITVSSANEIVENFTLITTSENLTEVFVKGNANKYTKSESEYVSRMQVKNLENSQVYNVVTKELMKDQLVTNQDEALKNVPGLYQLWGATNRAGDGGSWYSLRGFTTQSLVRNGIAGKVNSNSDAANLERIEVIKGPSATLFGNVLSSYGGLINRVTKKPYETFGGEIAYQAGSYGFNRVSADINTPLNDDNTALFRLNTSYNNTNTFQDYGSSRSFFVAPSFSYKVNDKLTLSLDAEIGDQNNSGMPLIYLPFDVSVAALGFNNAKDLNMNFKRSFWGDEFITNTKTFNVFAQANYKISDEWTSQSVFSSTSNRASGLQTWFYLYPNEEISRNAWNANGKDNAIEFQQNFNGDFLLFGKMRNRFLIGGDLFHSTNRLGYRLLPNGEFDKIGYTGTTAAYNNFNPTTVNAELVNGFDYKTNSALSTYSAYVADAINITESLIVSAAVRFDHYDNQGTTDDTTGQKAGDFSQNAFSPKFGVVYQVIKDQVSVFGNYQNSFTNIGYINANVGGALQMQKFDPERANQFEGGIKVNAFQNKVSATLSYYDIKVKDIVTADPSLPNASVQNGTQYSKGFELEVTANPIPGLNLLVGYSNNDSKLNGLRPVTAGPENLINYWISYNLQNATFKGLGLGFGGNYGDATYIYNNGTETFELPSYAVINAALYYDQPKYRVSLKVNNLTDELYFNGYTTINVQAPRTFMGSVTYKF

SEQ ID NO: 13131 - protein, 84 aa, Pseudovibrio sp. JE062
MHLKTISNAYNTKVNTANFQFLFNAGLRMNLARPKKKDGDHATQHGIELCAKIPTLNMSYNSFLGAKLEYRRLYSVHLNYVFAY

SEQ ID NO: 13132 - protein, 261 aa, Bordetella pertussis
MKFYSALALAGAFAASLALPATAQEWYVSGSAGYVLQNDSSNSGTTGAFTTGNGAPALPFGTAIAAGTPYGWETEFDNGYAIAGEFGGFYENGFRSGLELVYSKADVDTHSGVNVAGTVIDGVDAAVLTGSPTQLGATVGAVVADGQGDLKSTSVFANIYYDFNRDGMIQPYVGAGLGYSDVSVDYSPSGVGIIDDSEGKLAYQIKGGASWAITDKIDLFGEAVYRATDDVELSNQLFPGTLNIENTQTVLSVGARYRFGG

SEQ ID NO: 13133 - protein, 661 aa, Brucella abortus
MKFTRTLVLASTSLLATVATSQAQEVKRDTKKQGEVVLKPITIISHGKDNIEATGGTVLTYKDIEKLQPANVSELFSRQSSIAVSGGGGPSKRIHVLGMEQSNLAVSVDGVPQTATSWHHTGSNVIDPAFLKRVEVEAGAAAADSGFGAAAGAIRYETVNALDLLEPGKTFGARIIGSYGTNGRGFSGSTAAYGLKDGFDWLLMLHGTSGHNYKNGDGTEILGTEPAARNILGKAGYEFDGNRIDIGYERSRDKADRLIKMNMGLPGDTEYPLEVARDSVNIKYTRTDATDMWDPEVQLYYNRNDYWRNDYQNRTNGNMILKEDLYGGKLQNTFTIDYGKITAGIDFGKHDYNTDNYGHNDRRYRKFNTQQVGAFTQGRFEFDNGFSLSTGARYDYSRFADWNDEVFSDSGASVNGTLSYKFNEHIEVFAGASRTWLGYVLGDYGYVHARNNAFYTDPTFSPGRARNYKAGVNFGGADWSAGITLFDTRIAGLPNYDSQKLGNDPEEYRSRGFTLNARYIWNYTTIGATFTKAKVTAGDDPVLPNSGSFMPIGDMATLFIDQEIPDYNMKVGATLAWAGRISDEAATAANFYDQPAYTVVNAYAEWNPPAVKNMTLRVGVENLFNENYYERTSFAPSQNRGGIDPVWAPGRTFTFQTAFKF

SEQ ID NO: 13134 - protein, 900 aa, Brucella melitensis
MKFTRFGRGATVRSALLVGTAALAMPTAALAQDEGEDQAAVYDDAEEQAESPDPNVIVVTATKREQTLQEVPVAVSVTTAETIEQAQIRDIADLATVVPSLRVSTLQSAFATSYSVRGFGTDGNNIGLEPSVAMFVDGVYRSRAIAQISDLPDIQRVEVLRGPQSTLFGKNASAGVISLVTKRPEFDFSGSVEASYGNFEAKVVKGYITGPISDSIAFSAGAGWNNRDGYLTNGFNGEDVNDRNRWFTRGQLLFDNGGPLQARIIADYDEIEERCCGVVNVRPSLETSVIRLIGGQVNDFNNNPDGDVIFTDVDPINEVQNYGISGQLDYEFGAITATSITAYRETSLAADQDVDFTSASLATGANIGDADIDTFTQELRFSSDFDGPFNFLLGGYYFDESVSTRDQIVYGSDFRPYADLLVQGLTGGTQSIPTLEATLGALNGTDFTGQFFAEGQGFFNSISQDNEAYSIFGNVDFEFTDALVLTLGANYTKDKKQIVTDSVSTDVFSNIDLVASGNRAIFAEGLAGQVGSILMLGRPASQAEIGAFAAANPAAFGQVSAGVQAFADANDTNPAVNPLLGLTPLQFLPPLQNCPNAVEDCATDDDQWSYSVRLAYEISPTLNAYASWATGYKAPSFNLSRDSRPLPGDFAALQAQGLAVNNLRPGTRFAAAETSEVFEVGIKANWDYAAANLTIFQQNIDDFQANTFVGSSFVLSNAGKQETFGIEFDGNVRPTDSLTLNIAMTYLDAIYDEFTGSAVGDLSGLQRAGVPELSAVFGASWNKEINDAGDRFILRGDFSYQSQIPALDGFPNFIETDPATGEQNFQPARDIAQFYTREVNSLNASATYAFAMGLELTVWGRNLLDDRYLTTFFPSVAQGQSISGYPNQPRTYGVAAKFKF

SEQ ID NO: 13135 - protein, 661 aa, Brucella ovis
MKFTRTLVLASTSLLATVATSQAQEVKRDTKKQGEVVLKPITIISHGKDNIEATGGTVLTYKDIEKLQPANVSELFSRQSSIAVSGGGGPSKRIHVLGMEQSNLAVSVDGVPQTATSWHHTGSNVIDPAFLKRVEVEAGAAAADSGFGAAAGAIRYETVNALDLLEPGKTFGARIIGSYGTNGRGFSGSTAAYGLKDGFDWLLMLHGTSGHNYKNGDGTEILGTEPAARNILGKAGYEFDGNRIDIGYERSRDKADRLIKMNMGLPGDTEYPLEVARDSVNIKYTRTDATDMWDPEVQFYYNRNDYWRNDYQNRTNGNMILKEDLYGGKLQNTFTIDYGKITAGIDFGKHDYNTDNYGHNDRRYRKFNTQQVGAFTQGRFEFDNGFSLSTGARYDYSRFADWNDEVFSDSGASVNGTLSYKFNEHIEVFAGASRTWLGYVLGDYGYVHARNNAFYTDPTFSPGRARNYKAGVNFGGADWSAGITLFDTRIAGLPNYDSQKLGNDPEEYRSRGFTLNARYIWNYTTIGATFTKAKVTAGDDPVLPNSGSFMPIGDMATLFIDQEIPDYNMKVGATLAWAGRISDEAATAANFYDQPAYTVVNAYAEWNPPAVKNMTLRVGVENLFNENYYERTSFAPSQNRGGIDAVWAPGRTFTFQTAFKF

SEQ ID NO: 13136 - protein, 661 aa, Brucella suis
MKFTRMLVLASTSLLATVATSQAQEVKRDTKKQGEVVLKPITIISHGKDNIEATGGTVLTYKDIEKLQPANVSELFSRQSSIAVSGGGGPSKRIHVLGMEQSNLAVSVDGVPQTATSWHHTGSNVIDPAFLKRVEVEAGAAAADSGFGAAAGAIRYETVNALDLLEPGKTFGARIIGSYGTNGRGFSGSTAAYGLKDGFDWLLMLHGTSGHNYKNGDGTEILGTEPAARNILGKAGYEFDGNRIDIGYERSRDKADRLIKMNMGLPGDTEYPLEVARDSVNIKYTRTDATDMWDPEVQFYYNRNDYWRNDYQNRTNGNMILKEDLYGGKLQNTFTIDYGKITAGIDFGKHDYNTDNYGHNDRRYRKFNTQQVGAFTQGRFEFDNGFSLSTGARYDYSRFADWNDEVFSDSGASVNGTLSYKFNEHIEVFAGASRTWLGYVLGDYGYVHARNNAFYTDPTFSPGRARNYKAGVNFGGADWSAGITLFDTRIAGLPNYDSQKLGNDPEEYRSRGFTLNARYIWNYTTIGATFTKAKVTAGDDPVLPNSGSFMPIGDMATLFIDQEIPDYNMKVGATLAWAGRISDEAATAANFYDQPAYTVVNAYAEWNPPAVKNMTLRVGVENLFNENYYERTSFAPSQNRGGIDAVWAPGRTFTFQTAFKF

SEQ ID NO: 13137 - protein, 136 aa, Salmonella typhimurium
MNPLVWCLRADVAAELRSLRRYYHLSNGMESKSVDTRSIYRELGATLSYNMRLGNGMEIEPCLKAAVRKEFVDDNRVRVNSDGNFVNDLSGRRGIYQAGIKASFSSTLSGHFGVGYSHGAGVESPWNAVAGVNWSF

SEQ ID NO: 13138 - protein, 517 aa, Citrobacter freundii
MIKKNRTLFLSLALCASISYAEDDGGFFTVGYQLGQVMQDVQNPGSTKRDELERELNAGVTNNILGNNTGGNVAGALSNAFSQYLYSLLGAYPEKLNGNDVSANALLGGAVGSGTCAAAGTAGGNSLTTQSACTAAGYYWLPSLSNRVLSTIGSQTNYGTNTNFPNMQQQLTYLNAANVFFNAMNKALEAKNGTNGTNSAIGSSGQTYSQQAIQYLQNQQNILNNAANLLKQDELLLEAFNSAVAANIGNKEFNSAVFTGLVQGIIDQSQSVYNELNKNPISGSAFNNATSNTLTNQANAVQGRANQLSNALYNAQVTLDKINALNNQVRNMPYLPQFRAGNSRSTNILNGFYTKVGYKQFFGKKRNIGLRYYGFFSYNGASVGFRSTQNNVGLYTYGVGTDVLYNIFSRSYQNRSVDMGFFSGIQLAGETFQSTLRDDPNVKLHGKVNNTHFQFLFDFGMRMNFGKLDGKSNRHNQHTVEFGVVAPTIYNTYYKSAGTTVKYFRPYSVYWSYGYSF

SEQ ID NO: 13139 - protein, 614 aa, Escherichia coli O139:H28
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRIEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVTVGHGNIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDVPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 13140 - protein, 614 aa, Escherichia coli O9:H4
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARNDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 13141 - protein, 614 aa, Escherichia coli O1:K1 / APEC
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 13142 - protein, 614 aa, Escherichia coli O6:K15:H31
  misc_feature (609)..(609): Xaa can be any naturally occurring amino acid
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLXGSYTF

SEQ ID NO: 13143 - protein, 614 aa, Escherichia coli O6
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAYTHGYDVVAYGNTGTQAQPDKDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 13144 - protein, 615 aa, Escherichia coli
MIKKVSLMTALSVTAFSGWAQDSADSLVVTANRFEQPANTVLAPTSVVTREDIERWQSTTVLDVMRRLPGVDTAQNGGMGQASSLFVRGTNSSHVLILVDGIRLNQAGVTGSSDLSQFPISLVQRIEYIRGPRSAVYGSDAIGGVVNIITTRAKDGTTLNAGVGSHGYQNYGGSTQQTLGDNTRVTLAGDYTYTKGFDVVADGNNGGLAQTDRDGYMNKTIYGALEHAFSDQWSGFVRGFGYSNRTAYDAYYSSFTPDVLVDTRQLYSQTWDTGLRFNDGIFHSQLLSSYSHSKDYNYDPHLGRYDSTATLDEIKQYNVQWTNSVDVGHGNVGAGVDWQKQSTEPGTNYVTNDTNLRNTGVYLTALQKFGDFTLEGAARSDDNSQFGRHGTWQSSAAWEFIEGYRFIASYGTAYKAPNLGQLYGFYGNDHLNPEESKQWEGAFEGLTAGVSWRVSAYRNDVDNLIDFDSNLQQYYNVGKARIKGVEATASFDTGPLTHTVGYDYVDARNAATNELLDRRAKQQVKYQLDTQVYDFDWSLTYHYLGTRYDTDFGSYPYQKVKMGGVSLWDLAVSYPVTSHLTVRGKIANLFDKDYETVYGYETAGREYTLSGSYTF

SEQ ID NO: 13145 - protein, 615 aa, Enterobacter sp.
MIKKVSLLTALSVTAFSGWAQDSADSLVVTANRFEQPVNTVLAPTSVVTRADIDRWQSTTVLDVMRRLPGVDTAQNGGMGQLSSLFIRGTNSSHVLILVDGIRLNQAGVTGSSDLSQFPIALVQRIEYIRGPRSAVYGSDAIGGVVNIITTRAKDGTTLNAGVGSHGYQNYGGSTQQTLGESTRVTLAGDYTYTKGFDVVADGNNGGLVQTDRDGYMNKTIYGALEHAFSDQWSGFVRGYGYSNRTAYDGYYSTFTPDVLVDTRQLYSQTWDAGLRFNEDIFHSQLLSSYSHSKDYNYDPHLGRYDSTATLDEIKQYNVQWTNSVDVGHGNIGAGIDWQKQSTEPGTNYVTESYDLRNTGVYLTGLQKFGDVTLEGAARSDDNSQFGRHGTWQSSAAWEFVDGYRFIASYGTAYKAPNLGQLYGFYGNDRLDPEESKQWEGAFEGLTSGVSWRVSAYRNDVDNLIDFNNNLQEYYNVGKARIKGVEATASFDTGPVTHSVGYDYVDARNAATNALLDRRAKQQVKYQLDTQIYDFDWSLTYHYLGTRYDTDFGSYPSQKVKMGGVSLWDVAVSYPVTSHLTVRGKIANLFDKDYETVYGYQTAGREYTLSGSYTF

SEQ ID NO: 13146 - protein, 1003 aa, Enterobacter sakazakii
MIKKILFLFFVVFAATAYSQDVTITGTVTDANSEPLVGVNVLVKGTTTGAITDIDGNFSVSGKKGSTLVFSYIGMLTQEVVYKGTALRVVMKDDSKALEEVVVIGYQTVKKSDLTGAVAVVDTKEMKKSAAGTLVSQMQGLATGINVRSSGRAGEDASIEIRGVGSLSNNSPLWVIDGMITDPGVDFNPADAESIQILKDASAAAIYGSRAANGVIIVTTKKGTKGPMKVNVSVKETLEWSPKFDLMNAAEYIKYNDIAYNEAIKDGIATVNSTQKHSQYDTNWQDEVLKTALVQDYNVSLSGGGDSGSYFVSAGYYNNDGVSYGNTFDRYSFRVNTQGKKGWFSFGENLAYSLTNTDPNQTNTYNDFLRMMPTIPIYDENNPGGYGYGDAAKYNTFGVNPIAREDLEYRHFRQNRLNGSLWLEFKPFEFLSYKFNGGIDLYFYENSWFRGEGNWTQNQEHRDPESQKARDNTYNMLIEHTLNFNKDFGKHHVDAVVGTTYQHHEWEGLWASRLNFPMLGNGDYLTVLNAGQSNQQNSNSISENAMISYLGRANYIYDDKYYLTATFRRDGTSRLAKENRWGNFPSFSGAWRISKEEFFDVPWINDLKIRGNWGRLGNSSIGDWDYIGTINQSIVTVFGGAIVPGSTQVKLVNAGLVWETKETVNVGFDASFLNQRLTVSAEYYNSKTSDVLAETPIAISTGNQGGSPWKNAASLRNKGFEFTLGWKDQISDFKYSALLNVTTMDNEVLSLGRDGTNRDYIDSGQARTKPGRSLAEFYLRKTDGIFKTQEQIDNYVTSTGTPIMIEGKRPQLGDVKYLDLNDDGEITDADRGYCGSPWAKMQMSLVFNAEWKNFDFSMMWNGQFGNKIYNVSRWQGRLFADNSNYIRFKKGEEPYQVNPNSNTPRIIYGDFRNSRDADRFLENGSYFRMKNISIGYNFRQDWLKNLGVEKLRLFATGSNLITITGYSGLDPDFKGANSVWNSGTDSFAYPNTRSVMFGLDLTF

SEQ ID NO: 13147 - protein, 616 aa, Erwinia carotovora
MIKKISLLTALSVTAFSGWAQDSGSDSLVVTANRFQQPVNTVLAPTSVVTREDIERWQANTVIDVMRRLPGVDTAQSGGMGQLSSLFIRGTNSSHVLILVDGIRLNQAGVTGSSDLSQFPLALVQRIEYIRGPRSAVYGSDAIGGVVNIITTRAKDGTTLNAGIGSHSYQNYGGSTQQTLGDNTRVTLAGDYTYTRGFDVVAEGNNGGLAQPDRDGFMNKTLYGALEHAFSDQWTGFVRGYGYSNRTAYDGYYNSFTPDVLVDTRQLYSQTWDAGLRFNNDLFHSQLLSSYSHSKDYNYDPHLGRYDSTATLDEIKQYNVQWTNAVDVGHGNIGAGVDWQKQSTEPGTSYVTNGYDLRNTGVYLTALQKFGDVTLEGAVRSDDNSQFGRHGTWQSSAAWEFIEGYRFIASYGTAYKAPNLGQLYGFYGNDHLDPEESKQWEGAFEGLTAGVNWRVSAYRNDVDNLIDFNNNLQEYYNVGKARIKGVEATASFDTGPLTHTLGYDYVDARNAATNALLVRRAKQQVKYQLDTQLYDFDWSLTYHYLGTRYDTDFSTYPTQNVKLGGVSLWDVAVSYPVTSHLTVRGKIANLFDKDYETAYGYATAGREYTLSGSYTF

SEQ ID NO: 13148 - protein, 678 aa, Photorhabdus luminescens
MINKGKSWRLATVAAALMMAGSAWATEYSASFKNADIEEFINTVGKNLSKTIIIEPSVRGKINVRSYDLLNEEQYYQFFLSVLDVYGFAVVPMDNGVLKVVRSKDAKTSAIPVVDETNPGIGDEMVTRVVPVRNVSVRELAPLLRQLNDNAGGGNVVHYDPSNVLLITGRAAVVNRLVEVVRRVDKAGDQEVDIIKLRYASAGEMVRLVTNLNKDGNTQGGNTSLLLAPKVVADERTNSVVVSGEPKARARIIQMVRQLDRDLQSQGNTRVFYLKYGKAKDMVEVLKGVSTSIEADKKGGGTTAGGGNASIGGGKLAISADETTNALVITAQPDVMAELEQVVAKLDIRRAQVLVEAIIVEIADGDGLNLGVQWANTNGGGTQFTDTNLPIGSVAIAAKDYNENGTTTGLADLAKGFNGMAAGFYHGNWAALVTALSTSTKSDILSTPSIVTMDNKEASFNVGQEVPVQSGSQSSTTSDQVFNTIERKTVGTKLTVTPQINEGDSVLLNIEQEVSSVAQKQATGTADLGPTFDTRTIKNAVLVKSGETVVLGGLMDEQTQEKVSKVPLLGDIPVLGYLFRSTNNTTSKRNLMVFIRPTILRDAHVYSGISSNKYTMFRAEQLDAAAQESYLTSPKRQVLPEYGQDVAQSPEVQKQIELMKARQQATADGAQPFVQGNK

SEQ ID NO: 13149 - protein, 606 aa, Photobacterium profundum
MKKTLLAVALAPLCLPSQAFAADESSNDVMVVTANRFEQPIKNVIAPISVVTKEEIDAIQAKSIAEVLRRLPGVQVVSGGYGQATEVYVRGTTSRHLLVMINGVRIGSATLGSADFSQIPLTGIERIELIRGSRAALYGSDAIGGVLNIITAYQPGESVAEVTAGGGSKGFYQLGGSVAGGLGESGWGKIALKTEGDDGFSARKEPFEQDDDGFKNSNVVAEVGTHVGDHWKLSLQGYYHDGESDYDDSYGAPHAQSESSLFNIAAKAGYSNDKLDSQFTVAQNQDENRNFNDVSNGSKIKTERTVANWQNHYQLTDGLELGGGLEWYRDSVSNTGTQYAEDERDNTAVYLTSIYRISDWQFEGSVRTDDNDSYGTNNTWQLATAYNITSELKVSANAGTGFKAPTFNDLYWPDSGNPNLKPEESKNYEISLSGTHQLLDWSVTGYQSEIDQLIAWAPKDASNPSGDWIPMNVDEAEIQGVELTAGFATGMLYHDVSYDYLDAKDKGLDKQLIRRSKDSAKWNVSYLADQWQLDVSAIYKGTSYDDAANTKKLDAYTLVDVAASYFVTDNLSVRGRVANLFDKDYVAKETYNVQERSYYATATYKF

SEQ ID NO: 13150 - protein, 614 aa, Salmonella typhi
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATVIGDYKYTKGFDVVAKGGTGMQAQPDRDGFLSKTLYGALEHTFSDRWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 13151 - protein, 614 aa, Shigella dysenteriae serotype 1
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDNTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 13152 - protein, 614 aa, Shigella flexneri serotype 5b
MIKKASLLTACSVTAFSAWAQDTSPDTLVVTAIRFEQPRSTVLAPTTVVTRQDIDRWQSTSVNDVLRRLPGVDITQNGGSGQLSSIFIRGTNASHVLVLIDGVRLNLAGVSGSADLSQFPIALVQRIEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKALNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 13153 - protein, 1233 aa, Shigella flexneri
MIKKARKLIPFFLIGSLLAEDNGWYMSVGYQIGGTQQFINNKQLLENQNIINSVTQSAINIAGPTTGLITLSSQSVIDALGYGVSNTVGNQLEGISNILNQIGKRKDFYSSRQISSISQQIIGLKGSSDPLKAHSSQITAKLLSNTQSAFDEGIALSTSIISSINSLNPSNNTQEVKAQLQNTVQSMTELLQQIEHSITKTTSTTYAQSLLSNLTDAVNASSNNTTYVSALVNALNTLGVGVFPTTTSTHVVLNPPGQVVFYPTNSLLGSTSSNSNNQQQYNNTLLMNTLQGALSANNQNNPNGCTNQVQCLEQFIQNLAPLAATPTSNNQANQQVQAIAQKLQSVAINTLDNNAINNTTYNLNNLHNALNFQAYESTIEQYNNALKQISWISFSEPKNLLKNTSNNYQIGTVTNAQGQNISAYDCMTATGSLSSDASSGISCSATSSTSSTNSFDNSLVATSKIQTINGKEQIGVNSFNLVSQVWSVYNSLKTSEANLQKNANILCANGTPSGTSSCNSSSGGLSISGNAQLQNILSSTSGTTTTTQAKSNAPKKAMVVVNNEEEAKTTNLAQSGGPTTQSPNSTVMGALNTVLQNVSNFQQSIQSAFQNQESNIQAWANAIYNTNRSQSQYMTPNNNQDLHIQLRANFYQLINTINQQVPTDMNALISQSQQTQQTSGSASTTNNACASGTNGSGSNWCYQQWSDSKAYYSGLQSALGYQTQATTQSGSSGGNSITYNVQQITLTSGGLLNQIITNLKDVNGGNGASGGSSGIRNGTSQINTAYQMLTDASDGKLGTYSGSGGSGSNNGYTPCNSTNGSNRTNCYEPNKQQNATTATTNENNSLQKVYNDAQKIANIIASSGNNKGVENGLKQFFEALKSNSSSLSNLCNGSSGSSGSGATCTGGLINLLGAIPTNGVSDTNNLINLLTEFIKTAGFIQNNNNNSNNANLTSAFQAITSAISQGFQALQNDISPNAILTLLQEITSNTTTIQAFSQTLRQLLGDKTFFMVQQKLIDAMINARNQVQNVQNQANNYGSQPVLSQYATAKSTQHGMSNGLGVNLGYKYFFGKARKLGLRHYFFFDYGFSEIGLANQSVKANIFAYGVGTDFLWNLFRRTYNTKALNFGLFAGVQLGGATWLSSLRQQIIDNWGNANDIHSTNFQVALNFGVRTNFAEFKRFAKKFHNQGVISQKSVEFGIKVPLINQAYLNSAGADVSYRRLYTFYINYIMGF

SEQ ID NO: 13154 - protein, 393 aa, Vibrio harveyi
MRKTCPIVVCLLAASLAFFPLPGAGEEPAANMEGTLETQKNGQRIKLGGAVMLDLDSASSEFWDEEEEKPDDWQTRLELRRVRLSIKAKLPDGFKTKLQFDFAGDDGTVEIKDAYIRYDGFKVVDITVGQHKEPFGLEATTSSNKLSFIERSMVSDAFRPGRNIGISCSGGPERISGQIGVFDTGTNESDEENIFEMSGRLGVLPWKSKTGFFHLGVSGAYQYYGGKEFEIKEPAQIHTADNIVFSDEIHADYVTIYGLEGAFGKGPFSLAAEYMSAEIKAVGTDDKADFNGYYFSGSWFLTGEAKPFKDRDWGQVRPESSWGAWELAARYSYIDAAENDYGTLASAYTGGVNWHINSFVKLMVNYQHLRLMDDKTKGDNVEEAVSLRFQCVF

SEQ ID NO: 13155 - protein, 613 aa, Vibrio vulnificus
MQKSLLAIAMASLLTPISYLHAQEVQTNDTVVVTANRFEQVESSVLASISVVTKAEIEQLNVTTALDILKTLPGVEVNSQGGKGQISSIFLRGTSSKHTLVLVDGVKINSATAGGASLGLIPAFAIEQIEVVRGPRAAIYGSDAIGGVIHIKTIPANRQTKHDANLGYGNDDHSSLAWRSSGQLNDSTQASFVFSDEKSDGYRVNEVAPSGDSHGYQSQTLFGSLRHEIDDAWSVQFNGYQLSSDVEYANQFSGVKNESNTDFYSIAGSLNFHKDNYSSQLMVSRSDNESWDGVASGMVAKTALFSSRNSVSWLNHWVVVPALTLAAGVDYDQENARQGGANATNYSKTEKDNKAAYVTAHFSKNIVTAEASIRSDDDSAFGKHNTWNLGLGIAPSDYVEFIASTGTGFKAPTFNDLYWPSSGNPNLKPETSKSSEVGIRSYLPFVQIDISAYRNEIEDMIDWAPTGPGGAWTPSNIDNAKIEGIEIEALFETGVIEHRVSAEWKDPRDKSDDSFLIRRARENFSWVSTYSADRFGFSAVANYVGDRKDSTGKTMDAYTLLDISANYKMTEALTLGARVGNLFDKEYQTAHSSGGKYYVGEGRNWFATVNYRF

SEQ ID NO: 13156 - protein, 1001 aa, Vibrio vulnificus
MQKSKCVSAARYSSKTVATGALCALSFTFGCSAYADYVEQGKLGDAASWRSAEFQSDWGLGRIQADQAYAAGMTGAGVKIGALDSGFDPSHPEASPSRFQAVTATGTYVNGTPFSVTGAINPNNDTHGTHVTGTMGAARDGVEMHGVAYNAQIYVGNTNQNDSFLFGPNPDPQYFKAVYGALADAGVRAINNSWGSQPADVTYATESGVRAAYAQHYNRGTWLDEAANVSRKGVINVFSAGNSGYANASVRASLPYFEPDLEGHWLAVSGLDASTGQRYNQCGLSKYWCITMPGRLINSTVPGGGYGIKSGTSMSAPHATGALALVMERFPYLNNEQALQVLLTTATQLDGSVTQAPTTSVGWGVANLERAMRGPGQLLGTFDANLGTGLTDTWSNNISDQALIQRQAEDTAEHATWQQTLISKGWQNGVASTASQQDQADYATGSARAAAAAQRQYQGSLIKSGAGRLILQGANTYRGETLVNGGVLSVNGSLVSAVQVNAGGTLGGNGQIGGLTARNGGVVAPGNSIGTLQVNGNVLLEPGSTYAVELSPAASDRIVATGSATVSGANMTLALLDNTPVALNSVPTQSVAGPQYNVLQAANGINGQFGSVTSNYAFLGGRLDYAATGVALNIEQTAAFNSVARTPNQAAVATAAEQLGAGNAVYENLLLTQNPASARDSFQQLSGEIYPAIGSVLINDSRQVRDAVGERLGASVLGGEGNTAAQDNVWIKALGAWGKTDSRDDTTGYTTSIGGLLAGVDGNVADDTRLGAVAGYSDSSLNMGSGTHSRASVDSYHLGAYVGHEIGALSLTLGGAHSWHRIDAQRDVQVGGAAGKEKTKHDAQSTQVFTEAAYRIRLQPATLEPFANLAYVHLNTDSFTEKGDAAALSAGSDNRDAVLSTLGLRALKTIAITERQKVDLSGSLGWQHNLSSTDSEQHLAFASGGGSFGIESSPLVRDAALVGAHASVALSKDARISLDYSGQLASREKSHGVGLSLNWQF

SEQ ID NO: 13157 - protein, 625 aa, Yersinia pseudotuberculosis serotype O:1b
MTIKKYTLLTALSVTAFSGWAQGNNTTDNNDEMVVTANRFPQPKSSVLAPVDVVTRADIDRWQSTNINDVLRRLPGVDIAQDGGMGQRSSLFIRGTNSSHVLVLIDGVRLNQAGITGASDLSQIPISLVQRIEYIRGPRSAVYGSDAIGGVINILTGRDKPGTTLSAGLGSNGYQTYDGSTQQKLGEDTTVTLAGNYTYSKGYDVVAGMPGAGGPRQPDRDGFMGKMLWAGLEHQFNEQFNGFARVYGFDNRSDYDGYTNYSNPLALIDTRKLSSRTYDTGLRYKNGIYASQFIASYNRTKDYNYSPLFGQHDITASLDEAEQYNLQWGNTFQLTNGMISAGADWQEQRTERKSSNQNTTADFTQHNTGIYLTGQQQISDVTLEGAVRSDDNSQFGWHSTWQTSAGWEFIDGYRLIGSYGTAYKAPNLMQLYSAYGGNANLKPEESKQWEGGVEGLTGPLTWRLSAYRNDIDQLIDYSNLTNGYFNINKATIKGVEWTGSFDTGPLSHQVTLEYLDPRNADTHEILVRRAKQQVKYQLDWQVADLDWSVTYQYLGQRYDKDYSTYPEETVELGGVSLWDLAVSYPVTSHLTVRGRIANLFDKDYEMVYGYQTPGREYYFTGSYNF

SEQ ID NO: 13158 - protein, 381 aa, Yersinia pestis
MTIKKSALAATIGAAVALTTFASQAEITVLKQDPQAGDPLSRLNFTVGGSIRPQFNMMTGDGDKGSYKRNGFDGGTRFRFAADYYLFDDISWVSYYELGVNIPALFNWDNHYAEGANDTSRRMLYTGLKSDTWGTLTFGQQNSVYYDVVGAKTDIWDYDMIGQAPGNGINGDYDGSYRSRKMLKYKKTVGDADIYASYLFEDSEYLPGNGLRYKRKGGGSLGLDYHLTTDLTWGAAWNYTRADMRNPDNGDSKSYDQNILGTALSWTPDNWTFSAGGGWYQNFLTTKKVSTDNYFAGDAWGIEYFAGYTFPVGQYAVKSIQPYFMGDRIQYVNGRNYQRIDNGVGISFQLDYGFRVDYEHVFTSSTDDLGDMNLVRLRYDF

SEQ ID NO: 13159 - protein, 2319 aa, Escherichia coli
MNKVFKVIWNSRLNIFVVASELARGYCKSTAGNTSFGSLLKYPLMSALAVSISCILTTGTFAADLQVYDFSPQDPFEEIISGSTHLTGGFSGIQRGETGYTWTTLGQAREDGLITGDSGQWVDKDIFRMGSQTKSINYTDPVTGSTVTMKVYDNNDMQTEAAKDFRVVVSQPVGKDGQYVDRNLYQVGAGASLDVDVGQKTGNWVGAADNQFNVIMKSSVNTQNLSSAYHVTNGGSLNYQSKTVVQLGNSDNNIKDASNALAWMTAADFVGEFDSVIGKQNITNIDEFKAYNDALIQALQDGQIQLTEAQYADELNKARDTSLHGIFADTGSIAADDAIRAFVNRDAVSYIHGVGSGTNVVIDKDANIQLVGSDATVVNLENGARLTNNGTLGTAGNTYRGAYIIAARNTSFVDNNGVIDAGTNPEMADFFSSGAAGVAQGAHTAILANGSSVINNNSSGVINVAARGNYYGNTGVLMSGNATLNNDGAINIAASNEANSILGNGANIGVVTQQNTTFNNRGTLYIGRLAQRAPDDANTDIAIKQQSIGVHLYGNGTYNGSDTSQIIIGSKVQNATAIDVGGNATLDQKGSININGAVTGESVSSNIGIIARAGTQAAKVVHDGIINLNGLNSTGIQVLENGQITSSGTININGGLDPVTHYANYGIYVQGEKALAILSGTVNLSGDGAIGVHARDKGEIDVTENGTVNFKDGVNQTGYYIFGAGSTIKNAASSVQDASTQNATLYRVDGGASFYGSADSSAQLNASGDGATIIRTTGAGSHFDSGKLALSVTGTGATGIRIEGGATGEITSDAVIVRVAGKDTTAGIVDGNYYNLDGSVNDAQKGDSVLTSYAVLETANTADGAFGYIARNGGRLIHEGSIDFTADNSTGILVDGGILENHSDVTVNGVAVNIQGANSEVTNSGVVTATDGQAAYLVGNNATLALNGNGETRAAGTAHGILLDTGAKGLTVDGATITMDSAGSGNAIENKAAISGIQLKNTTINVGNGVGVHTGASMAQTNSGTININGSGTGILFENVADGSDTDQTLDMSDSRDLVINVNGAQGNGIITRASTDLKTGASVNVLDSDGKSALVVQGTTKNVEQSGKLISVSDKAAVVDLNNGVLESFINKGDILALDASHTALEMNSGNGITFTNASGANIVGQVNLLNGDNTVILESGSTATDITSGSGKDNFILKNIRENESGSLFTSLNGGSGDDTLQLENSSYTLTRADAINGMEHIALANNSVFTLDNVALGLGDDELDGAGTGYTIDGSSQLSIKNTADVTFKSHLAGTGVVAVDTANNHFNFDANNAADGFAGTLALTNSRFELDGLNSQALSNATLQAGNGSITHVGSGEQNIGGLDFKGGTVQFDGVTPGNPTALGTIHAGAMDLSGRGTVQVDSGTVSNDRPQADTHRPILEQDDAQALIKLATSDTAVQGGAGNLVLKDKDGNVISDSITADIAQNGAVVAKGTYDYRLTGGDSDDGLYVSYGLTQVDLLGKDADALILDANGKSGNAADLSARVTGSGDLAFDSQKGQTVTLSNMDNDYSGVTDVRSGNLAMLNDNVLGNTRELKLAGDTGFDMRGHSQTIGKLTAESGSLTDLNGGHLTLTNGGEASGVLTGDGELTVAGGTLNVSGANTGLKATTTIAQGATAVLDNTLGLGTGDIVAAGLLNLSNATGVLYNSISDAGKVALDASDVVLAGNNSHFAGTFDIDNDSTLTASSAQQLGTSAIQNAGKFVLNTHESWSLENGVTGSGSVVKNGSGNVTLSDSAQWTGATDINAGGLTLGSADNAFTLASHQVNIGKDGRLSGFGGVAGNMANQGTLLIGDDVSAARRAASSPVSFTVGGNLTNSGDIWTGSKGKDAGNQLVVNGNYQGDGGHLHLNTALNDDNSVTDKLIVKGNTSGTTGVSVTNAGGSGAQTINGIEVIHVDGQSDGEFTQDGRIVAGAYDYSLARGQGDNNGNWYLTSHKTDPNPGPGPKPEPDIRPEPGSWTANLAAANTLFVTRLHDRLGETQYIDALTGEKKVTSMWMRQAGGHNAWRDSSGQLKTQSNRYVMQVGGDVARWSGDGLDRWHLGVMAGYGHNSSNTRSSSTGYRSDGSVNGYSAGVYATWYANDETHQGAYLDSWAQYSWFNNSVKGQDIQSESYKSKGITGSLELGYTHKLGEFAGSKGSKNEWFIQPQAQAIWMGVEADDHRESNGTRISGEGDGNVQTRLGVRTFLKGHSAIDEGKAREFQPFVEVNWLHNTRDFGTKMDGVSIRQEGARNLGEIKTGVEGQINQQLNVWGNVGVQLGDKGYNDTSAMIGIKYNFK

SEQ ID NO: 13160 - protein, 1306 aa, Escherichia coli O127:H6
MNKIYALKYCHATGGLIAVSELASRVMKKAARGSLLALFNLSLYGAFLSASQAAQLNIDNVWARDYLDLAQNKGVFKAGATNVSIQLKNGQTFNFPNVPIPDFSPASNKGATTSIGGAYSVTATHNGTTHHAISTQNWGQSSYKYIDRMTNGDFAVTRLDKFVVETTGVKNSVDFSLNSHDALERYGVEINGEKKIIGFRVGAGTTYTAQNGNTYSTGQVYNPLLLSASMFQLNWDNKRPYNNTTPFYNETTGGDSGSGFYLYDNVKKEWVMLGTLFGIASSGADVGSILNQYDENTVNGLKNKFTQKVQLNNNTMSLNSDSFTLAGNNTAVAKNNNNYKDLSFSGGGSINFDNDVNIGSGGLIFDAGHHYTVTGNNKTFKGAGLDIGDNTTVDWNVKGVVGDNLHKIGAGTLNVNVSQGNNLKTGDGLVVLNSANAFDNIYMASGHGVVKINHSAALNQNNDYRGIFFTENGGTLDLNGYDQSFNKIAATDIGALITNSAVQKAVLSVNNQSHYMYHGSVSGNTEINHQFDTQKNNSRLILDGNVDITNDINIKNSQLHHAGTCLHLMLFLERVGVTCMLPGVICEKDYVSGIQQQENSANKNNNTDYKTNNQVSSFEQPDWENRLFKFKTLNLINSDFIVGRNAIVVGDISANNSTLSLSGKDTKVHIDMYDGKNITGDGFGFRQDIKDGVSVSPESSSYFGNVTLNNHSLLDIGNKFTGGIEAYDSSVSVTSQNAVFDRVGSFVNSSLTLEKGAKLTAQGGIFSTGAVDVKENASLILTGTPSAQKQEYYSPVISTTEGINLGDKASLSVKNMGYLSSDIHAGTTAATINLGDGDAETDSPLFSSLIRGYNAVLSGNITGEQSTVNMNNALWYSDGNSTIGTLKSTGGRVELGGGKDFATLRVKELNANNATFLMHTNTSQADQLNVTNKLLGSNNTVLVDFLNKPASEMNVTLITAPKGSDEKTFTAGTQQIGFSNVTPVISTEKTDDATKWMLTGYQTVSDAGASKTATDFMASGYKSFLTEVNNLNKRMGDLRDTQGDAGVWARIMNGTGSADGGYSDNYTHVQIGADRKHELDGVDLFTGALLTYTDSNASSHAFSGKTKSVGGGLYASALFDSGAYFDLIGKYLHHDNQYTASFASLGTKDYSSHSWYAGAEVGYRYHLSEESWVEPQMELVYGSVSGKSFIWEDRGMALSMKDKDYNPLIGRTGVDVGRTFSGDDWKITARAGLGYQFDLLANGETVLRDASGEKRFEGEKDSRMLMNVGMNAEIKDNMRFGLELEKSAFGKYNVDNAINANFRYSF

SEQ ID NO: 13161 - protein, 1300 aa, Escherichia coli
MNKIYSLKYSHITGGLIAVSELSGRVSSRATGKKKHKRILALCFLGLLQSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKYSYNVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENRRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSVGRNANVIGDIQASKSNITIGDTTAYIDLHAGKNITGDGFGFRQNIVRGNSQGETLFTGGITAEDSTIVIKDKAKALFSNYVYLLNTKATIENGADVTTQSGMFSTSDISISGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKPTPEKQLNIELVSAPKDTNENVFKASKQTIGFSDVTPVITTRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEAGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSVGLNAEIRDNVRFGLEFEKSAFGKYNVDNAVNANFRYSF

SEQ ID NO: 13162 - protein, 646 aa, Pseudomonas aeruginosa
MIRMALKPLVAACLLASLSTAPQAAPSPYSTLVVFGDSLSDAGQFPDPAGPAGSTSRFTNRVGPTYQNGSGEIFGPTAPMLLGNQLGIAPGDLAASTSPVNAQQGIADGNNWAVGGYRTDQIYDSITAANGSLIERDNTLLRSRDGYLVDRARQGLGADPNALYYITGGGNDFLQGRILNDVQAQQAAGRLVDSVQALQQAGARYIVVWLLPDLGLTPATFGGPLQPFASQLSGTFNAELTAQLSQAGANVIPLNIPLLLKEGMANPASFGLAADQNLIGTCFSGNGCTMNPTYGINGSTPDPSKLLFNDSVHPTITGQRLIADYTYSLLSAPWELTLLPEMAHGTLRAYQDELRSQWQADWENWQNVGQWRGFVGGGGQRLDFDSQDSAASGDGNGYNLTLGGSYRIDEAWRAGVAAGFYRQKLEAGAKDSDYRMNSYMASAFVQYQENRWWADAALTGGYLDYDDLKRKFALGGGERSEKGDTNGHLWAFSARLGYDIAQQADSPWHLSPFVSADYARVEVDGYSEKGASASALDYDDQKRSSKRLGAGLQGKYAFGSDTQLFAEYAHEREYEDDTQDLTMSLNSLPGNRFTLEGYTPQDHLNRVSLGFSQKLAPELSLRGGYNWRKGEDDTQQSVSLALSLDF

SEQ ID NO: 13163 - protein, 435 aa, Escherichia coli O6
MSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGQIPSDTKIAHLNGNQWGFGWNAGILYELDKNNRYALTYRSEVKIDFKGNYSSDLPIAINRFNLPIPTATGGATRSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 13164 - protein, 446 aa, Escherichia coli
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTQQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVAPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 13165 - protein, 435 aa, Salmonella typhi
MSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPIAGQIPSDTKIAHLNGNQWGFGWNAGILYELDKNNRYALTYRSEVKIDFKGNYSSDLPIAINRFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 13166 - protein, 446 aa, Shigella flexneri
MSQKTLFTKSALAVAVALISTQAWSAGFQLNEFSSSGLGRAYSGEGAIADDAGNVSRNPALITMFDRPTFSAGAVYIDPDVNISGTSPSGRSLDADNIAPTAWVPNAHFVAPINDQFGWGASITSNYGLATEFNDTYAGGSVGGTTDLETINMNLSGAYRLNNAWSFGLGLNAVYARAKIERFAGDLGQLVAGQIMQSPAGATPQGQQLAGMANSIPSDEKIAHLNGNKWGFGWNAGILYELDKNNRYALTYRSEVKIDFKGNYSSDLPVAINNYNFGLPTATGGATQSGYLTLNLPEMWEVSGYNRVAPQWAIHYSLAYTSWSQFQQLKATSTGGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 13167 - protein, 726 aa, Vibrio anguillarum
MTHQVATCHKKQSFSGKPTLSRIALLVALQISASALPISITHAEEQADESITVYGQANEAYAAGKISKASSIGMLGDKDFLDTPFNAIGYTDKHIQDQHAQDISDVISASDPSVFTSGETGLNKESFKIRGFSSDIGDVMFNGLYGIAPYYRSSPEMYQRIDVLKGPASLLNGMPPNGSVGGSINLVTKRAQEAPITSFTGTYMSDSQFGGHIDIGRRFGENEQFGVRFNGVFRDGDASVDGQSRKAQLASLSLDWRNDIALIEADLYFSTERVDGPNRGLSIASGVDVPSPPSSDTLLSPSWAYNDSEDKGMMIRAELDLSNSVTAYGAVGASRTDFDSNVPQRVKIIDDSGTLEVSLGSVKLESKRTSGEVGIRSSFDTGPIEHYLVLNSTYFREDKNDSPKGNNNPGSWNPNIYNPVWGPEDSTYDNYYELPVDSTQISFGVADTLSLANGKYQVTLGLRHQSIDYESGVTWNGNAFPTTKLKESTYTPAIVALYKVSDSVSLYGNYTEGLTNGKTAGSGAANVGEAFEPQKTKQTEAGLKLDMNDFAHTFSLFEIKKPNGYQDPDTNIYSFGGEQRNRGIEWGFYGTVLEDYTLTGGIAYTDAEITKATDVTTEGKQATKLPDLQAKLALEWNLPVMRQLTLIGQANYMSEQYIDAQNTQSLSAQTIFDLGARYNSTIANQSVIWRLAVNNVTDEAYWTTTHYASLALGAPRTVMLSATADF

SEQ ID NO: 13168 - protein, 577 aa, Dickeya dadantii
MHSTEVQAKPLFSWKALGWALLYFWFFSTLLQAIIYISGYSGTNGIRDSLLFSSLWLIPVFLFPKRIKIIAAVIGVVLWAASLAALCYYVIYGQEFSQSVLFVMFETNTNEASEYLSQYFSLKIVLIALAYTAVAVLLWTRLRPVYIPKPWRYVVSFALLYGLILHPIAMNTFIKNKPFEKTLDNLASRMEPAAPWQFLTGYYQYRQQLNSLTKLLNENNALPPLANFKDESGNEPRTLVLVIGESTQRGRMSLYGYPRETTPELDALHKTDPNLTVFNNVVTSRPYTIEILQQALTFANEKNPDLYLTQPSLMNMMKQAGYKTFWITNQQTMTARNTMLTVFSRQTDKQYYMNQQRTQSAREYDTNVLKPFQEVLNDPAPKKLIIVHLLGTHIKYKYRYPENQGKFDGNTDHVPPGLNAEELESYNDYDNANLYNDHVVASLIKDFKAANPNGFLVYFSDHGEEVYDTPPHKTQGRNEDNPTRHMYTIPFLLWTSEKWQATHPRDFSQDVDRKYSLAELIHTWSDLAGLSYDGYDPTRSVVNPQFKETTRWIGNPYKKNALIDYDTLPYGDQVGNQ

SEQ ID NO: 13169 - protein, 1001 aa, Yersinia enterocolitica
MNQTHNLALKGAFSARKTLAAAAVGAALMLSAPAMAVDGSSIVKGQVVSAEGAGLGGATITLRHKTKGLVYTVSTNEKGEYLLRNVPVGEYDIDIHKDGYSDSKESGVRVEVGQALILDGQLYGAGETSMERLAVTGSMIRRVDMASSTSGVTFSQEDLNQMPVNSGFESIALLAPGTAAPGGSSFRGASSFGGASSAENGYYFNGMNVTSIRTGLGSINLPWEAISQTQVMTGGVSPEFGGAMGGIVNAVSKSGDNEFKFGTQIRWEPDSLRANHDSIFDSAGNISSNTMQDGYDFRELQLWASGAIIQDKLFYYGLFNPRRDDSDWAGQTTAGHREREEDRWFAKLDWYISEDHSIGLSAMSNERTWDTGTFAYDWETNEVGDQIGENAPGRDGGKVYSLNYNGYFTDSFSVSAVVGRTSENIDNVVASSNPSVYDYRTSTTLSQHTNSSVSEQEFIRDQARIDFNWDLDNHSLQFGVDYTRVLVDYTSAQNGIGDAQGWWGVKTAGNNSVSGAAAGEDYIERRVRTRYTDSEITSLAFYANDSWQVTDQLVLNLGLRYSGFENTVSDGRAYVSIDNQIAPRLQAIYDLHGDGSAKVYATYGRYFQPVSANMNITQGSSSIEWFEYFALDQVDGSGAPVLLPDGSPSRGDMLRDRYWRQRGITEPGLIASSSLKPMYSDEFTLGYQQELFDTMSGGVRFIYRDLGRSVEDTDVGPVLAKKLAELGIADNVGQGSYYVLNNPGEDITMSYDFDGDGQVDNVTLTQDELQLPEAKRKYLAVELTLDGRVNDDLTINSSYTWSHSYGNTEGLVKTDNDQADPGWTTSYDYADLMDHGYGDLPNDHRHAFKVSGAYNITDSLVLGLVARTTSGRPQSYFSQHPQGVDSCAAGSPWEDCISRYYDHVSHYDENGNPSPRGSAGNLPWVTNVDLSLTYSTELFGGDLMLKGTVYNLLNADSATSVWEERTRYADTASGLELNPDYGMVTGRQEARYMSLIARYEF

SEQ ID NO: 13170 - protein, 760 aa, Escherichia coli O6
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPVGVAKGSPVTTVDTARSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 13171 - protein, 388 aa, Escherichia coli
MENNQFSTTTKLRGEVIFSVADSFGGQALLRNTDGTVTRGTNQDQTQTVFNNRVRLNFETSFTGKDLLRTRLQAGNFNNTFNQSGPTRTNMTRLAYDNGRDNDVTIDDLFYRAPIDTPFGKITIWVGANELNLDDVFITTNPFLADSGTGALSRGQRYNNIVFRGPDGVGAAVRFNVGDVFQVTGTYLASGGTDGASNPNPGSGLFNGSYSAGAQVGFSFIKFADINFVYVRSYQTAASMSSGLFGNVSSPLTERPFGNVATVADRFGLQASAQVIPGVLNLGAWGGYANASATGVNDAIGDNNTGIWSWNLNLSVLDLFAEGAAFSLGGGQVPRSDKESSTAYMVEAQYKFPVTKNILITPGAYAVFNANNEGNSILVGVIRTTFRF

SEQ ID NO: 13172 - protein, 912 aa, Salmonella typhimurium
MPLDLEAMSLNMKARGVLAAASLLVSAPALAQVPPPQPEAQAAAPQLTKAPELVRSVQAQYPAEAAAQGLTADVRLIVTISEEGTVTEVKPAEPVGHGFDEAAVEAVRQFRFTPAEVDGVSAPVQVEYVYHFTLTEAPAPGAGQEGEDAPRETATLTGRLLSRGSRSRVAGATVRCGEDPEAPEATSDAEGRFTLRVVPGECEVRVIASNFQRYQTTETLKPHETAEVVFYLVPAGGAFETVVRSERPKKEVVRRTVTREEAQKTPGTFGDPVRVIQTLPGVARAPFIAGDLLVRGSNPGQSSTLMDGVNIPILFHLLGGPSVVNAEFLDTLDFYPGGYGSQYGRAVGGVVDVTTRKGASDTLHGSVKVDLLDAGFFLEAPVAKGVSVAASARRSYIDALLPLFLPEEEGETLSVVPRYWDYQLRVDFGARKKEGEGEEAPERRSTGYIMAFGSDDQLTLVSSGESQANDLSLSSHTLFHRLKGDWTYRVGKITSVFAPYAGIDKYDTEVGSSYTEKDTVYSLGARETLALELSSAITLRTGVDVMFEHGRFDVVADAPPGFEYVPFPGASPEAESLEEKLRITGFDGALFLESDYKLGAFTLTPGMRANLQIVGSQRNVALDPRLWARYTANEHTALKGSAGLYSQPPDTPRFAFLPYGNPRLGYQRAFQASLGVEQRVASRFQVDLTAFFNRRFKNVVSPGQVLTQPDGTIVQERFSNEGLGRAYGLELMVKKERASPTDKWFGWLSYTLSRAEDGREEPLPAIRDNVIDGGTGDTAYGLSPWDQTHILTLVGSYVLGNGWELGGRFRYTAGRPVTPLDHRHDVYGSDGNVYRPTYGPYFSARAAGFHQLDVRVDKSWQMESWTLTAYLDVQNLYNAKNAEFVFNDYRYRDEYEVPGIPLLPVVGVKGSF

SEQ ID NO: 13173 - protein, 710 aa, Yersinia enterocolitica
MFSAFIIKRSAILCSLAMFIPLASIADDTIEVTAKAGHEADLPTLGYTATTTKGATKTDQPLILTAQAVSVVTRQQMDDQNVATVNQALNYTPGVFTGFSGGATRYDTVALRGFHGGDVNNTFLDGLRLLSDGGSYNVLQVDPWFLERIDVIKGPSSALYGQSIPGGVVMMTSKRPQFTSEGHFRLTAGNNNTQVAAFDYTDAISEHWAFRLTGITRNSDTMYDHQREERYAIAPSLLWQPDENTSLLLRANLQKDPSGGYHSAVPADGSIYGQKLSRGFFDGESNHNVFKRWQQIYSYEFSHKFDDVWSFRQNASYTHSNTQLEQVYQGGWNSDRTLMNRYYSGEDSSLNAFAVDNQLEADFATAAVKHKVLLGVDFQKFRNNLRSDSAYATPLNPYTGVSGGSTLYSDYLLTTPGINTSYLSRRYEQSGVYLQDEMTLDNWHLNLSGRYDRMKTENINNTANSTDERTDNHASGRASLLYSFDSGISPYVSYSQAITPSLFPDAQQKLLKPMTSEQYEVGIKYQPPGSTSLYSAALYDLTQNDVANRAVPATYYVPAGKVNSQGLELEARSQISDRLSVIAGYTYNRVKFKDAIDGNDGNTPVLAPSNMASLWAQYEAGYGINVGAGIRYIGKQWADDANTLRVPSYTLGDASVRADLGTWAASLKGAFVQLNVNNIADKKYVAACYSTSYCYWGAERSVQATVGYDF

SEQ ID NO: 13174 - protein, 726 aa, Pseudomonas aeruginosa
  misc_feature (121)..(164): Xaa can be any naturally occurring amino acid
MKTETKVIKGRQGIARNRHTPLCLGLLLALSPLAAAVADARKDGETELPDMVISGESTSATQPPGVTTLGKVPLKPRELPQSASVIDHERLEQQNLFSLDEAMQQATGVTVQPFQLLTTAXXXXXXXXXXXXXXXXXXXXXXXXXXXXXXXXXXXXXXXXXXXXPSRLHGLLHGTGNPAATVNLVRKRPQREFAASTTLSAGRWDRYRAEVDVGGPLSASGNVRGRAVAAYEDRDYFYDVADQGTRLLYGVTEFDLSPDTLLTVGAQYQHIDSITNMAGVPMAKDGSNLGLSRDTYLDVDWDRFKWDTYRAFGSLEQQLGGGWKGKVSAEYQEADSRLRYAGSFGAIDPQTGDGGQLTGAAYKFKSIQRSLDANLNGPVRLFGLTHELLGGVTYAQGETRQDTARFLNLPNTPVNVYRWDPHGVPRPQIGQYTSPGTTTTTQKGLYALGRIKLAEPLTLVVGGRESWWDQDTPATRFKPGRQFTPYGGLIWDFARDWSWYVSYAEVYQPQADRQTWNSEPLSPVEGKTYETGIKGELADGRLNLSLAAFRIDLENNPQEDPDHPGPPNNPFYISGGKVRSQGFELEGTGYLTPYWSLSAGYTYTSTEYLKDSQNDSGTRYSTFTPRHLLRLWSNYDLPWQDRRWSVGGGLQAQSDYSVDYRGVSMRQGGYALVNMRLGYKIDEHWTAAVNVNNLFDRTYYQSLSNPNWNNRYGEPRSFNVSLRGAF

SEQ ID NO: 13175 - protein, 815 aa, Yersinia enterocolitica serotype O:8 / biotype 1B
MKMTPIACAVSILFATPLMAQEANTETPDNDEYENIIVTGSSVARTEADTPAKTTLIGKDQIANTGFSSQADILMSVPGIKVEGGGGEVATNAFVRGLPSGGQFQFTPLNYDGMPAFQSGMTSSAQDVYYRPDIGIERVEYVGGGVSNLFGPGSVAGIINYISRTGSDDPETTVQVEIAEEGRVRTDFYNSGALSSDENLYYAISGFYRYDEGPLETGLETKGYQLRGNIRKEFDDGHITFHGQMIDDQVQFFLPLPLEGDSRERLTGNDGETVYVAQTVAAADLRYDTADGTYESPIRNGVLTEGGSFGVDFEKELTDNWRLAGKAKVASYDHQFNLFLDGDGIANTPETQEGYANNLGRTANGDVLSSLGSANYTWSETGNALPEDYLLFGNRLLDRQRDGDFFSTEFNLTGDIEAGGFDHTVNIGTFFINSSQMDYNIISSYLADFSNGDSARLVDLSFTNEAGDTVQYSKNGIVGPGTSYTNKDLTSKRMAFYVTDQMENDQWALDVGMRVERAEGTTKSEGSEVVVVNDDPSLAPNLQVNTTGNGRFTYGEVATTEAAFSAAVLYKMDDQDLNLYANASTGYFFPQIRSITFNENGEPQSYEGEDITLGAIGFKYFPEDLYIDASLFIANLDNRRSVDFENDGSGGLLEVVKQQSTETTGAEVITRWNMTDEVILEGNVTYQDAEFSEGGNVGKQPRRQPEFSGNLAVSYNNGFVDARLGLSYFGDAYANDDNSVELDSHTIATLSAGYSWELNNDQQIRVGVSVWNLFDTDGITEGSPRQGNSQVSGGEFFVGRPVLPRRVSLTARYDF

SEQ ID NO: 13176 - protein, 673 aa, Yersinia enterocolitica
MKMTRLYPLALGGLLLPAIANAQTSQQDESTLEVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSLSDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRIAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERINISVHVDNLFDRRYRTYGYMNGSSAVAQVNMGRTVGINTRIDFF

SEQ ID NO: 13177 - protein, 1394 aa, Haemophilus influenzae
MKKTVFRLNFLTACISLGIVSQAWAGHTYFGIDYQYYRDFAENKGKFTVGAQNIKVYNKQGQLVGTSMTKAPMIDFSVVSRNGVAALVENQYIVSVAHNVGYTDVDFGAEGNNPDQHRFTYKIVKRNNYKKDNLHPYEDDYHNPRLHKFVTEAAPIDMTSNMNGSTYSDRTKYPERVRIGSGRQFWRNDQDKGDQVAGAYHYLTAGNTHNQRGAGNGYSYLGGDVRKAGEYGPLPIAGSKGDSGSPMFIYDAEKQKWLINGILREGNPFEGKENGFQLVRKSYFDEIFERDLHTSLYTRAGNGVYTISGNDNGQGSITQKSGIPSEIKITLANMSLPLKEKDKVHNPRYDGPNIYSPRLNNGETLYFMDQKQGSLIFASDINQGAGGLYFEGNFTVSPNSNQTWQGAGIHVSENSTVTWKVNGVEHDRLSKIGKGTLHVQAKGENKGSISVGDGKVILEQQADDQGNKQAFSEIGLVSGRGTVQLNDDKQFDTDKFYFGFRGGRLDLNGHSLTFKRIQNTDEGAMIVNHNTTQAANVTITGNESIVLPNGNNINKLDYRKEIAYNGWFGETDKNKHNGRLNLIYKPTTEDRTLLLSGGTNLKGDITQTKGKLFFSGRPTPHAYNHLNKRWSEMEGIPQGEIVWDHDWINRTFKAENFQIKGGSAVVSRNVSSIEGNWTVSNNANATFGVVPNQQNTICTRSDWTGLTTCQKVDLTDTKVINSIPKTQINGSINLTDNATANVKGLAKLNGNVTLTNHSQFTLSNNATQIGNIRLSDNSTATVDNANLNGNVHLTDSAQFSLKNSHFSHQIQGDKGTTVTLENATWTMPSDTTLQNLTLNNSTITLNSAYSASSNNTPRRRSLETETTPTSAEHRFNTLTVNGKLSGQGTFQFTSSLFGYKSDKLKLSNDAEGDYILSVRNTGKEPETLEQLTLVESKDNQPLSDKLKFTLENDHVDAGALRYKLVKNDGEFRLHNPIKEQELHNDLVRAEQAERTLEAKQVEPTAKTQTGEPKVRSRRAARAAFPDTLPDQSLLNALEAKQAELTAETQKSKAKTKKVRSKRAVFSDPLLDQSLFALEAALEVIDAPQQSEKDRLAQEEAEKQRKQKDLISRYSNSALSELSATVNSMLSVQDELDRLFVDQAQSAVWTNIAQDKRRYDSDAFRAYQQQKTNLRQIGVQKALANGRIGAVFSHSRSDNTFDEQVKNHATLTMMSGFAQYQWGDLQFGVNVGTGISASKMAEEQSRKIHRKAINYGVNASYQFRLGQLGIQPYFGVNRYFIERENYQSEEVRVKTPSLAFNRYNAGIRVDYTFTPTDNISVKPYFFVNYVDVSNANVQTTVNLTVLQQPFGRYWQKEVGLKAEILHFQISAFISKSQGSQLGKQQNVGVKLGYRW

SEQ ID NO: 13178 - protein, 1391 aa, Haemophilus influenzae
MKKTVFRLNFLTACISLGIVSQAWAGHTYFGIDYQYYRDFAENKGKFTVGAQDIDIYNKKGEMIGTMMKGVPMPDLSSMVRGGYSTLISEQHLISVAHNVGYDVVDFGMEGENPDQHRFKYKVVKRYNYKSGDRQYNDYQHPRLEKFVTETAPIEMVSYMDGNHYKNFNQYPLRVRVGSGHQWWKDDNNKTIGDLAYGGSWLIGGNTFEDGPAGNGTLELNGRVQNPNKYGPLPTAGSFGDSGSPMFIYDKEVKKWLLNGVLREGNPYAAVGNSYQITRKDYFQGILNQDITANFWDTNAEYRFNIGSDHNGRVATIKSTLPKKAIQPERIVGLYDNSQLHDARDKNGDESPSYKGPNPWSPALHHGKSIYFGDQGTGTLTIENNINQGAGGLYFEGNFVVKGNQNNITWQGAGVSVGEESTVEWQVHNPEGDRLSKIGLGTLLVNGKGKNLGSLSVGNGLVVLDQQADESGQKQAFKEVGIVSGRATVQLNSADQVDPNNIYFGFRGGRLDLNGHSLTFERIQNTDEGAMIVNHNASQTANITITGNATINSDSKQLTNKKDIAFNGWFGEQDKAKTNGRLNVNYQPVNAENHLLLSGGTNLNGNITQNGGTLVFSGRPTPHAYNHLRRDLSNMEGIPQGEIVWDHDWINRTFKAENFQIKGGSAVVSRNVSSIEGNWTVSNNANATFGVVPNQQNTICTRSDWTGLTTCKTVDLTDKKVINSIPTTQINGSINLTDNATVNIHGLAKLNGNVTLIDHSQFTLSNNATQTGNIKLSNHANATVDNANLNGNVNLMDSAQFSLKNSHFSHQIQGGEDTTVMLENATWTMPSDTTLQNLTLNNSTVTLNSAYSAISNNAPRRRRRSLETETTPTSAEHRFNTLTVNGKLSGQGTFQFTSSLFGYKSDKLKLSNDAEGDYTLSVRNTGKEPVTFGQLTLVESKDNKPLSDKLTFTLENDHVDAGALRYKLVKNDGEFRLHNPIKEQELRSDLVRAEQAERTLEAKQVEQTAKTQTSKARVRSRRAVFSDPLPAQSLLKALEAKQALTTETQTSKAKKVRSKRAAREFSDTLPDQILQAALEVIDAQQQVKKEPQTQEEEEKRQRKQKELISRYSNSALSELSATVNSMLSVQDELDRLFVDQAQSAVWTNIAQDKRRYDSDAFRAYQQKTNLRQIGVQKALDNGRIGAVFSHSRSDNTFDEQVKNHATLAMMSGFAQYQWGDLQFGVNVGAGISASKMAEEQSRKIHRKAINYGVNASYQFRLGQLGIQPYLGVNRYFIERENYQSEEVKVQTPSLVFNRYNAGIRVDYTFTPTDNISIKPYFFVNYVDVSNANVQTTVNRTMLQQSFGRYWQKEVGLKAEILHFQLSAFISKSQGSQLGKQQNVGVKLGYRW

SEQ ID NO: 13179 - protein, 1335 aa, Escherichia coli
MNRIYSLRMNDRKELVAVAETAGGRKKSSGIPGAGMLSRLLLASGAVAGVLFSYPSLASVVGNTLPWQTYRDFAENKGAFHAGATNIPLYGRNGAVGGRLDKAPMMDFSVVDQILGVATLISPQYVAGVKHNGSYNTVRFGYADDTTYRLVDRNEHWRDFHTPRLNKLVTEVAPVSVTDAGTGKGVYQNRSRYPVFYRMGSGTQYTGAASGALTRIAGAYAWKTGGTVGSPLISDWSLVSNPGYLYQSVNGPLASYGTPGDSGSPLFAWDAVKKQWVLVAVLNGYAGEKGKTNWFTVIPAGDVNNTIKQDSSGTVVPAVAGGDIVWNYSKGSGEGTLSQDGKVWKMNGFRGGSLNDGKDITFGGKGTVVLKDDVVQGAGSLTFNGDYTVRPEGNQTWVGGGIIVNDGHRVDWMVNGLAGDALHKTGKGTLVVAGSGENPGTLNTGDGTVILAQKADAAGRVRAFSEVRIVSGRPVVVLQDSHQIEGDRIRWGYRGGTLDINGNDMTFHRLAAADEGAVLTSRAGSATVRLDFSPSGQKAVMWHGHFTGNLSVLNNTSSAVDFIMDGGADMSGSFTQQGGGLYIQGHPVVHAVSSEAVAAALRKQGDNSVLTRPVSFTQKDWESRTFSIGQLKLKEASFSLSRNATLTGDIDADNATMVLGSDSLYLDMKDGTGSSSTPVKGTSAAGGASGTSTFRGNVNMRHSSLTVRDHFTGSITASDSRIAVSSENVRLEGDSRLTSSALTVSDGGRLHVKGGLETDGGVTLDGGTLLVDGGSVRNDVYERLLAWSEVRGGLNGSGEYDFMTGAAGLLRGYVRGSAGNVNLQNAAWMMTGNSSVKHLESSGSALYFSRPGGEFHTLTAGSMDISDSVLVMRTDLHHSDQLRVTESLRGKNNLLLVDFTERSDGQKALNIPLVTAPAGTGADVFSVKTRDTGFSHITPVVRAEQGTGGTAWQLNVVQPETVAEPVVDEVSRPSLPVVMRQDAKTPNPVEAVSPVPSPAPAASVTDVPTGENTGESGEYRDETRWLLTGYRSTVNVSAVRDAGMLMSMGHRNFINEVNNLNKRMGDLRDINGEAGAWARIMSGTGSAGGGFSDNYTHVQVGADKKHELDGLDLFTGVTMTYTDSNAGSDTFSGKTKSVGAGLYASALFDSGAYIDLIGKYVHHDNEYTATFAGLGTKDYGSHSWYAGAEVGYRYHVTEDAWIEPQAELVYGAVSGKQFSWKDQGMNLTMKDKDFNPLIGRTGVDVGKSFSGKDWKVTARAGLGYQFDLLANGETVLRDASGEKRIKGEKDGRMLMSVGLNAEVRDNIRFGLEFEKSAFGKYNVDNAVNAGFRYSF

SEQ ID NO: 13180 - protein, 687 aa, Yersinia enterocolitica
MPRSTSDRFRWSPLSLAIACTLPLAVQAADTSSTQTNSKKRTADTMVVTATGNERSSFEAPMMVTVVEADTPTSETATSATDMLRNIPGLTVTGSGRVNGQDVTLRGYGKQGVLTLVDGIRQGTDTGHLNSTFLDPALVKRVEIVRGPSALLYGSGALGGVISYETVDAADLLLPGQNSGYRVYSAAATGDHSFGLGASAFGRTDDVDGILSFGTRDIGNIRQSDGFNAPNDETISNVLAKGTWRIDQIQSLSANLRYYNNSALEPKNPQTSAASSTNLMTDRSTIQRDAQLKYNIKPLDQEWLNATAQVYYSEVEINARPQGTPEEGRKQTTKGGKLENRTRLFTDSFASHLLTYGTEAYKQEQTPSGATESFPQADIRFGSGWLQDEITLRDLPVSILAGTRYDNYRGSSEGYADVDADKWSSRGAVSVTPTDWLMLFGSYAQAFRAPTMGEMYNDSKHFSMNIMGNTLTNYWVPNPNLKPETNETQEYGFGLRFNDLMMAEDDLQFKASYFDTNAKDYISTGVTMDFGFGPGGLYCKNCSTYSTNIDRAKIWGWDATMTYQTQWFNLGLAYNRTRGKNQNTNEWLDTINPDTVTSTLDVPVANSGFAVGWIGTFADRSSRVSSSGTPQAGYGVNDFYVSYKGQEQFKGMTTTVVLGNAFDKEYYAPQGVPQDGRNAKFFVSYQW

SEQ ID NO: 13181 - protein, 756 aa, Haemophilus ducreyi
MKAMKQSTLAVLINAALFSAVGLSANAIAAEQADENKAKNSQLEVIQITARKRVENAQEVPVSVSALQGDNLDAYSSAGMDIRFMNAKIPSLTVESSFGRTFPRFYVRGLGNTDFDLNASQPVSLVVDDVVQENPILKGFPVFDIERIEVLRGPQGTLFGRNTPAGLVKFDSVKPSQDFDGYGAVSYGSRGAVDFEGAVGGGLSDNVSARFSALVQNKGDFIDNRAPGFEEKDVLGGYTEKAARLQFLYKKDDLSALLNYHVRDLDGKPIVFNANLMDKGTNNIRKDFKNDVVFHDAAKDATQQVESQGVSLKVEYDFDTHTLTSISAWDSVEIFSRGDVDGGFGAPWAPAMGPGVIGFAAESADAIPDHDQITQELRLSSNFNGDFNYQVGAFYFDEDLTIESFSYDTLAGGVQNGYAKQNQQTTAWAVFGSADFTVSDELKITAGLRYSDDDKDFVAERFSNPTPWNGSPDYLMRTANPSDSHVSWDLSAAYKYSRDVNFFARIANGFRAPSIQGRILFGDEVTIAKSETINSIEAGVKSDVLDGRGRVNATVFYYQMDDQQLTAVGGDANFNRLINADKTNGYGFELDTEWVLTDELLATFNVSYNHTELDSAGLAVAACAQCTVTSPRNADGLAIIDGTSLPHAPEWIANFTLRYTKELENGEFFAYTDWSYRSEIDFFLYRAKEFTGEALFEGGVRAGYAWTQDDNEYEVSAFVRNLTDEQVIIGGVDFNNNTGMVNEERFIGAEFKIKFF

SEQ ID NO: 13182 - protein, 1067 aa, Haemophilus influenzae
MTNFKFSLLACSIAFALNASTAYAAQPTNQPTNQPTNQPTNQPTNQPTNQNSNVSEQLEQINVSGSSENINIKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILVVDTKRDGHEIENYDYKIYPNKQADLRAVGPTREKADPYQITRQSTLIKLGFQPNENHRLSVALDDSTLETKGIDLSYALRPYSTAGNEKYGERIINDQSKRKNIQFSYENFSQTPFWDHIKLSYSSQKITNKARSDEYCHQSTCPGVRNPQGLHLVEKDGTYRIVDKDNNDFHYKKDDSDLWAWGKELHNSKGKKISDDVDTKGGSLDSVLINCEKLDCSKRFRIYQEYDENSSEKYTYDDREIKVETLPNGKKYGKIPLKKGEKLFSQEEARFLFPKSHGYSTDFVNDRDLNTHTQQIKLDLDKEFHLWHTQHQLKYGGLYEKTLKSMVNHQYNTAANVQWWADYFFCARQEGGNLGGEKKPRPDISVAGCANGTLLHSDIGKDTYLIPVTTKNNVLYFGDNVQLTSWLGLDLNYRYDHVKYLPSYDKNIPVPKGLITGLFKKFKSTDYVYGKKYSKPDGYTDCTYDTPCYKQNFKDNLALLLRKTDYKHHSYNLGLNLDPTDWLRVQLKYANGFRAPTSDEIYMTFKHPQFSIQPNTDLKAETSKTKEVAFTFYKNSSYITLNAFQNDYRNFIDLVEVGERPIEEDSVVRYPFHQNQNRDRARVRGIEIASRLEIGDLFEKLQGFHLGYKFTYQKGRIKDNGLHPKYKEFLKLNKDQHPEYEAIARKPQPMNALQPTTSVYNIGYDAPSQKWGVDMYITNVAAKKAKDSFNSQWTSMVERKEKQYTDITDIKASKANGKEVKDSRGLWRNNRYTVIDTIAYWKPIKNLTFTAGVYNLTNKKYLTWDSARSIRHIGTINRVKTETGKGLNRFYAPGRNYRMSVQFEF

SEQ ID NO: 13183 - protein, 1064 aa, Haemophilus influenzae
MTNFKFSLLACSIAFALNASTAYAAQPTNQPTNQPTNQPTNQPTNQNSNVSEQLEQINVSGSTETINVKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILVVDTKRDGHEIENYDYKIYPNKQTDFSAVGPTREKADPYQITRQSTLIKLGFQPNENHRLSVALDDSTLETKGMDLSYIFNQCRNSTCAETYGERVINDQSKRKNIQFSYENFTQTPFWDHIKLSYSSQKITNKARSDEYCHQPTCNGVSNPQGLHLVEEEGIYKIVDKDNNDFNYQEDQSNPWSYEKELYNSKNEKISNDVDTEAGNLDSVLINCEKLNCENKKFRIYQTKDENWNDSYKYDDREITIKKLPNGKKYGEISLKEGTEYFIDELKKETARFLFPKSSGYSEDSVNDRDLNTNTQQIKLDLDKEFSLWHTQHQLKYGGLYEKTLKSMVNHQYNTVANVQWWADYFFCNKLANGKHTPAPDYSAHRCSLMNTDKGKDSYLIPVTTKNNVLYFGDNIQLTSWLGLDLNYRYDHVKYLPSYDENIPVPNGLITGLFKKFGLKDYVYGSKNSIPQGQGYIDCTYDTPCYKQNFKDNLALLLRKTDYKHHSYNLGLNLDPTNWLRVQLKYANGFRAPTSDEIYMTFKHPQFSIQPNTDLKAETSKTKEVAFTFYKNSSYITLNAFQNDYRNFIDLVEVGERPIEEGSVIRYPFHQNQNRDRARVRGIEIASRLEMGDLFEKLQGFHLGYKFTYQKGRIKDNGLHPKYKEFLELNKAEHPEYEAIARKPQPMNALQPTTSVYNIGYDAPSQKWGVDVYITNVAAKKAKDSFNSQWTSMVARKEKQYTSIENKEASKANGKDVKDSRGLWRNNRYTVIDTIAYWKPIKNLTFTAGVYNLTNKKYLTWDSARSIRHLGTINRVETATGKGLNRFYAPSRNYRMSVQFEF

SEQ ID NO: 13184 - protein, 329 aa, Haemophilus influenzae
MANFASEGVRGNFGVRYAGTEATSTYYVDGKKTDSSANYGEWLPSLNVAFDLAPDLILRASAARVMARPQYDDMYVNPNVLGANDDVPNNQKWVVGNIGLKPFIANQIDLGIEWYFNEESLLSAALFMKDVKNFVTFSEYHADSADIPFTGTLKPDEVAGGWTVQEKANGESATIQGLELQYQQDFGNGFGSIVNYTYTDSETSPNTYTDRNPFLSDSSKHSYNLTGYFENDLFQVRLAYNWRSEYMIRETGSYGNRLHDAFGSLDLSAIWHVTDYMDIKLDGNNLLEEGSRQFGNNQFQSNLSGFTDGFPVFEYNMARRITLGASVRF

SEQ ID NO: 13185 - protein, 777 aa, Haemophilus influenzae
MTNFHKAALAVCIQGALFSHTLHAQEVPAAKDKGLEKITVTAQKRTQSIQEVPISIATLNGERFESIFSGGDDIIALAVRVPGLYAESSNGRVAPRFYIRGLGNTDFDLAASQPVSIVMDDVVKENVILKSFPLFDVEQVEVIRGPQGTLFGRNTTAGIVKFDSVKPTEDFDAYAKLGVGNLGTVNFEAAVGGGLAEDLSGRFSVLSQDRDDWIDNGFTGEKDAIGGFDEKAWRGQLLFTPSEDFSALLNVHGRELDGTASVFRANVFTKGSNDLNQNFDRDTVYYDGDIDGNGTDNNPQEYENYGASLKLEFGLDEMSFTSITAYEEAEGSSLGDIDGGVYTNDLSTPVPDGLTSANFNSGFEDVLTFPGAIGFSAVTQDNLDDLEQFTQEIRLASETDDALSWQTGAFYYDSSFNVTSIDGYFGATTVFHENTTWAVFGQTTYELNERLNVTGGVRYTHDKKSLRVGEQNVDGFALITGDASVQDYDDIDVDDGQISWELSANYKVSDDTSVFARFANGFRAQSIQGRDVAFEGAPSVADAETINSIEFGFKSDLLENTLRLNAATFYYQIDDMQFSAIGGGANNVALVNADKGVGYGFEIDAQYVANDYLTLTAGYSYNKTEIKDDSLTLLPCGTNEAFGSTGNCTVLDPRPNGFNAVIDGNPFPQAPETIFTFTARYAVPLGNDGEFFAFTDWAYQGDTNLFLYESVEFQTDGNVEGGLRIGYENFEHNYTVALFGRNITDEENVKGAVDFNNLTGIVNQPRIFGIEAKVSFY

SEQ ID NO: 13186 - protein, 1046 aa, Haemophilus influenzae
MTNFRLNLLAYSVMLGLTAGVAYAAQPTNQPTNQPTNQPTNQDGNVSEQLEQINVLGSDNHNDNTPPKIAETIKTAKKPEKEQAQDVKDLVRYETGITVVEAGRFGNSGFAVRGVDENRVAVQIDGLHQAETISSQGFKELFEGYGNFNNTRNTAEIETLKQVTIRKGADSLKSGSGALGGSVSFDTKDARDYLLNKNYYASYKRGYNTADNQNLQTLTLAGRYKYFDAIAVITSRKGHELENYGYKNYNDRIQGREREKADPYRRTQESKLLKFAFQPTENHRLSVVVDLYKQTSKGHDFSYTLKQNTEHMTYDEVELRHTNDKVDRKNLAFTYENFTETPFWDTLKISYSHQKITTTARTDDYCDGNDKCALAGNPLGMKYNQDNQLVGEDGNLAKYKDINTKQTIHEKLPFTKPNEKWRYNRVDWDALKKKYPGVPIYASCIEENNDPSKYCSYDVEIPKKENTFEINGKQYDLLSEADKNVISDEQRLPTNSSYLFSCDGLNCDKDTIQGFEKKGTTVNIPFVVIEKNGKKYAKTEAVANNQLSGPYIFMPSKTGYQTNLWTQRDLTSETKQINLDLTKHLELGKTQHDLSYGGLWSEMEKSMTNISGDSPMNVKWWAQYPHSCDIFLPSSTPNGAPTLNPERTNTLCNNSNVYSFLIPVKTKTGALYFINDFRVNSHIAFNFGYRYDRVKYDPEYIPGKTPKIPDDMVVNLYVKQPTFDDTKVNLPPEELRKKEANAAANIKAIVQPKKFSASSYSVGTTLDPLNWLRLQAKYGKAFRAPTSDEIYFTFLHPDFSIRPNRDLQAETAKTKELALTLHNEIGYVTTSVFDTRYRNFIDLAYKGLYNVQRHSKLTPYHTYQNVNRPNAKVTGWEIAAQISLGKITQFLNGLNLSYKYTYQKGRIDGNIPMNAIQPKTSVYGVSYAHPADKFGLDLYFTHVSAKNAEDTYNMFYKEEGKKDSTIKWRSKSYTTIDLLGYIKPIKNLTLRAGVYNLTNRKYITWDSARSIRPFGTSNMINQKTGEGINRFYAPGRNYRMSVQFEF

SEQ ID NO: 13187 - protein, 1013 aa, Haemophilus influenzae
MTNFKFSLLACSIAFALNASTAYAAQPTNQPTNQPTNQPTNQPTNQPTNQPTNQPTNQDSNLSEQLEQINVSGSTENSDSKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDVLVVTTSRNGHELENYGYKNYNDKIQGKRREKADPYKIEQDSTLLKLSFNPTENHRFTLAADLYEHRSRGQDLSYTLKYLKTLPDLPEVDSRHTNDKTKRHNISFSYENFSQTPFWDTLKITFSKQKIKTRARTDEYCDAGVRYCEGTANPAGLKLKNGEITRRDGTPLQFKEINNTTTPNSNSNKDKTYDFSKLIDTNGKEIESGITRSNDTFWYDCSIFDCENPGKMKVAEGKTYYRYDGTWKNNVQLEKKVLNGKEFARINNGTRGKTFPILPSSLGYLERLWQERDLDTNTQQLNLDLTKDFKTWRVEHNLQYGSSYNTTMKRMVNRAGYDATDVQWWAKRTLGTRFDFLKNEEIVETCATTFGWNAFLCPRVDPEFSYLLPIKTKEKSVYLFDNVVITDYLSFDLGYRYDNIHYQPKYKHGVTPKLPDDIVKELFIPLKSGQNNNDAEVKKNVQENIDYIAKQNKKYKAHSYSFVSTIDPTSFLRLQLKYSKGFRAPTSDEMYFTFKHPDFTILPNTHLKPEIAKTKEIAFTLHHDDWGFISTSLFKTNYRDFIDLVYKGEREFEVGNPNNRGKISFDTFQNINRDSAVVKGIEINSKVFLGKMAKFMDGFNLSYKYTYQKGRMDGNIPMNAIQPKTMVYGLGYDHPSQKFGFNFYTTHVASKNPEDTYDIYAKDKNQTNTSIKWRSKSYTILDLIGYVQPIKNLTIRAGVYNLTNRKYITWDSARSIRSFGTSNVIDQKTGQGINRFYAPGRNYKMSVQFEF

SEQ ID NO: 13188 - protein, 999 aa, Haemophilus influenzae
MTNFRLNVLAYSVMLGLTAGVAYAAQPTNQPTNQPTNQPTNQPTNQPTNQPTNQNSNVSEQLEQINVSGSTENSDTKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGADSIKNGSGSLGGSVIYKTKDARDYLINKDYYVSYKKGYATENNQSFDTLTLAGRYKKFDVLVVTTSRNGHELENYGYKNYNDKIQGKKREKADPYKIEQDSTLLKLSFNPTENHRFTFAADLYEHRSRGQDLSYTLKYQRSGNETPEVDSRHTNDKTKRRNISFSYENFSQTPFWDTLKLTYSDQRIKTRARTDEYCDAGVRHCEGTDNPTGLKVTNGKITRRDGSDLQFEEKNNTAKSSDKTYDFKKFIDTDKRVIDDKLVLNNPSDTWYDCSIFNCENNAKIKVFKGNNYYGYDGKWKEVDLEIKELNGKKFAKIKDNDRKIKSILPSSPGYLERLWQERDLDTNTQQLNLDLTKDFKIWHIEHNLQYGGSYNTAMKRMVNRAGNDASDVQWWATPTLGEDSWTGKPHTCATTYEWNANLCPRVDPEFSYLLPIKTTGKSVYLFDNFVITDYLSFDLGYRYDNIHYQPKYKHGITPKLPDDIVKGLFIPLPNNSNSDPNKVKENVQQNIDYIAKQNKKYKAHSYSFVSTIDPTSFLRLQLKYSKGFRTPTSDEMYFTFKHPDFTILPNTDLKPEIAKTKEIAFTLHNDDWGFISTSLFKTNYKNFIDLIFKKQETFKVGGSGRGETLPFSLYQNINRDNASLKGIEINSKVFLGKMAKFMDGFNLSYKYTYQKGRMNGNIPMNAIQPRTMVYGLGYDHPNHKFGFDFYTTHVASKNPEDTYNMFYKEENKKDSTIKWRSKSYTILDLIGYVQPIKNLTIRAGVYNLTNRKYITWDSARSIRSFGTSNVIDQSTGLGINRFYAPGRNYKMSVQFEF

SEQ ID NO: 13189 - protein, 1015 aa, Haemophilus influenzae
MTNFRLNVLAYSVMLGLTASVAYAEPTNQPTNQPTNQPTNQPTNQPTNQPTNQPTNQPTNQPTNQDSNVSEQLEQINVSGSTENSATKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTSRNGHELENYDYKNADSLTQGKKREKADPYKIEQDSTLLKLSFNPTENHRFTLAADLYEHRSRGQDLSYTLKYQRSGHETPEVESRHTNDKTKRRNISFSYENFSQTPFWDTLKITFSKQKIKTRARTDEYCDAGVRYCEGTANPAGLKLKNGEITRRDGSELQFKEKEKNNSTPSNNDKIYDFKKFIDTDDQVIEDKLALRRASETWYDCLIFNCEKDTKIKVFEGEKHYGHDGKWKEFDLEIEELNGKKFAKIKNAGYKTRSIIPSSPGFLENLWQERDLDTNTQQLNLDLTKDFKTWHIEHNLQYGGSYNTAMKRMVNRAGYNASDVQWWATPTLGKDSWTGKPHTCATSSDAYNANLCPHVDPEFSYLLPIKTTGKSVYLFDNFVITDYLSFDLGYRYDNIHYQPKYKHGITPKLPDDIVKGLFIPLDNSQSNNSAKVKENVQQNIDYIAKQNKKYKAHSYSFVSTIDPTSFLRLQLKYSKGFRTPTSDEMYFTFKHPDFTILPNTDLKPEIAKTKEIAFTLHNDDWGFISTSLFKTNYKNFIDLIFKEKRSFKVGKPGSQGETLPFSLYQNINRDNASLKGIEINSKVFLGKMAKFMDGFNLSYKYTYQKGRMNGNIPMNAIQPRTMVYGLGYDHPNHKFGFDFYTTHVASKNPEDTYNMFYKEEKKTDSTIKWRSKSYTILDLIGYVQPIKNLTIRAGVYNLTNRKYITWDSARSIRSFGTSNVIEQTTGLGINRFYAPGRNYKMSVQFEF

SEQ ID NO: 13190 - protein, 999 aa, Haemophilus influenzae
MTNFRLNVLAYSVMLGLTASVAYAEPTNQPTNQPTNQPTNQPTNQPTNQNSNASEQLEQINVLGSDNNNDNTPPKIAETVKTASQLKRQQVQDSRDLVRYETGVTVVEAGRFGSSGYAIRGVDENRVAITVDGLHQAETLSSQGFKELFEGYGNFNNTRNSVEIETLKVAKIAKGADSVKVGSGSLGGAVLFETKDARDFLTEKDWHIGYKAGYSTADNQGLNAVTLAGRYQMFDALIMHSKRHGHELENYDYKNGRDIQGKEREKADPYTITKESTLVKFSFSPTENHRFTVASDTYLQHSRGHDFSYNLVKTTYINKDEEELRHTNDLTKRKNVSFTYENYTVTPFWDTLKLSYSQQRITTRARTEDYCDGNEKCDSYKNPLGLQLKEGKVVDRNGDPVELKLVEDEQGQKRHQVVDKYNNPFSVASGTNNDAFVGKQLSPSEFWLDCSIFNCDKPVRVYKYQYSNQEPESKEVELNRTMEINGKKFATYESNNYRDRYHMILPNSKGYLPLDYKERDLNTKTKQINLDLTKAFTLFEIENELSYGGVYAKTTKEMVNKAGYYGRNPTWWAERTLGKSLLNGLRTCKEDSSYNGLLCPRHEPKTSFLIPVETTTKSLYFADNIKLHNMLSVDLGYRYDDIKYQPEYIPGVTPKIADDMVRELFVPLPPANGKDWQGNPVYTPEQIRKNAEENIAYIAQEKRFKKHSYSLGATFDPLNFLRVQVKYSKGFRTPTSDELYFTFKHPDFTILPNPNMKPEEAKNQEIALTFHHDWGFFSTNVFQTKYRQFIDLAYLGSRNLSNSVGGQAQARDFQVYQNVNVDRAKVKGVEINSRLNIGYFFEKLDGFNVSYKFTYQRGRLDGNRPMNAIQPKTSVIGLGYDHKEQRFGADLYVTHVSAKKAKDTYNMFYKEQGYKDSAVRWRSDDYTLVDFVTYIKPVKNVTLQFGVYNLTDRKYLTWESARSIKPFGTSNLINQGTGAGINRFYSPGRNYKLSAEITF

SEQ ID NO: 13191 - protein, 1084 aa, Haemophilus influenzae
MTNFKFSLLACSIAFALNASTVYAAQPTNQPTNQPTNQPTNQPTNQPTNQPTNQPTNQPTNQPTNQPTNQPTNQNSNVSEQLEQINVSGSSENINIKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILIIDTTRDGHEIENYDYKIYPNKQADLRAVGPTREKADPYQITRQSTLIKLGFQPNENHRLSVALDDSTLETKGIDLSYALRPYSTAGNEKYGERIINDQSKRKNIQFSYENFSQTPFWDHIKLSYSSQKITNKARSDEYCHQSTCNGVSNPQGLHLVEEGGVYKIVDKNGDKLTYNKNAGWYGQFQNKNGENVDNDIDSTGGSLDSVLIDCERLNCKNKFQVFVEKDEEGKDKYEYEERDIIVETLPNGKKYGKITLKKGKTPLWDDVYQEESARFLFPKSYGYSTDFVNDRDLNTNTQQIKLDLDKEFSLWHTQHSLKYGGFYEKTLKSMVNHQYNTVANVQWWAGNFFCNKLENGKRTPAPDYSHRCSLMNTDKGKETYLIPVTTKNNVLYFGDNVQLTSWLGLDLNYRYDHVKYLPSYDEKIPVPNGLITGLFKKFGPKDYVYGSKYSKPADYTDCTYNSDCYKKNFKDNLALLLRKTDYKHHSYNLGLNLDPTDWLRVQLKYANGFRAPTSDEIYMTFKHPQFSIQPNTDLKAETSKTKEVAFTFYKNSSYITLNAFQNDYRNFIDLVEVGPRPIEEGSTIAYPFHQNQNRDRARVRGIEIASRLEMGDLFEKLQGFHLGYKFTYQKGRIKDNGLNPKYKEFLELNKDKHPEYEAIARKPQPMNALQPTTSVYNIGYDAPSQKWGVDMYITNVAAKKAKDSFNSQWTSMVKRKEKIYGNEKDAEASTANGKEVKDSRGLWRNNRYTVIDTIAYWKPIKNLTFTAGVYNLTNKKYLTWDSARSIRHLGTINRVETATGKGLNRFYAPGRNYRMSVQFEF

SEQ ID NO: 13192 - protein, 987 aa, Haemophilus influenzae
MTNFRLNALAYSVMLGLTASVAYAEPTNQPTNQPTNQNSNLSEQLEQINVSGSTENSDSKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTRRNGHELENYDYKNANSLTQGKKREKADPYKIEQDSTLLKFSFNPTENHRFTLAADLYEHRSRGQDLSYTLKYQKTNPDLPEVESRHTNDKTKRRNISFSYENFSQTPFWDTLKITFSKQKIKTRARTDEYCDAGVRHCQGTENPTGLKLTDGKITRRDGTPLKFKEKTTNGTEKTYDFDKFIDTNDQEIEGKLTRKRASETWYDCSIFNCKDGTKINVFEGKRHYGHEGKWKEVELEKKEINGKTFARIKDKDNNNYNYGKIQSIFPSSPGYLERLWQERDLDTNTQQLNLDLTKDFKTWRVEHNLQYGSSYNTTMKRMVNRAGNDATDVQWWAERTLGTKTNLFSPTQQEIPRTCEDSLDPNLCPRVDPEFSYLLPIKTKEKSVYLFDNVVITDYLSFDLGYRYDNIHYQPKYKHGVTPKLPDDIVKGLFIPLNGKNNNDEVIKKNVQENIDYIAKQNKKYKAHSYSFASTIDPTSFLRLQLKYSKGFRAPTSDEMYFTFKHPDFTILPNTNLKPEIAKTKEIAFTLHHDDWGFISTSLFKTNYKNFIDLVYKGTQSFKLVSGGDTLPFSLYQNINRDSAVVKGIEINSKVFLGKMAKFMDGFNLSYKYTYQKGRINGNIPMNAIQPKTMVYGLGYDHPSQKFGFNFYTTHVATKNPEDTYDIYAEDKRQTDTSIKWRSKSYTILDLIGYVQPIKNLTIRAGVYNLTNRKYITWDSARSIRSFGTSNVIEQTTGLGINRFYAPGRNYKMSVQFEF

SEQ ID NO: 13193 - protein, 809 aa, Neisseria meningitidis serogroup A
MPIPFKPVLAAAAIAQAFPAFAADPAPQSAQTLNEITVTGTHKTQKLGEEKIRRKTLDKLLTNDEHDLVRYDPGISVVEGGRAGSNGFTIRGVDKDRVAINVDGLAQAESRSSEAFQELFGAYGNFNANRNTSEPENFSEVTITKGADSLKSGSGALGGAVNYQTKSASDYVSEDKPYHLGIKGGSVGKNSQKFSSITAAGRLFGLDALLVYTRRFGKETKNRSTEGDVEIKNDGYVFDPANPSPSRYLTYKATGVARSQPDPQEWVNKSTLFKLGYNFNDRNRIGWIFEDSRTDRFTNELSNLWTGTTTSAATGDYRHRQDVSYRRRTGVEYKNELEHGPWDSLKLRYDKQRIDMNTWTWDIPKNYDTNGINGEVYHSFRHIRQNTAQWTADFEKQLDFSKAVWAAQYGLGGGRGDNANSDYSYFAKLYDPKILASNQAKITMLIENRSKYKFAYWNNVFHLGGNDRFRLNAGIRYDKNSSSAKDDPKYTTAIRGQIPHLGSERAHAGFSYGTGFDWRFTKHLHLLAKYSTGFRAPTSDETWLLFPHPDFYLKTNPELKAEKAKNWELGLAGSGKAGSFKLSGFKTKYRDFIELTYMGVSSDDKNNPRYAPLSDGTALVSSPVWQNQNRTAAWVEGIEFNGTWNLDSIGLPKGLHTGLNVSYIKGKATQNNGKETPINALSPWTAVYSLGYDAPSKRWGVNAYAARTAAKKPSDTVHSNDDLNKPWPYAKHSKAYTLFDLSAYLNIGKQVTLRAAAYNITNKQYYTWESLRSVREFGTVNRVNNKTHAGIQRFTSPGRSYNFTIEAKF

SEQ ID NO: 13194 - protein, 718 aa, Haemophilus influenzae
MRFSKLSLAITTTLVTANALAQSVELDSINVIATRDPSRFAYTPEKQSKDSLLSKQATSVADALEDIPNVDIRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSEKDVSVFAANDKFDVLISGFYNNADNLRTGKGNKLNNTAYKQFGGLAKFGWQINDANRVELSHRETRFKQTAPSNNEVENEFTNEQIIDQIKEFHGSNDGLLPGKQPSESERSKFYSGVKTRFGSVSYLSDQQIPDQSTVFNYYLTPDNPYLNTHIALYNNKTIEKEQRKVSGVKDQTKLTTRGINLRNSSELSHISFVYGVDYMRDKIRTERGTNGSDAKFRADPYNANSNTTGVYLIAHIPLFGEKLLLSPSVRYDHYDTSSKTVKYKDNHLSPATKLTWIVTNWLDFTAKYNEAFRAPSMQERFASGAHFGTTILGSDRINKFVANPNLRPETAKNKEITANLHFDSLFKQGDKFKIEATYFRNDVKDFINLKIFNDANTNKGAGANGAFLPTKSQYQNITNARLSGIELQAQYQTERLTLFTNYGSTKGKDKDSGEALSNIAASKIGVGVNYALVKDKFTVGATVTHYAAQRRVPKDHSVTYPSYILTDLRATYAPLKGEWKNLRLDFALENLFDKKYQPAFSLMEGTGRNAKISAVYSF

SEQ ID NO: 13195 - protein, 716 aa, Haemophilus influenzae
MRFSKLSLAIATTLVTANALAQSVELDSINVIATRDPSRFAYTPEKQSKDSLLSKQATSVAAALEDIPNVDIRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSEKDASVFAANDKFDVLISAFYNNADNLRIGKGNKLNNTAYKQFGGLSKIGWQINDANRVELSHRETRFKQTAPSNNEVENELTNEQITDQIREFHGSNKSFPPKAQPSPSETSKFYSGVKTRLGSVSYLTDQQIPDQSTVFNYYLTPDNPYLNTHIALYNNKTIEKEQRKVSGVKDQTKLTTRGINLRNSSELSHISFVYGVDYMRDKIRTERGTNSSDAQFRADPYNANSNTTGVYLIAHIPLFGEKLLLSPSVRYDHYDTSSKTVKYKDNHLSPATKLTWIVTNWLDFTAKYNEAFRAPSMQERFVSGSHFGANIAGKYNINKFVANPNLRPETAKNKEITANLHFDSLFKQGDKFKIEATYFRNDVKDFINLKIFNDAKANPNTNGAFLPTNSQYQNITNARLSGIELQAQYQTERLTLFTNYGSTKGKDKDSGEALSNIAASKIGVGVNYALVKDKFTVGATVTHYAAQRRVPKDHSVTYPSYILTDLRATYAPLKGEWKNLRLDFALENLFDRKYQPAFSLMEGTGRNAKISAVYSF

SEQ ID NO: 13196 - protein, 723 aa, Haemophilus influenzae
MRFSKLSLAITTTLVTANALAQSVELDSINVIATRDPSRFAYTPEKQSKDSLLSKQATSVADALEDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSEKDVSVFAANDKFDVLISGFYNNADNLRTGKGNKLNNTAYKQFGGLAKFGWQINDANRVELSHRETRFKQTAPSNNEVENELTNEQITDQIKKFHGQKDDLLPPTTQPSPSERSEFYSKVKTRLGSVSYLTDQQIPDQSTVFNYYLTPDNPYLNTHIALYNNKTIEKEQRKVSGVKDQTKLTTRGINLRNSSELSHISFVYGVDYMRDKIRTERGTNGSDAKFRADPYNANSNTTGVYLIAHIPLFGEKLLVSPSVRYDHYDTSSKTVKYKDNHLSPATKLTWIVTNWLDFTAKYNEAFRAPSMQERFVSGAHFGANTLGLDHINRFVANPNLRPETAKNKEITANLHFDSLFKQGDKFKIEATYFRNDVKDFINLKIFNDAKTSASAGANPNTNGALLPKNSQYQNITNARLSGIELQAQYQTERLTLFTNYGSTKGKDKDSGEALSNIAASKIGVGVNYALVKDKFTVGATVTHYAAQRRVPKDHSVTYPSYILTDLRATYAPLKGEWKNLRLDFALENLFDRKYQPAFSLMEGTGRNAKISAVYSF

SEQ ID NO: 13197 - protein, 1102 aa, Shigella flexneri
MNQIHKFFCNMTQCSQGGAGELPTVKEKTCKLSFSPFVVGASLLLGGPIAFAIPLSGTQELHFSEDNYEKLLTPVDGLSPLGAGEDGMDAWYITSSNPSHASRTKLRINSDIMISAGHGGAGDNNDGNSCGGNGGDSITGSDLSIINQGMILGGSGGSGADHNGDGGEAVTGDNLFIINGEIISGGHGGDSYSDSDGGNGGDAVTGVNLPIINKGTISGGNGGNNYGEGDGGNGGDAITGSSLSVINKGTFAGGNGGAAYGYGYDGYGGNAITGDNLSIINNGAILGGNGGHWGDAINGSNMTIANSGYIISGKEDDGTQNVAGNAIHITGGNNSLILHEGSVITGDVQVNNSSILKIINNDYTGTTPTIEGDLCAGDCTTVSLSGNKFTVSGDVSFGENSSLNLAGISSLEASGNMSFGNNVKVEAIINNWAQKDYKLLSADKGITGFSVSNISIINPLLTTGAIDYTKSYISDQNKLIYGLSWNDTDGDSHGEFNLKENAELTVSTILADNLSHHNINGWDGKSLTKSGEGTLILAEKNTYSGLTNINAGILKMGTVEAMTRTAGVIVNKGATLNFSGMNQTVNTLLNSGTVLINNINAPFLPDPVIVTGNMTLEKNGHVILNNSSSNVGQTYVQKGNWHGKGGILSLGAVLGNDNSKTDRLEITGHASGITYVAVTNEGGSGDKTLEGVQIISTDSSDKNAFIQKGRIVAGSYDYRLKQGTVSGLNTNKWYLTSQMDNQESKQMSNQESTQMSSRRASSQLVSSLNLGEGSIHTWRPEAGSYIANLIAMNTMFSPSLYDRHGSTIVDPTTGQLSETTMWIRTVGGHNEHNLADRQLKTTANRMVYQIGGDILKTNFTDHDGLHVGIMGAYGYQDSKTHNKYTSYSSRGTVSGYTAGLYSSWFQDEKERTGLYMDAWLQYGWFNNTVKGDGVTGEKYSSKGITGALEAGYIYPTIRWTTHNNIDNALYLNPQVQITRHGVKANDYIEHNGTMVTSSGGNNIQAKLGLRTSLISQSCIDKETLRKFEPFLEVNWKWSSKQYGVIMNGMSNHQIGNRNVIELKTGVGGRLADNLSIWGNVSQQLGNNSYRDTQGILGVKYTF

SEQ ID NO: 13198 - protein, 805 aa, Shigella flexneri
MKLKFFLFAILGIIATAQAQNSGSVSGKIVEKSNNAPISYATVSLKENGKVVTGVNTDDNGDFTFKNLALKSYTIEIQYIGFRKYVGSVILNDNKKTATVNVSLEEEATQLKGVNIVAERSTIEQKIDRKVVNVGKDLTTAGASASDIMNNIPSVNVDQDGKLSLRGNDNVRVLIDGRPSNIDPAQLLKQIPSTSIKKIELITNPSAKYNPEGMSGIINIILHKNANTGFNGSYSGGITFGETAKYNQSLDLNYKTGKVNFFGNAGNNFGTYFNNGNIQRLDQDVVQKLKISNDNDNYLYKVGMDYLINDHNTLSFYTNQNKSSGTGIVNTDIDYNNGDPNIKNIYQKSRYQGPNQTGTYNLAYKHIFKKEGHTLDFEGNYSKTAESQDANFDTQTTNPANAVNSVIYNDYIHESRKLGTFNVDYVNPLNDKTTLEAGAEARITRTDNDYNTSNPSVPTAEQISNYKYDTDIYSAYVTFGQKYKKFSYQLGARFESYKVAANLNSGQSKFDDDYITLYPSAYLTYNLNEKNVLQLSYSRRVDRPSLEQTKPIREFSTPLVTSYGNPELRPQFTNSVEVNYTKTLEKGSITAGVFVRSINDQISRTLSPDPNDASGYKQILSFANYDHNSAYGFDVSLNYKLTKWWDIQPAIDFSSIKQEGVVFQFDPATNTSSPFQRSVTTSAFNARMNSNFKPTKRLSFLLFGFYRGPVDEIQQKRNEMYKIDIGSRYTLLDNKMNISVRFNDVFNTMKFSFDGIYPYPQTGQFTWESQTVYLGLTYNFGGAKIKKLERKQREDNTNQGGGGMF

SEQ ID NO: 13199 - protein, 1764 aa, Haemophilus influenzae
MLNKKFKLNFIALTVAYALTPYTEAALVRDDVDYQIFRDFAENKGRFSVGATNVEVRDKNNHSLGNALPNGIPMIDFSVVDVNKRIGTLVDPQYIVSVKHAHQYMNDFYFGHYNGHRDVSNDENKYSVVTQNNVNSSEKWDVNKRLDDYNMPRLNKFVTEVAPTTPTLAGDDLETYKDKEKYPSFVRVGAGRQLVYEKGSRHVEGNEHGEDLKDLSVAYNYAIGGTPYEGINIDPSQSKKGLIGFGDSRKDHVIDTKILLSQAPLTNYGVLGDSGSPLFAFDKQQNKWIFIGPYTYWAGYEKKSWQEWNIYKTTFADGIKNRDNAKPVPFSNKEYRWTNTTNHQSEIKNTDHTITVTLPSDPDRLVNYQKEENKNTGQNVIFEGNGNSKNTLVLENNINQGAGGLFFKGNYEVKGTTDNITWVGGGIDVAEGKTVTWKVHNPEKDHLAKIGKGKLIVEGKGDNKGSLKVGDGTVVLKQQTTTGQHAFASVGIVSGRSTVVLNDDKQVDPNSIYFGFRGGRLDLNGNSLTFDHIRNIDDGARLVNHNMTNASNITITGESLITDPKKINPYYIKAREEDNPYAFRWIKDGEQLYFNLENYTYYALRKGGKANSQLPYNDKESNENWLYMGKNADEAKRNVMKHINNERMNGFNGYFGEEEGKDNGNLNVTFKGKTEQNRFLLTGGTNLNGNLKVEQGTLFLSGRPTPHARDIAGISSTKKDSHFAENNEVVVEDDWINRNFKATTMNVTGNASLYSGRNVESITSNITASSKAQVHIGYKKGDTVCVRSDYTGYVTCHNGDLSEKALNSFNATNVFGNVNLSGNANFTLGKANLHGSIQAGGNSQVHLTENSHWYLTGDSNVHQLDLKNGHIHLNSADNKNNVTKYNTLNISNLSGNGSFYYLTDLSKNQGDKVVVTKSAKGNFTLQVADKTGEPTKNELTLFDASNATRSNLVVTLANGSVDRGAWKYKLRENNGRYDLYNPEVERRHQTVDTPSVEMPNDMQADAPSAPSNNEEIARVDAPVPPPAPPAPATGSAMAKEQPKTRPAETAQPTMEETKAANSTETAPKSDTTTQADTSNSESVPSETTETVAENSPQESASVEKNAEEATETTPQNDEVAKEAKPTVETKDQTNEMTQSGSENTTETQAENKVSQPTETDKIATVETEETARVEKEETQVASQTFPKQEEPEMTKQQAEPETRNVPIVNNLEEAQPQTKPITVATAETPTSNSKSAEKTQPSGETNAEPVTPVVVSENQPENTISQPTEDTVVKVETEETPKVETGGTKEAPQVASQTSPKQEEPETVQPQAEPAQENSPTVNNVEEAQPQTQPTIVAAKEITAPNSAQKETAQSVANPKTAEQPVTVSTENPVVENPENTTQPAVNSEAVQPETATTGTVSQPKEASTDETTVASTDETTGTSAEETTVADNSEASKPKRRSRRDVSSTPHNVEPAVTGGGRDRSAVVVPLRDLTSTNTNAVLSDAMAKAQFVALNVGKAVSQHISQLEMNNEGQYNVWVSNTSMNENYSSDQYRRFSSKSAQTQLGWDQTISNNVQLGGILTYVRNSNSFDKASSKNTLAQANFYSKYYADNHWYLAVDLGYGNFQSNLQTNHNAKFDRHTAQIGLTAGKAFNLGNVAVKPTVGVRYSYLSNADFALDQDRIKVNPISVKTAFAQVDLSYTYNLGEFAITPILSARYDANQGNGKINVSGYAFAYNVENQQQYNAGLKLKYHNVKLSLMGGLTKAKQAEKQKTAEVKLSFSF

SEQ ID NO: 13200 - protein, 1545 aa, Haemophilus influenzae
MLNKKFKLNFIALTVAYALTPYTEAALVRDDVDYQIFRDFAENKGKFSVGATNVEVRDKNNRPLGNVLPNGIPMIDFSVVDVDKRIATLVNPQYVVGVKHVSNGVSELHFGNLNGNMNNGNAKAHRDVSSEENRYYTVEKNEYPTKLNGKAVTTEDQAQKRREDYYMPRLDKFVTEVAPIEASTDSSTAGTYNNKDKYPYFVRLGSGTQFIYENGTRYELWLGKEGQKSDAGGYNLKLVGNAYTYGIAGTPYEVNHENDGLIGFGNSNNEYINPKEILSKKPLTNYAVLGDSGSPLFVYDREKGKWLFLGSYDYWAGYNKKSWQEWNIYKPEFAEKIYEQYSAGSLIGSKTDYSWSSNGKTSTITGGEKSLNVDLADGKDKPNHGKSVTFEGSGTLTLNNNIDQGAGGLFFEGDYEVKGTSDNTTWKGAGVSVAEGKTVTWKVHNPQYDRLAKIGKGTLIVEGTGDNKGSLKVGDGTVILKQQTNGSGQHAFASVGIVSGRSTLVLNDDKQVDPNSIYFGFRGGRLDLNGNSLTFDHIRNIDEGARLVNHSTSKHSTVTITGDNLITDPNNVSIYYVKPLEDDNPYAIRQIKYGYQLYFNEENRTYYALKKDASIRSEFPQNRGESNNSWLYMGTEKADAQKNAMNHINNERMNGFNGYFGEEEGKNNGNLNVTFKGKSEQNRFLLTGGTNLNGDLNVQQGTLFLSGRPTPHARDIAGISSTKKDSHFSENNEVVVEDDWINRNFKATNINVTNNATLYSGRNVESITSNITASNNAKVHIGYKAGDTVCVRSDYTGYVTCTTDKLSDKALNSFNPTNLRGNVNLTESANFVLGKANLFGTIQSRGNSQVRLTENSHWHLTGNSDVHQLDLANGHIHLNSADNSNNVTKYNTLTVNSLSGNGSFYYLTDLSNKQGDKVVVTKSATGNFTLQVADKTGEPNHNELTLFDASKAQRDHLNVSLVGNTVDLGAWKYKLRNVNGRYDLYNPEVEKRNQTVDTTNITTPNNIQADVPSVPSNNEEIARVDEAPVPPPAPATPSETTETVAENSKQESKTVEKNEQDATETTAQNREVAKEAKSNVKANTQTNEVAQSGSETKETQTTETKETATVEKEEKAKVETEKTQEVPKVTSQVSPKQEQSETVQPQAEPARENDPTVNIKEPQSQTNTTADTEQPAKETSSNVEQPVTESTTVNTGNSVVENPENTTPATTQPTVNSESSNKPKNRHRRSVRSVPHNVEPATTSSNDRSTVALCDLTSTNTNAVLSDARAKAQFVALNVGKAVSQHISQLEMNNEGQYNVWVSNTSMNKNYSSSQYRRFSSKSTQTQLGWDQTISNNVQLGGVFTYVRNSNNFDKATSKNTLAQVNFYSKYYADNHWYLGIDLGYGKFQSKLQTNHNAKFARHTAQFGLTAGKAFNLGNFGITPIVGVRYSYLSNADFALDQARIKVNPISVKTAFAQVDLSYTYHLGEFSVTPILSARYDANQGSGKINVNGYDFAYNVENQQQYNAGLKLKYHNVKLSLIGGLTKAKQAEKQKTAELKLSFSF

SEQ ID NO: 13201 - protein, 1694 aa, Haemophilus influenzae
MLNKKFKLNFIALTVAYALTPYTEAALVRDDVDYQIFRDFAENKGRFSVGATNVEVRDKNNHSLGNVLPNGIPMIDFSVVDVDKRIATLINPQYVVGVKHVSNGVSELHFGNLNGNMNNGNAKSHRDVSSEENRYFSVEKNEYPTKLNGKAVTTEDQTQKRREDYYMPRLDKFVTEVAPIEASTASSDAGTYNDQNKYPAFVRLGSGSQFIYKKGDNYSLILNNHEVGGNNLKLVGDAYTYGIAGTPYKVNHENNGLIGFGNSKEEHSDPKGILSQDPLTNYAVLGDSGSPLFVYDREKGKWLFLGSYDFWAGYNKKSWQEWNIYKPEFAKTVLDKDTAGSLTGSNTQYNWNPTGKTSVISNGSESLNVDLFDSSQDTDSKKNNHGKSVTLRGSGTLTLNNNIDQGAGGLFFEGDYEVKGTSDSTTWKGAGVSVADGKTVTWKVHNPKSDRLAKIGKGTLIVEGKGENKGSLKVGDGTVILKQQADANNKVKAFSQVGIVSGRSTVVLNDDKQVDPNSIYFGFRGGRLDANGNNLTFEHIRNIDDGARLVNHNTSKTSTVTITGESLITDPNTITPYNIDAPDEDNPYAFRRIKDGGQLYLNLENYTYYALRKGASTRSELPKNSGESNENWLYMGKTSDEAKRNVMNHINNERMNGFNGYFGEEEGKNNGNLNVTFKGKSEQNRFLLTGGTNLNGDLKVEKGTLFLSGRPTPHARDIAGISSTKKDQHFAENNEVVVEDDWINRNFKATNINVTNNATLYSGRNVANITSNITASDNAKVHIGYKAGDTVCVRSDYTGYVTCTTDKLSDKALNSFNATNVSGNVNLSGNANFVLGKANLFGTISGTGNSQVRLTENSHWHLTGDSNVNQLNLDKGHIHLNAQNDANKVTTYNTLTVNSLSGNGSFYYLTDLSNKQGDKVVVTKSATGNFTLQVADKTGEPTKNELTLFDASNATRNNLNVSLVGNTVDLGAWKYKLRNVNGRYDLYNPEVEKRNQTVDTTNITTPNNIQADVPSVPSNNEEIARVETPVPPPAPATPSETTETVAENSKQESKTVEKNEQDATETTAQNGEVAEEAKPSVKANTQTNEVAQSGSETEETQTTEIKETAKVEKEEKAKVEKDEIQEAPQMASETSPKQAKPAPKEVSTDTKVEETQVQAQPQTQSTTVAAAEATSPNSKPAEETQPSEKTNAEPVTPVVSKNQTENTTDQPTEREKTAKVETEKTQEPPQVASQASPKQEQSETVQPQAVLESENVPTVNNAEEVQAQLQTQTSATVSTKQPAPENSINTGSATAITETAEKSDKPQTETAASTEDASQHKANTVADNSVANNSESSDPKSRRRRSISQPQETSAEETTAASTDETTIADNSKRSKPNRRSRRSVRSEPTVTNGSDRSTVALRDLTSTNTNAVISDAMAKAQFVALNVGKAVSQHISQLEMNNEGQYNVWVSNTSMNENYSSSQYRRFSSKSTQTQLGWDQTISNNVQLGGVFTYVRNSNNFDKASSKNTLAQVNFYSKYYADNHWYLGIDLGYGKFQSNLKTNHNAKFARHTAQFGLTAGKAFNLGNFGITPIVGVRYSYLSNANFALAKDRIKVNPISVKTAFAQVDLSYTYHLGEFSVTPILSARYDTNQGSGKINVNQYDFAYNVENQQQYNAGLKLKYHNVKLSLIGGLTKAKQAEKQKTAELKLSFSF

SEQ ID NO: 13202 - protein, 1781 aa, Haemophilus influenzae
MLNKKFKLNFIALTVAYALTPYTEAALVRDDVDYQIFRDFAENKGKFSVGATNVEVRDKNNHSLGNALPNGIPMIDFSVVDVNKRIGTLVDPQYIVSVKHAHQYMNDFYFGHYNGHRDVSDDENKYSVVTQNNVNPNENWHVDKRLDDYNMPRLNKFVTEVAPTTPTLAGDDLETYKDKEKYLSFVRVGAGRQLVYEKGSHHVEDKEHGEDLKDLSAAYRYAIGGTPYKGINIDPSQSKKGLIGFGDSREDHVINSKTLLSQDPLTNYGVLGDSGSPLFAFDKQQNKWVFIGPYTYWAGYGKKSWQEWNIYKSQFTKDVLNKDSAGLLKGNTQYNWTSNGNTSMISNGSELLEVNLFDNSKHTNREKANYGKSVTFQGNGTLTLKNSINQGAGGLFFEGNYTVEGSSDNIVWNGAGISVAEGKTVTWKVHNPQSDRLAKIGKGTLIVEGKGENKGSLKVGDGTVILKQQADANNKVKAFSQVGIVSGRSTVVLNDDKQVDPNSIYFGFRGGRLDANGNNLTFEHIRNIDDGARIVNHNMTNASNITITGTGLITNPSQVTLDYIRPRDEENPYALRRIKDGGQLYLNEENYTYYALRKGAKANLQLPYNDNESNETWLYMGKDKNEAQKKTMEYINNSRMNGFNGYFGEEDSKNNGNLNVTFKGKSEQNRFLLTGGTNLNGDLTVEKGTLFLSGRPTPHARDIAGISSTKKDQHFAENNEVVVEDDWINRNFKATNINVTNNATLYSGRNVANITSNITASNKAQVHIGYKAGDTVCVRSDYTGYVTCHNGTLSTKALNSFNPTNLRGNVNLSGNANFVLGKANLFGTIHSTENSQVNLKENSHWHLTGNSDVHQLDLANGHIHLNNVSDATKATKYHTLNISNLSGNGSFYYLTDLSKKQGDKVVVTQSATGNFTLQVADKTGEPTKNELTLFDASNATRNNLNVSLIGNTVDLGAWKYTLKETDGRYDLYNPEVEKRNQTVDTPSIAMPNNIQADAPSVPSNNEEIARVDAPVPPPAPPAPATGSVMANGQPETRPAETTQPAMEEANTANSTETAPKSDTATQTENPNSESVPSETTEKVAENSPQENETVAKNEQKATETTTQNGEVAEEAQSSAETKAQTNKVAQSGSETEETQTAETKSEPTESITVSENQPEKTVSQSTEDKVVVEKEEKAKVETEETQKAPQVTSKEPPKQAEPAPEEVPTDTNAEEAQALQQTQPTTVTAAETTSPNSKPAEETQSSEGTNAKPVTPVVSENKVSQPTETEKTAKVESKEAQETPKVASQASPKQEQSETVQPQAELESEKVPTVKNAEEVQAQPQTQPSAIVSTEQPAKETSSNVEQPEQESSTNTGSATAMTETAEKSDKPQMETVTENDRQPEANTVADNSVANNSESSESKSRRRRSVSQPKETSTEETTVTSTDKTTVADNSKSSKPNRRHRRSVSQPQETSTEKTTVADNSKRSKPKRRSRRDVSSAPHNVEPLHNLTSTNTNAVISDAMAKAQFVALNVGKAVSQHISQLEMNNEGQYNVWVSNTSMNENYSSSQYRRFSSKSTQTQLGWDQTISNNVQLGGVFTYVRNSNNFDKASSKNTLAQANLYSKYYMDNHWYLAVDLGYGNFQSNLQTNHNAKFARHTAQFGLTAGKAFNLGNFAVKPTVGVRYSYLSNANFALDQDHIKVNPISVKTAFAQIDLSYTYRLGEFAITPILSARYDANQGSGKINVDRYDFAYNVENQQQYNAGLKLKYHNVKLSLIGGLTKAKQAEKQKTAEVKLSFSF

SEQ ID NO: 13203 - protein, 1745 aa, Haemophilus influenzae
MLNKKFKLNFIALTVAYALTPYTEAALVRDDVDYQIFRDFAENKGKFSVGATNVEVRDKKNQSLGSALPNGIPMIDFSVVDVDKRIATLVNPQYVVGVKHVSNGVSELHFGNLNGNMHNGNAKSHRDVSSEENRYYTVEKNEYPTKLNGKAVTTEDQAQKRREDYYMPRLDKFVTEVAPIEASTDSSTAGTYNNKDKYPYFVRLGSGTQFIYENGTRYELWLGKEGQKSDAGGYNLKLVGNAYTYGIAGTPYEVNHENDGLIGFGNSNNVHSDPKGILSQDPLTNYAVLGDSGSPLFVYDREKGKWLFLGSYDFWAGYNKKSWQEWNIYKSQFTKDVLNKDSAGSLTGSNTDYSWSSNGTSTSTIRGVAEHLNVDLADGKDKPNHGKSITLKGNGTLTLNNNIDQGAGGLFFEGDYEVKGTSDSTTWKGAGISVAEGKTVTWKVHNPQSDRLAKIGKGTLIVNGKGDNKGSLKVGDGTVVLKQQTTKGQHAFASVGIVSGRSTVVLNDDKQVDPNSIYFGFRGGRLDLNGNSLTFDHIRNIDDGARIVNHNTSKTSTVTITGDNLITSPSQISLVYNIPLRDEENPYVRRQIKYGGQLYFNEENRTYYSLKRGASVYSELPYNDKVSNENWLYMGKTSDEAKRNVMNHINNERMNGFNGYFGEEENKADQNGKLNVTFSGKTDQNRFLLTGGTNLNGDLKVEKGTLFLSGRPTPHARDIAGISSTKKDPHFAENNEVVVEDDWINRNFKATNINVTNNATLYSGRNVANITSNITASDKAQVHIGYKAGDTVCVRSDYTGYVTCHNGNLSEKALNSFNATNVSGNVNLSGNANFVLGKANLFGTISSTGNSQVRLTENSHWHLTGNSDVHQLDLANGHIHLNSADNSNNVTKYNTLTVNSLSGNGSFYYLTDLSKKQGDKVVVTKSATGNFTLQVADKTGEPNHNELTLFDASTVAERSNLKVTLANGSVDIGAWKYTLKDTNGRYDLYNPEVEKRNQTVDTTNITTPNNIQADAPSVPSNNEEIARVEAPVPPPAPATPSETTETVAENSKQESETIAKNEQDATETTAQNREVAEEAKPSVEANTQTNELAQSGSETEETQTTETARQPEINSTEETAVENGLTSSEPRTEETATVEKEETQEVPKVTSETSPKQAEPAPKEVSTDTKVEETQVQAQLQTQPSATVSTEQPAKETSSNVKQPAPENSINTGSATAMTETAEKSDKPQTQTAATTEDASQHKANTVTDNSVANNSTSVKPTENSSTKTEQPVTESTTVNTGNSVVENPENTTQPAVNSEAVQSKTTEADNSGSSNPKRRHRRSISQPQETSTEETTVTSTEKTTVADNSESNKTNSRRKRSISQPQETSAEETTVTSTNETTVADNSRRRSRRSVSQPKETSTEETTVTSTEKTTVADNSESNKTNSRRRSRRSVSSEPTVASGSDRSTVALRDLTSTNTNAVISDAMAKAQFVALNVGKAVSQHISQLEMNNEGQYNIWVSNTSMNENYSSSQYRRFSSKSTQTQLGWDQTISNNVQLGGVFTYVRNSNNFDKATSKNTLAQVNFYSKYYADNHWYLGIDLGYGKFQSNLQTNNNAKFARHTAQFGLTAGKAFNLGNFGITPIVGVRYSYLSNANFALDQDRIKVNPISVKTAFAQVDLSYTYHLGEFSVTPILSARYDANQGSGKINVTRYDFAYNVENQQQYNAGLKLKYHNVKLSLIGGLTKAKQAEKQKTAELKLSFSF

SEQ ID NO: 13204 - protein, 1593 aa, Neisseria gonorrhoeae
MKAKRFKINAISLSIFLAYALTPYSEAALVRDDVDYQIFRDFAENKGKFFVGATDLSVKNKRGQNIGNALSNVPMIDFSVADVNKRIATVVDPQYAVSVKHAKAEVHTFYYGQYNGHNDVADKENEYRVVEQNNYEPHKAWGASNLGRLEDYNMARFNKFVTEVAPIAPTDAGGGLDTYKDKNRFSSFVRIGAGRQLVYEKGVYHQEGNEKGYDLRDLSQAYRYAIAGTPYKDINIDQTMNTEGLIGFGNHNKQYSAEELKQALSQDALTNYGVLGDSGSPLFAFDKQKNQWVFLGTYDYWAGYGKKSWQEWNIYKKEFADKIKQHDNAGTVKGNGEHHWKTTGTNSHIGSTAVRLANNEGDANNGQNVTFEDNGTLVLDQNINQGAGGLFFKGDYTVKGANNDITWLGAGIDVADGKKVVWQVKNPNGDRLAKIGKGTLEINGTGVNQGQLKVGDGTVILNQKADADKKVQAFSQVGIVSGRGTLVLNSSNQINPDNLYFGFRGGRLDANGNDLTFEHIRNVDEGARIVNHNTDHASTITLTGKSLITNPNSLSVHSIQNDYDEDDYSYYYRPRRPIPQGKDLYYKNYRYYALKSGGSVNAPMPENGVAENNDWVFMGYTQEEAKKNAMNHKNNQRISGFSGFFGEENGKGHNGALNLNFNGKSAQNRFLLTGGANLNGKISVTQGNVLLSGRPTPHARDFVNKSSARKDAHFSKNNEVVFEDDWINRTFKAAEIAVNQSASFSSGRNVSDITANITATDNAKVNLGYKNGDEVCVRSDYTGYVTCNTGNLSDKALNSFDATRINGNVNLNQNAALVLGKAALWGKIQGQGNSRVSLNQHSKWHLTGDSQVHNLSLADSHIHLNNASDAQSANKYHTIKINHLSGNGHFHYLTDLAKNLGDKVLVKESASGHYQLHVQNKTGEPNQEGLDLFDASSVQDRSRLFVSLANHYVDLGALRYTIKTENGITRLYNPYAGNRRPVKPAPSPAANTASQAQKATQTDGAQIAKPQDIVVAPPSPQANQAEEAKRQQAKAEQVKRQQAEAGRKSAELSAKQRAGEEERRQTAQSQPQRRKRRAAPQDYMAVSQDRPKRRGHRSVQQNNVEIAQAQAELARRQQEERKAAELLAKQRAEAEREAQALAARRKAEAEEAKHQAAELAHRQEAKRKAAESAKRKAEEEEHRQTAQSQPQRRKRRAAPQDYMAVSQDRPKRRGRRSTLPAPPSPSFDSSAYAAPRALHNPDWYENDYEEIPLDALEDEDVSESVDTSDKQPQDNTELHEKVEAVSLQPRAAQPRTQAAAQADAVSTNTNSALSDAMASTQSILLDTGASLTRHIAQKSRADAEKNSVWMSNTGYGRDYASAQYRRFSSKRTQTQIGIDRSLSENMQIGGVLTYSDSQHTFDQAGGKNTFVQANLYGKYYLNDAWYVAGDIGAGSLRSRLQTQQKANFNRTSIQTGLTLGNTLKINQFEIVPSAGIRYSRLSSADYKLGDDSVKVSSMAVKTLTAGLDFAYRFKVGNLTVKPLLSAAYFANYGKGGVNVGGKSFAYKADNQQQYSAGAALLYRNVTLNVNGSITKGKQLEKQKSGQIKIQIRF

SEQ ID NO: 13205 - protein, 733 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDRIEVISGATSLYGGGSTGGLINIVTKKGQPETIMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 13206 - protein, 302 aa, Dickeya dadantii
MKIKLLPLAVAALIATPAFAEPTLYGKANVAYQFADDGSDSVTELVSHASRIGVKGSEKLEGGNLEVIYQAEFQVDFADGDEGDSPFSQRNIFVGLKGDFGTVKAGKFDTPLKVSQNKIDLFNDLAGDIKHMVTVNDNRPGNVVQYSTPTASGFSGSFAIINSEDADVDNGLSGSVSYTQDALYVSLARDENVEAEDTNATRLVGQYSMGDIQLGALYEAYEAAGADSENGWLVSAKYKLDAWALKLQAGQSDINEAGGQTVSVGADRKLSKAAKLFFYYTAQESDAGTDDNFLGAGVEVKF

SEQ ID NO: 13207 - protein, 943 aa, Neisseria meningitidis serogroup A
MNKKHGFQLTLTALAVAAAFPSYAANPETAAPDAAQTQSLKEVTVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSWGIQAKTAYGSKNRQFMKSLGAGFSKDGWEGLLIRTERQGRETHPHGDIADGVAYGINRLDAFRQTYGIKKPSEGGEYFLAEGESELKPVAKVAGNGNYLNNQLNRWVKERIEQNQPLSAEEEAMVREAQARHENLSAQAYTGGGRILPDPMDYRSGSWLAKLGYRFGGRHYVGGVFEDTKQRYDIRDMTEKQYYGTDEAKKFRDKSGVYDGDDFRDGLYFVPNIEEWKGDQKLIRGIGLKYSRTKFIDEHHRRRRMGLLYRYENEKYSDNWADKAVLSFDKQGVATDNNTLKLNCAVYPAVDKSCRASADKPYSYDSSDRFHYREQHNVLNASFEKSLKNKWTKHHLTLGFGYDASNAISRPEQLSHNAARISEYSDYTDKGDKYLLGKPEVVEGSVCGYIETLRSRKCVPRKINGSNIHISLNDRFSIGKYFDFSSGGRYDRKNFTTSEELVRSGRYVDRSWNSGIVFKPNRHFSLSYRASSGFRTPSFQELFGIDIYHDYPKGWQRPALKSEKAANREIGLQWKGDFGFLEISSFRNRYTDMIAVADHKTKLPNQAGQLTEIDIRDYYNAQNMSLQGVNILGKIDWNGVYGKLPEGLYTTLAYNRIKPKSVSNRPGLSLRSYALDAVQPSRYVLGFGYDQPEGKWGANIMLTYSKGKNPDELAYLAGDQKRYSTKRASSSWSTADVSAYLNLKKRLTLRAAIYNIGNYRYVTWESLRQTAESTANRHGGDSNYGRYAAPGRNFSLALEMKF

SEQ ID NO: 13208 - protein, 943 aa, Neisseria meningitidis serogroup B
MNKKHGFPLTLTALAIATAFPAYAAQAGGATPDAAQTQSLKEITVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSWGIQAKTAYGSKNRQFMKSLGAGFSKDGWEGLLIRTERQGRETRPHGDIADGVEYGIDRLDAFRQTYDIKRKTREPFFSVEGERESKPVAKLAGYGKYLNNQLNRWVKERIEQNQPLSAEEEAQVREAQARHENLSAQAYTGGGRILPDPMDYRSGSWLAKLGYRFGGRHYVGGVFEDTKQRYDIRDMTEKQYYGTDEAEKFRDKSGVYDGDDFRDGLYFVPNIEEWKGDKNLVRGIGLKYSRTKFIDEHHRRRRMGLLYRYENEAYSDNWADKAVLSFDKQGVATDNNTLKLNCAVYPAVDKSCRASADKPYSYDSSDRFHYREQHNVLNASFEKSLKNKWTKHHLTLGFGYDASKAISRPEQLSHNAARISESTGFDENNQDKYLLGKPEVVEGSVCGYIETLRSRKCVPRKINGSNIHISLNDRFSIGKYFDFSLGGRYDRKNFTTSEELVRSGRYVDRSWNSGILFKPNRHFSVSYRASSGFRTPSFQELFGIDIYHDYPKGWQRPALKSEKAANREIGLQWKGDFGFLEISSFRNRYTDMIAVADHKTKLPNQAGQLTEIDIRDYYNAQNMSLQGVNILGKIDWNGMYGKLPEGLYTTLAYNRIKPKSVSNRPGLSLRSYALDAVQPSRYVLGFGYDQPEGKWGANIMLTYSKGKNPDELAYLAGDQKRYSTKRASSSWSTADVSAYLNLKKRLTLRAAIYNIGNYRYVTWESLRQTAESTANRHGGDSNYGRYAAPGRNFSLALEMKF

SEQ ID NO: 13209 - protein, 649 aa, Photorhabdus luminescens
MKRSFIFAPGILALSISAISNAHTYDNLYVFGDSLSDSGNNGRYTVDGKTSDLYHDIIARKLGTELTHSNSGGTNYAAGGATAVASLNSKDNTQDQITRYLASHGGRADSNGMYIHWIGGNDIKEALEDLGKAQDMIDKSATAAASQVYTLLDAGAGLVIVPTVPDVGVTPKLMETIISKGLASRGATESQIKAALGKVHAGVNEYPTIDEGTRLQVIQGVFKNIGSDVSGGDAKKAEAITQQLLDTYRKLSSDASKLVDSYNQLEDTLLSKGDGNIVRVDINALLHEVMADPLRYGFLNTIGYACPQGVNASACHSTDPGFDASKPFLFADDFHPTPAAQHMMGQYAISILNAGQQVMLLTKANNVPVKGALASLDGRLQQLRSVGNEQGKVGVFGGYSGNHNHTLTLGSDYQLTDNILLGGMISRYQDNRSVDNFRYDGRGYVFTAYGLWRYYDKGWISGDLHYLDMKYEDITRGVVLNEWLRNEHASTTGHQWGGRITAGWDILLAPTVTTSPIIQYAWDKSYVKGYRESGNNSTSMHFGDQRYDSQVGTLGWRLDTNFNRFSPYAEIRFNRQFGEKRYQVRGAINSTETFPVSKSPKQDTNWREYVIGMNTVINKDWGAFASISRNDGDVQNHTYAFSLGVNASF

SEQ ID NO: 13210 - protein, 108 aa, Escherichia coli
  misc_feature (37)..(37): Xaa can be any naturally occurring amino acid
  misc_feature (78)..(78): Xaa can be any naturally occurring amino acid
MRNRWFSVMAGPSVRVNEWFSAYAMAGVAYSRVSTFXGDYLRVTDNKGKTHDVLTGSDDGRHSNTSLAWGAGVQFNPXESVAIDIAYEGSGSGDWRTDGFIVGVGYKF

SEQ ID NO: 13211 - protein, 371 aa, Burkholderia cenocepacia
MPPILHLRRRHVMPLVVMATGFVADASAETNVTIYGRLNTAIEYSSASTSTNGTSLGSVVRQTNNRSVFGFRGEEDLGGSLKAVWQIESNLSIDTGQGQIAGRNSRIGLQGDYGLFFMGHWTTPYTEATMGYDPYYPTTAGYMALIGNGSTSSSDNVQDTSSFDRRQKNIVQYRSPSLAGVSVSLGWGLPEEKLTVPRNPALYSMAAVYERGPLNATVAYEIHQHYQAAGRNDDALKFGIAYQLFQGTRLAAIYEHLHYRTDTGDLQRNAYYASLVQQVGTGSVRAGVAYAANGTGSSTSTIGYFRSGAETGAIQFTVGYDYPLSKRTALFAYYSRINNKKNAVYDFAINQLGIKAGADPQTVALGMRHFF

SEQ ID NO: 13212 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFIDISKQVTTKLAYRGKVGISYQFTPEISLVAGGFYHGLFDESYKDIPAHNSVKFSGEAKASVKAHIADYGFNLGARFLFS

SEQ ID NO: 13213 - protein, 211 aa, Pseudomonas aeruginosa
MIKRTICLVYPLFCLASPTWAEESPWTYRIGMTNVAFDASAKVYLNGQRVPGGSADASDNNALTFDFGYAINDQWNVRAIVGIPPTTKVTGAGTLPGIQLGKITYAPTVLTLNYNLPALGPVRPHIGAGVNYTRIFESRDANLKSFDADHAWSPALHVGADIDVNRGWFVSIDIRKLYLKSDASGYLGPQEAKARVTLDPLLTSIAIGRQF

SEQ ID NO: 13214 - protein, 151 aa, Pseudomonas putida
ADHVEDGPNVTLDLLFASPDFLDAIWSPRPYLYGSFNTNGLTNFGGTGLAWDFEVAENLNFEFRTGLTYNDGVEDIDPNSPPGDPTRIRLATTRSLMGNEILFHNAIGLDYDLNERWSVGAYYEHISHGQILASGRNQALDNAGIRFGYRF

SEQ ID NO: 13215 - protein, 467 aa, Escherichia coli O6
MKKAINKTFLASCILCAAGQASAAAFQLAEISTSGLGRSYAGEAAIADNAAVIATNPALMSQFKTNQFSAGGIYVDSQIRMNGTVSANLAGQTVAQAPASKTSVVPGSLIPNMYFVSPLNDKFAVGAGMNVNFGLKSEYEDDYAAGVFGGKTELTALNLNLSGSYRVTEKLSAGVGLNALYAKAEVSRNAGILADAVGNVASNPQALSAIVAQRPDLASKMGALSGLASGLQRDTLLTHLQDKTAWAFGYNLGLAYDLNERNRFGIAYHSKIDIDFKDRNAVSYLPYGTTPYIGEGGLVLHLPSYWEFSGYHKLTDKFAMHYSYKYTEWSRLKNLHATYADRSLRNDGLAFHKDEEYKDNSRIALGATYEVDEKLTLRAGVAYDESAAPRTHASASIPDTNRTWYSLGATYKFTPALSVDFGFAHLRGRKLDFSEEQSLAGGLVTVKADYKSKATANLYGLNINYSF

SEQ ID NO: 13216 - protein, 360 aa, Escherichia coli
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNNQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 13217 - protein, 1984 aa, Ectothiorhodospira vacuolata
MQKKTLLSACIALALSGSGWAADIDDTDSATRQRKETRIPCPTAHSSEKLSPQQLKSLPSECSTTNDNNLYSLIAVGATSLITTLAVLELNHDDGNHAHSSDNPPVPPDDDNGGNTPDDGGNTPDDGGNTPDDGGNTPDDGGNTPDDGGNTPDDGGNTPDDGGNTPDDGGNTPDDGGNTPDDGGNTPDDGGNTPDDGGNTPDDGGNTPDDGGNTPDDGGNTPDDGGNVTPPKEPKIFNNNVTFDEDKGTLKIRNATFTYSKNTDGTYTLTAGDGRTTVVQGWDVDTAANTVEITGVNTQGGMTWRYGKDGIIYITKTVGATVDDPASSNVFNLSDAVLTDQGGNAALNGATVIEINGSRIVLNNDGDISATGKDSVVVAMTGNDITVNNNGHMVVDGGTAGVVNGDRAILNNRGDAVITNGGAGVIVTGDNAVINNTGQSDIDGDNSVSVKVAGNATRIKMEGGLNVSGGAHGIDATGDNNEVSNKGNISVVDAHSTGVLLNGDRASFVNMGDINVSGGAADDHAIGVQINGDNSTFINVGDLNADDRATGVKITGDASDIALAGAMHVGDFASGLEVTGKNNDLSLSTNMMDVTGKQSTGVTITGDENTIDITGDMVVDQNSVGTKIVGDRVSLQQKGDITVNGAGHGVEVSGSKATINNQGKLTVKDQDSIGIAITGDDAQFTTVGEIDVSLNGTGVAISGDREQVNLSGDINIIQERDDSGTFQGGTGISIMSNDSSMLLAGNINVTSSIGDQPSTSHLSLTGVTIGGENNTVDLQGDVNITVDSGYPGDENSLYGVVVSGSNNIISLDGGINISGDSGGHVVKGVQVTGNNTVNISGHSVMNTRQVLGAFSLISVADGGNVVFDENAITEIQSSVRNTTAPLFVDSSLIVAKGNQSVIQNKGIINTTDAQGLMMANSGAKVVNAGVINIRPDAESHSFFAGMLARGDDSQAKNVSGGTINLTSITQPSYGGGFSEYPVKWYFNTGYALLASNYGSVINEAGATINLHGAGTYGVSASKGTATNAGEINVDGFVPTVDENGNISDETYWQTNSVYLMGGGMLAGSTDTGNGDAKAVNTGTINVKNEGFGMLAMSGGTVVNQGTINLTADEGVTKQQDNQLFALGAIQRGLAINDQNGVININTDIGQAFYKDSTGTILNYGKINLFGNPMDESDSHMGVAPDDKDVLSELSGSGESISKTTTADGFIAVNDLANYGDETLNGDVTANGWIFNQPDASLTINGELSVNQGLENSGHLTTDLLTLNGAVSFFNEGEFSGSITGNSYQQNVVNTGEMTVTEDGHSLVNGSFLFFNEAGATLTNSGNAVTGGENAIIHVTRTGDSVSQVNRGTITAINGYSAIKTENTGSYSNGKWIWNTETGVINGINPAAPLVDLGRGYNFSNAGVINVQGDNAVGISGGITSYTVKLVNSGTINVGTEQGQLDGTNGEGLIGIKGNGKDTTINNTQTGVINVYADNSWAFGGQTKAIINNGEINLLCDTGCDIYAPGTTGTKNDHNGTADITVPEASTTPSQGNVPTPPADSNAPQLLSNYTIGTNSDGSSGTLSANNLVIGDNVSVNAGFSAGTADTTVVVNDVFKGENISGVDNIVSSTVVWTAKGSTDASGNVDVTMSKNAYTDVATDGSVSDVAKALDAGYTNNELYTSLNVGTTAELNSALKQISGSQATTVFREARVLSNRFSMLADAAPKMGNGLAFNVVAKGDPRAELGNNTEYDMLALRKTVDLSESQTMSLEYGIARLDGDGAQKAGDNGVTGGYSQFFGLKHQMSFDNGMNWNNALRYDIHQLDSSRSVAYGDVSKTADTNVKQQYLEFRSEGAKTFEPREGLKITPYAGVKLRHTLEGGYQERNAGDFNLSMNSGSETAVDSIVGLKLDYAGKDGWSANATLEGGPNLSYAKSQRTASLAGAGSQHFNVDDGQKGGSINSLASVGVKYSSKESSLNLDAYHWKEDGVSDKGVMLNFKKTF

SEQ ID NO: 13218 - protein, 751 aa, Pseudomonas sp.
MGPQQNTHTRSRNISLLGAAISLALAGHVSAQTTETEQASNDDFENITVTARKRTESLFESPTAITSLSDSFMEDANISNLDDVGKYVPNLNVSRYGGGNSAHASIFIRGIGLQDHIITTDPGVGVYVDGVYLGRQMGANLSLPNIASVEVLRGPQGTLYGRNTLGGAVNIITKKPGDESMASVAAKVGTLGRVAADLYINGDINDDVSIAASGSFKKRDGVGKAVNLANPEKEIGEEQEFSGRLSANWNVSNSFSLLFAVDGYDNESGQSPYTIEFTDPSPDPTDVFNGDFPLLTPDLIPSDPDDLGTTVPGLESTASAGWGASITANWDINENYATKLITSFRSSDYEGGLDDDASPLNLSEFPETGEADQYSVELQVNGTFDNYDFVSGVYFFNEEGSTSSGPWVFSPFNTPGALNNDGTPTGFGGDYGFFDLHQETDAFAIYANASYDVSEKLTVGGGLRYSKDKKDADALFPSFAERAYRSAEFSEVTWDVNAAYQFDNGLNVYAQVQKGYQTGGFPPRPFGGSDQFVQFDETTSVNYETGLKGKVAENVSLLAAIFITKYDDLALPFSDPTAGGGFVTITENAGKSEAKGIELEATVDVTDNFSFRAAVGFLDAEITQVDENVNGVGVGDSPALTPEWTLMIAPSYYMDLDSGATLAFKADYSFRDEMQGQSVFNPNETIDSRSILGFDINYTSVNGDWSLSLYGENVTDEIYDQGRLQQNGFVGIVRSNDRREFGLRFKKEFEM

SEQ ID NO: 13219 - protein, 1290 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNNFPHKEYDLYKSLLSSKIDGGWDWGNAARHYWVKGGQWNKLEVDMKDAVGTYKLSGLINFTGGDLDVNMQKATLRLGQFNGNSFTSYKDSADRTTRVDFNAKNILIDNFLEINNRVGSGAGRKASSTVLTLQASEGITSSKNAEISLYDGATLNLASSSVKLMGNVWMGRLQYVGAYLAPSYSTINTSKVTGEVNFNHLTVGDHNAAQAGIIASNKTHIGTLDLWQSAGLNIIAPPEGGYKDKPKDKPSNTTQNNANNNQQNSAQNNNNTQVINPPNSAQKTEIQPTQVINGPFAGGKDTVVNINRINTNADGTIRVGGYKASLTTNAAHLHIGKGGINLSNQASGRSLLVENLTGNITVDGPLRVNNQVGGYALAGSNANFEFKAGTDTKNGTATFNNDISLGRFVNLKVDAHTANFKGIDTGNGGFNTLDFSGVTDKVNINKLITASTNVAIKNFNINELLVKTNGVSVGEYTHFSEDIGSQSRINTVRLETGTRSIFSGGVKFKSGEKLVIDEFYYSPWNYFDARNIKNVEITRKFASSTPENPWGTSKLMFNNLTLGQNAVMDYSQFSNLTIQGDFINNQGTINYLVRGGKVATLNVGNAAAMMFNNDIDSATGFYKPLIKINSAQDLIKNTEHVLLKAKIIGYGNVSTGTNGISNVNLEEQFKERLALYNNNNRMDTCVVRNTDDIKACGMAIGNQSMVNNPDNYKYLIGKAWKNIGISKTANGSKISVYYLGNSTPTENGGNTTNLPTNTTNNARSANYALVKNAPFAHSATPNLVAINQHDFGTIESVFELANRSKDIDTLYTHSGAKGRDLLQTLLIDSHDAGYARQMIDNTSTGEITKQLNAATTTLNNIASLEHKTSSLQTLSLSNAMILNSRLVNLSRKHTNNIDSFAKRLQALKDQRFASLESAAEVLYQFAPKYEKPTNVWANAIGGASLNNGSNASLYGTSAGVDAYLNGQVEAIVGGFGSYGYSSFSNRANSLNSGANNTNFGVYSRIFANQHEFDFEAQGALGSDQSSLNFKSALLQDLNQSYNYLAYSAATRASYGYDFAFFKNALVLKPSVGVSYNHLGSTNFKSNSTNKVALSNGSSSQHLFNASANVEARYYYGDTSYFYMNAGVLQEFANFGSSNAVSLNTFKVNAARNPLNTHARVMMGGELQLAKEVFLNLGFVYLHNLISNIGHFASNLGMRYSF

SEQ ID NO: 13220 - protein, 318 aa, Campylobacter coli
MKKLLLAVAVSTVAAGSVNAATVYEKDGFTYKLNGDFQIQFRQATGFDERAEVEYDDLELKNYVAYDLGNDLTAFGRLDFGFKDAAEKGENGSNLEEAFVGLKYGVASVSFGKQNFAGDEFGIEEAYEVADINEDRFDAVGTDGDDTIRIDVELENVYIAASHEMKTSDDNSGDDISGEYYDLFAATELAGLELAAAYQQAKEFGAADTKNTWGLSASYDFGFMNLAADYSMTDDKENDADIAQYNVAAVFAVASTTDVAVGMGNVDDDNKADDVTEWYANVTYKFPQAKNVSVFAEIADSDVDEHDMGMLAGMRVKF

SEQ ID NO: 13221 - protein, 244 aa, Neisseria meningitidis
AAQAASEDGSRSPYYVQADLAYAAERITHNYPEPTGADKDKISTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRLGLGVIAGVGFDITPKLTLDTGYRYHNWGRLENTRFKTHEVSLGMRYHF

SEQ ID NO: 13222 - protein, 244 aa, Neisseria meningitidis
AAQAASEDGSRSPYYVQADLAYAAERITHNYPEPTGADKDKISTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRLGLGVIAGVGFDITPKLTLDTGYRYHNWGRLENTRFKTHEVSLGMRYRF

SEQ ID NO: 13223 - protein, 245 aa, Neisseria meningitidis
AAQAASEDGSRSPYYVQADLAYAAERITHDYPQATGANNTSTVSDYFRNIRAHSIHPRVSVGYDFGDWRIAADYASYRKWNDNKYSVNTKNVQVNKSNGNRQDLKTENQENGSFHASSSLGLSAIYDFKLNDKFDKFKPYIGVRVAYGHVKHQVHSVKKETTTTFLAPTGDAKVPGKIVEGPFSKPAYHESHSISSLGLGVIAGVGFDITPKLTLDTGYRYHNWGRLENTRFKTHEVSLGMRYHF

SEQ ID NO: 13224 - protein, 244 aa, Neisseria meningitidis
AAQAASEDSGRSPYYVQADLAYAAERITHDYPQATGANNTSTVSDYFRNIRAHSIHPRVSVGYDFGGWRIAADYASYRKWNNNKYSVNTKEVERNNTSGNWKELKTENQENGTFHASSSLGLSAIYDFKLNDKFDKFKPYIGVRVAYGHVKHQVHSVRKETTTAFLKPSKGATEPGKIPSLVTKPAYHESHSTSSLGLGVIAGVGFDITPKLTLDTGYRYHNWGRLENTRFKTHEVSLGMRYHF

SEQ ID NO: 13225 - protein, 243 aa, Neisseria meningitidis
AAQAASEDSSRSPYYVQADLAYAAERITHDYPKATGANNTSTVSDYFRNIRAHSIHPRVSVGYDFGGWRIAADYASYRKWNNNKYSVNTKELENKHNNKKDLKTENQENGTFHAASSLGLSAIYDFKLNDKFDKFKPYIGVRVAYGHVKHQVHSVESKTTIVTSKPTKGATQPGKLVSGPTPKPAYHESNSISSLGLGVIAGVGFDITPKLTLDTGYRYHNWGRLENTRFKTHEASLGVRYRF

SEQ ID NO: 13226 - protein, 245 aa, Neisseria meningitidis
AAQAASEDGSRSPYYVQADLAYAAERITHDYPQATGANNTSTVSDYFRNIRTHSIHPRVSVGYDFGDWRIAADYASYRKWNDNKYSVNTKNVQVNKSNGNRQDLKTENQENGTFHAVSSLGLSAIYDFKLNDKFDKFKPYIGVRVAYGHVKHQVHSVESKTTIVTSKPTKGATQPGKLVSGPTPKPAYHESNSISSLGLGVIAGVGFDITPKLTLDTGYRYHNWGRLENTRFKTHEASLGVRYRF

SEQ ID NO: 13227 - protein, 234 aa, Neisseria meningitidis
AAQAASEDGSRSPYYVQADLAYAAERITHDYPKATGANNTSTVSDYFRNIRAHSIHPRVSVGYDFGDWRIAADYASYRKWKESNSSTNTENSETQQNRIKIETGHQGNGSFHAASSLGLSAIYDFKLNDKFKPYIGARVAYGYVKHQVQSVESKTKTVTSKPNGGPVKEGPTPKPAYHESNSISSLGLGVIAGVGFDITPKLTLDTGYRYHNWGRLENTRFKTHEVSLGVRYHF

SEQ ID NO: 13228 - protein, 241 aa, Neisseria meningitidis
AAQAASEDGSRSPYYVQANLAYAAERITHDYPQATGANNTSTVSDYFRNIRTHSIHPRVSVGYDFGDWRIAADYASYRKWNDNKYSVNTKNVQVNKSNGNRQDLKTENQENGTFHAVSSLGLSAVYDFNTGSRFKPYAGVRVAYGHVRHSIDSTKKTTNVLTVPTNIPGGTPTIYNQGSTQDAYHESHSIRRLGLGVVAGVGFDITPKLTLDTGYRYHNWGRLENTRFKTHEVSLGVRYRF

SEQ ID NO: 13229 - protein, 234 aa, Neisseria meningitidis
AAQAASEDGSRSPYYVQADLAYAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSVGLGVIAGVGFDITPKLTLDTGYRYHNWGRLENTRFKTHEVSLGMRYHF

SEQ ID NO: 13230 - protein, 234 aa, Neisseria meningitidis
AAQAASEDGSRSPYYVQADLAYAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLSDKFKPYIGVRVAYGHVKHQVHSVESKTTTVTTNNGGPVPQGPTPKPAYHESHSISSVGLGVIAGVGFDITPKLTLDTGYRYHNWGRLENTRFKTHEVSLGMRYHF

SEQ ID NO: 13231 - protein, 234 aa, Neisseria meningitidis
AAQAASEDGSRSPYYVQADLAYAAERITHDYPQATGANNTSTVSDYFRNIRTHSIHPRVSVGYDFGDWRIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSVGLGVIAGVGFDITPKLTLDTGYRYHNWGRLENTRFKTHEVSLGMRYHF

SEQ ID NO: 13232 - protein, 241 aa, Neisseria meningitidis
AAQAASEDGSRSPYYVQADLAYAAERITHDYPKASGANNTSTVSDYFRNIRAHSIHPRVSVGYDFGDWRIAADYASYRKWNDNKYSVNTKNVQVNKSNGNRQDLKTENQENGTFHAVSSLGLSAVYDFNTGSRFKPYAGVRVAYGHVRHSIDSTKKTTNVLTVPTNIPGGTPTIYNQGSTQDAYHESHSIRRLGLGVVAGVGFDITPKLTLDTGYRYHNWGRLENTRFKTHEVSLGVRYRF

SEQ ID NO: 13233 - protein, 245 aa, Neisseria meningitidis
AAQAASEDGSRSPYYVQADLAYAAERITHDYPKASGANNTSTVSDYFRNIRAHSIHPRVSVGYDFGDWRIAADYASYRKWNNNKYSVNTKEVRRNNNAGNWRELKTENQENGSFHASSSLGLSAIYDFKLNDKFDKFKPYIGVRVAYGHVKHQVHSVKKETTTTFLAPTGDAKVPGKIVEGPFSKPAYHESHSISSLGLGVIAGVGFDITPKLTLDTGYRYHNWGRLENTRFKTHEVSLGMRYHF

SEQ ID NO: 13234 - protein, 244 aa, Neisseria meningitidis
AAQAASEDGSRSPYYVQADLAYAAERITHDYPQATGANNTSTVSDYFRNIRAHSIHPRVSVGYDFGDWRIAADYASYRKWNNNKYSVNTKEVLRHSNGNWQELKTENQENGSFHATSSLGLSAIYDFKLNDKFDKFKPYIGVRVAYGHVKHQVHSVESKTTIVTSKPTKGATQPGKLVSGPTPKPAYHESNSISSLGLGVIAGVGFDITPKLTLDTGYRYHNWGRLENTRFKTHEASLGVRYRF

SEQ ID NO: 13235 - protein, 239 aa, Neisseria meningitidis
AAQAASEDSGHGPYYVQADLAYAAERITHDYPKATGANNTSTVSDYFRNIRAHSIHPRVSVGYDFGDWRIAADYASYRKWNNNKYSVNTKELENKHNNKKDLKTENQENGTFHAASSLGLSAIYDFKLNDKFKPYIGARVAYGHVRHSIDSTKKTTEVVTSTHGGADTKPTIYNGESTQNAYHESHSIRRLGLGVVAGVGFDITPKLTLDTGYRYHNWGRLENTRFKTHEVSLGMRYHF

SEQ ID NO: 13236 - protein, 242 aa, Neisseria meningitidis
AAQAASEDGSRSPYYVQADLAYAAERITHDYPKASGANTVSDYFRNIRAHSIHPRVSVGYDFGDWRIAADYASYRKWNNNKYSVNTKEVRRNNNAGNWRELKTENQENGSFHASSSLGLSAIYDFKLNDKFDKFKPYIGVRVAYGHVKHQVHSVKKETTTTFLAPTGDAKVPGKIVEGPFSKPAYHESHSISSLGLGVIAGVGFDITPKLTLDTGYRYHNWGRLENTRFKTHEVSLGMRYHF

SEQ ID NO: 13237 - protein, 250 aa, Campylobacter coli
MKKICLLATLVLSQNVFADDIVQWWDVSATVLHGENYDLAPSERQTTITLETAGGWKYGDWFAFQDFINFNGNNNGVDSTTYGEISPRFSASKILGQQVSFGAIKDVSLALTYEEGEGPVNSMLYGIGVDLDVPFFSYLQLNTYRRDAISSGNISDGWQFTPVFRIDMPVGNANIIFDGFIDWVFSADNNGYDENLHINPQIKYDLGKTLFGDHKQNKLLVGFEYDYWQSKYGVAGIDQNTYSIIAQYHF

SEQ ID NO: 13238 - protein, 156 aa, Vibrio cholerae
SFFSGSVEAGYHWRRGAWALTPYVGVDQTQLKTDGFREQGGAGFGLQVQASQAIRSQLLAGVRTELGWRGVKLRGYGEWQQTLRQSGLNPQASFTATSSWTPLVASPWSSRSGGLLGLSMVWPVGMTAGEWSMGVEHFFGARKRSDSLGLRYQLSF

SEQ ID NO: 13239 - protein, 242 aa, Neisseria meningitidis
AAQAASEDGSRSPYYVQADLAYAAERITHDYPQATGANNTSTVSDYFRNIRTHSIHPRVSVGYDFGDWRIAADYASYRKWNDNKYSVNTKNVQVNKSNGNRQDLKTENQENGTFHAVSSLGLSAIYDFKLNDKFKPYIGVRVAYGHVKHQVHSVESKTTIVTSKPTKGATQPGKLVSGPTPKPAYHESNSISSLGLGVIAGVGFDITPKLTLDTGYRYHNWGRLENTRFKTHEVSLGMRYHF

SEQ ID NO: 13240 - protein, 243 aa, Neisseria meningitidis
AAQAASEDGSRSPYYVQADLAYAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLNDKFDKFKPYIGVRVAYGHVKHQVHSVESKTTIVTSKPTKGATQPGKLVSGPTPKPAYHESNSISSLGLGVIAGVGFDITPKLTLDTGYRYHNWGRLENTRFKTHEASLGVRYHF

SEQ ID NO: 13241 - protein, 348 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDDQAYSMPSLFVEKLQVHRLVGGYDNNALYVSVAAQQQDAKLYGATRVNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 13242 - protein, 362 aa, Bartonella henselae
MNIKSLLLGSAAALVAASGAQAADAIVAPEPEAVEYVRVCDAYGAGYFYIPGTETCLRVHGYVRYDVKGGDDVYTGSDRKGWDKSARFALRVSTGSETELGTLKTFTELRFNYAANNSGVDGKYGNETSSGTVMEFAYIQLGGLRVGIDESEFHTFTGYLGDVINDDVISAGSYRTGKISYTFTGGNGFSAVIALEQGGDNDGGYTGTTNYHIDGYMPDVVGGLKYAGGWGSIAGVVAYDSVIEEWAAKVRGDVNITDQFSVWLQGAYSSAATPDQNYGQWGGDWAVWGGLKYQATQKAAFNLQAAHDDWGKTAVTANVAYELVPGFTVTPEVSYTKFGGEWKNTVAEDNAWGGIVRFQRSF

SEQ ID NO: 13243 - protein, 425 aa, Pseudomonas aeruginosa
MLKKRICLLALGIATASQAMANDQEAAKGFVEDSHLDLFFRNGYISRDYKHGRQDKAEWGQAATATFTSGFTQGTVGVGVDAFGLYAVRLDGGKGRSGAAGIDFFKQGDSGSAADDLSKGGAAVKFRISNTVLKYGDQMPSLPVLSYDNSRLLPESYSGTLITSKEIEGLELNAGRFTAESRKSAEGRDSGGLKSINVFGGKYAFTDHFNASLYASDVEDVLKKQYINLNYTIPLQADQSLNFDFNGYRTKLDSDFADQNFNGNRDNKIWSLAASYTIDAHTFMIAHQRNTGDTGYNYGWYQNAGGIGDGGTTIWLANSYWSDFNAEDERSWQVSYALDFAKYGVPGLTYRVAYVRGDNIKTAETSNGKEREIFNQVQYVVQSGPAKDLTLRLRSSFLRVSNDARSYNDDGNEIRAFVEYPFSVF

SEQ ID NO: 13244 - protein, 167 aa, Acinetobacter sp.
NSAFSDPVGPIADEETSYYIRLQYNSEFSPLNTKVDGITGAQKDSKDTNDLYKPSFMAGGSAFGYRMDDIRVDIEGLYSQLSKSTLSRAPTPDIVDNLTAISGLVNVYYDVVIEDIPITPYVGVGLGVAYISNPAKAQVIADQKHGFGFAYQAKAGISYDVTPEIKL

SEQ ID NO: 13245 - protein, 427 aa, Acinetobacter sp.
MKKTSLWVGGCLCLLFTPVVHAEFIADSKAELTLRNFYFDRDYKQDPYPYTAARDWAQGVIFKGQSGYTDGPVGFGVDVLAMAGFNLMGNRADDYARSGLLPVNSDNSRDDYYGKVGITGKAKYRNNELFVGDLVPLLPTIFSSPARLFPQTYRGVRFLSTEIPKFQLEGFYVDEVRQRDSIRFTDVGTDNINRRFDRAATTDYFYTLGGAYQVNDAYRVRAYQAELHNIYQQQFLGFNGKQPLNQQLNFLSDVRFFNSEDAGTKKIGEVDNRHLSGLFGLNYQNHTISLGYMQSFGATGLPFLSGTESPVVLDFMSSDYSNKDEKVYSVRYEYEFKNVNVGDISLNGLRFMTRYAKGEDINLLNYGDQRFKEESMEVELGYRIPEGKFKGLGLRGRFSHYRNDMPTIMTFHSTNETRLNVDYTFKF

SEQ ID NO: 13246 - protein, 710 aa, Helicobacter pylori
MKKKFLSLTLGSLLVSALSAEDNGFFVSAGYQIGESAQMVKNTKGIQDLSDSYERLNNLLTNYSVLNTLIRQSADPNAINNARGNLNASAKNLINDKKNSPAYQAVLLALNAAAGLWQVMSYSISVCGPGSDKSKNGGVQTFENVPANGGTTITCDSFYEPGKWSAISTENYAKINKAYQIIQKAFGASGQDIPALSDTKELNFEIKGKKNDNAQPGERWKFPWTNGFVSIKWVNGAYTETKEDIKVSNNAQELLKQASTILTTLNEACPWLSNGGAGNVGGGNSLWAGIDKGDGSACGIFKNEISAIQDMIKNAEIAVEQSKIVAANAQNQHNLDTGKTFNPYKDANFAQSMFANARAQAEILNRAQAVVKDFERIPAAFVKDSLGVCHEKGSDGNLRGTPSGTVTSNTWGAGCAYVGETVTNLKNSIAHFGDQAEQIHNAQNLAYTLANFSNQYQKLGEHYDSITAAISSLPDAQSLQNVVSKKTNPNSPQGIQDNYYIDSNIHSQVQSRSQELGNNPFRRTGLIAASTTNNGAMNGIGFQVGYKQFFGKNKRWGARYYGFVDYNHTYNKSQFFNSDSDVWTYGVGSDLLVNFINDKATKHNKISFGAFGGIALAGTSWLNSQYVNLANVNNYYKAKINTSNFQFLFNLGLRTNLARNKRRGADHSAQHGMELGVKIPTINTNYYSLLGTTLQYRRLYSVYLNYVFAY

SEQ ID NO: 13247 - protein, 567 aa, Helicobacter pylori
MKKSFKKLGFFSLATSSVLLGSMNATDLQTYAALQKPSHVFGNYAEKDKDSKLTSDSLTQQQAQTQAQNTASSDSKEATTLENTAATDSQTATTDETYTKSTDATVADAAKQVETDNTAVQNDEKTLKTDVAKVQADASTKDFDETTFTKDQAAEQTAETNLQNAEEQLTNDQNALNTALKDQTPSTPSTPPATSGGASGSTVASQLTKDTTMVNNLKSVSVSAMNTTLSGVTQLSQQTATIGNLLNSSTDLSSVIPNAQGLSSAFSALESAQNTLKGYLNSSSATIGQLTNGSNAVVGALDKAINQVDMALADLSATDTQKTQAVALAAASDSATTTTDAINFLNALKNNLMAQKDAFMSVHKNIQTAVAQAQATYTPSVINTNNYGQMYGVDAMAGYKWFFGKTKRFGFRSYGYYSYNHANLSFVGSQLGIMEGASQVNNFTYGVGFDALYNFYESKEGYNTAGLFVGFGLGGDSFIVQGESYLKSQMQICNNTAGCSASMNTSYFQMPVEFGFRSNFSKHSGIEVGLKLPLFTNQFYKERGVDGSVDVFYKRNFSIYFNYMINF

SEQ ID NO: 13248 - protein, 253 aa, Helicobacter pylori
MKTLFSIYLFLSLNPLFLEAKEITWSQFLENFKNKNEDDKPKPLTLEKNNEKQKILDKNQQILKRALEKSLKFFFIFGYNYSQAAYSTTNQNLTLTANSIGFNTATGLEHFLRNHPKVGFRIFSVYNYFHSVSLSQPQTLMVQNYGGALDFSWIFVDKNIYRFRSYLGIALEQGVLLVDTIKPGAITTIIPRTKKTFFQAPLRFGFIVDFIGYLSLQLGIEMPLVRNVFYTYNNHQERFKPRFNANLSLIVSF

SEQ ID NO: 13249 - protein, 656 aa, Helicobacter pylori
MKKSVIGISIATSMLLAESFTLGQVSVFENIKDINLFEQSISSEVISQNSSDTVSEALDNISGVTQDTQGARTESTLHIRGFDAKRVGVFIDGIPVYVPYDGNFDYARFLTTDIASIDVSKGYSSVVYGGANMGGVVNIVSKKPTKEFEGSVKGKIVLDSDGKMARHVESLNAGSRQNNFYVQLGASYSKQDHFRLSDDYEASPTQPEGDRLRSEAEDKKVSLKAGYVADDGSEIAISYANQQGEKQQPPVTDTTFAKNKDWDWPYWDKETISITGQKNFNSSYVKALAYFDKSKNSIYSYDNATFSAITKNWAFKSRYDDYSYGARLEYGVELGDNFLKAAASYKKDVHRAYDKNKTTDVESLVERYEDNTISLGLEDVYSITSKLEFLAGVSYDRKEADEIYDTNTAYLNMLALEVEDSFAPQAALIYSLDESSKVKVSISRKTYMPTMKDRYSRKFNSYVPNVELKNEAATNYELSYLKKYDALTSRVNLFFTRVEDAIQSVVFASNPAYNQNKNVGTFEHRGVELELNYKTDTLEVGGNYTYISVKSRGDNGVEIIDVPKHQLFTFAQIEVAKYVSLYANMKFRDGAYENKLNGTYVTNPNFTTFDLKVIYEPTKAITAEIGVKNLTDELVRYDMAYPMAGREYFATMNYKF

SEQ ID NO: 13250 - protein, 486 aa, Helicobacter pylori
MKKTILLSLMVSSLLAENDGVFMSVGYQIGEAVQQVKNTGEIQKVSNAYENLNNLLTRYNELKQTASNTDSSTAQAIDNLKESASRLKTTPNNANQAVSSALSSAVGMWQVIASNLANNSLPTSEYDKINAISQSLQNTLENKNTANNNTTIDNDYDHLLTQASTIINTLQSQCPGIDGGNGKPWGINASGNACNIFGNTFNAITSMIDSAKKAAAEARRTSPESPNQQSAFTNADFNKNLNQVSGVINDTISYLKGDNLATIYNTLQKTPGSKGFQSLVSRSSYSYSLNETQYSEFQTTTKEFGHNPFRSVGLINSQSNNGAMNGVGVQLGYKQFFGKNKFFGIRYYGFFDYNYAYIKSNFFNSASNVFTYGAGSDLLLNFINGGSDKNRKISFGIFGGIALAGTTWLNNQSANLKITNSAYSAKINNTNFQFLFNTGLRLQGIHHGVELGVKIPTINTNYYSFMGAKLAYRRLYSVYFNYVLAY

SEQ ID NO: 13251 - protein, 476 aa, Helicobacter pylori
MKNHSFKKTIALSLLASMSLCRAEEDGAFFVIDYQTSLARQELKNPGFTQAQELKQLIRDGAVRLQTSAIPLSYYLDILGNKTKTLLSESLKNNAQPSQPNQALVNLEQSLGILGKLLDLSQQYANQGVIKPLVVDVGNKQIGITDSMLLVAQNIVLALGQVDLSKIQQNNNQQLYENIMKVMLLGAGGTNGAYNGVSVGDIATGMQNFSSQTGLIGANSTVSELNALIKSGISLDRETLGLGSFIEKNICSSASPCFTGSQLIYKKGLDRTINIINAVLGQFESSASSLYKISYIPNLFSLKDYQSASMNGFGAKMGYKQFFTHKKNIGLRYYGFLDYGYANFGDTNLKVGANLVTYGVGTDFLYNVYERSRRRERTTIGLFFGAQIAGQTWSTNVTNLLSGQRPDVKSSSFQFLFDLGVRTNFAKTNFNKHRLDQGIEFGVKIPVIAHKYFATQGSSASYMRNFSFYVGYSVGF

SEQ ID NO: 13252 - protein, 934 aa, Helicobacter pylori
MALACSLKRRKNARTALSLLFANTLLAGGVGMMFSSVTYAEAAASETHYYNIPSGPLSKAINAFAAVSGMYLGGNSELLKSKNTQGFVGEYSAGQALDLLLIGTGLSYEAGEGRSIVLIDTESVSEGENGITMSTLLVQGRQNKVEAGVQVIGSEEIEAMPTEGGNLTDLLRTNTAVNFSRSSSSSTGSGSMRPDEVSIYGQDYYQNAFMIDGIDTSNDFDPGSSAAGDSYTNPISNANLSTLSGSSPQSYYMDIDALEQVKVYSSNIPVEYGGFMGGVIDARLRRYDGEDEVFIKYGLSKSEWEKFHFDKRKAEEFYGADSVSGAYTPEYKKQNYSITALKRLSDNVGSTLTISRKTSEFRQQYENRSDEVKSIYYDDTIDNMMARIDAKVNDRVDLGFSFRYSNRFHDGLTSKDYADTFVKSHTAYGVGNNFEYRFDNSVLTVDTAYDRSFDELDSESNVYTYHPTENFYNGLPYSGGYGDILQQQDTLSINTKWVRDAIVLGRTQHTFTLGTDLAFKKAFYEAKGSEFYSYTCSLLPSSGTGESAGCLDSNSDDIHDEKDEYLKTYGVLSANKLNKNYQSHAVYLQDKVEINNWTVTAGIRADHETLLDNINISPRASLQWNVFGDSRTTITTGTSRYYGRSFLKYAINDEMQSWYTSTQYNSDGSIKKGPTANSGKFANFADYDLNTPYSDEIMFRIDQVMGPVDTSLTLVNRESHDGVQRVKSKENKLYYYTNEGRSSNNSIELAFQQRTPFEVFNTLTKANFSIGWQESKSNAQGDDGYEETVEDEERVYYNGEVIDFADLPSWDYNIPFTVKLSTTTNIPAWHLKWSNFVNVKSGGVIANRDTSSSYTDVDGNELQVYKDKKFDDLVTLDTKLRFSPPLWKDSEGYIELKVTNFFDQVMMITTSTSATAVQTFTSGRKISMEVGMRF

SEQ ID NO: 13253 - protein, 2906 aa, Helicobacter pylori
MKKFKKKPKSIKRSHQKTILKRPLWLAPLLLGGFASGVYADGTDILGLSWGEKSQKVCVHHPWYAVWSCDKWEEKTQQYTGNQLITKTWAGGNAANYYHSQNNQDITANLKNDNGTYFLSGLYNYTGGEYNGGNLDIELGSNATFNLGANSGNSFTSWYPNGHTNVTFSAGTINVNNSVEVGNRVGSGAGTHTGTATLNLNANKVNINSNINAYKTSQVNVGNANSTITIGSVSLSGDTCSSLASVGVGANCSTSGPSYSFKGTTNATNTTFSNASGSFTFEENATFSGAKWNGGTYTFNKEFKATNNTAFNSGSFNFKGASSFNGASFSNATYTFNDQATFQNSSFNGGTFNFNDQTNQSAQHPQIQNSSFSGGAITLKGFVNFQQAFNNSNHQLTIQNASFNNANFNNTGKITINESASFNNTTFNTSINTNNMSVTGSVTLSGKNDLNNGSTLDFGSSKITLTQGTTFNLTSLGSEKSVTILNSSGGITYSGLLNHAINGLTNVLKTNESSSNPQSFAQGLWDMITYDGVTGQLLSESAATSKNTDSSPPKSSTNSTQVYQVGYKIGDTIYKLQETFSHNSIIIQALESGTYTPPPVINGSKFDLSASNYINADMPWYDHKYYIPKSQNFTESGTYYLPSVQIWGSYTNSFKQTFSANGSNLVIGYNATWTGNSVSSSDTVSFGDTSGSALNGHCGPWPYYQCTGTTKGTYSAYHVYITANLRSGNRIGTGGAANLIFNGVDSINIANATITQHNAGIYSSSMTFSTQNMDNSQNLNGLNSNGKLSVYGATFTNQAKDGKFIFNAGQATFENTNFNGGSYQFSGDSLNFSNNNQFNSGSFEISAKNASFNNANFNNSASFNFNNSNATTSFVGDFTNANSNLQIAGNAVFGNSTNSDGSQNTANFNNTGSVNISGNATFDNVVFNSPTNTSVKGQVTLNNITLKNLNAPLSFGDGTIAFSAHSVINIGEAITNGNPITLVSSSKEIEYNNAFSKNLWQLINYQGHGASSEKLVSSVGNGVYDVVYSFNNQTYNFQEIFSPNSISIRRLGVGMVFDYVDMEKSDHLYYKDVVGFMTYMPNSYNNNLGNANNTIYYYDNSIDFYASGKTLFTKAEFSQKFTGQNSAIVFGAKNIWTNASDAPQSNAIIRFGDNKGAGSNDASGHCWNLQCIGFITGHYEAQKIYITGSIESGNRISSGGGASLNFNGLQGILLTNATLYNRAAGTQSSSMNFVSNSANIQAQNSYFIDDTAQNGGNPNFSFNALNLDFSNSSFRGYVGQTQSVFKFNAVNAISFTNSTNLSSGLYQMQANSVSFDNSNLSVSVGTSSIKANAINLSQNASINASNHSTLELQGDLNVNDTSSLNLNQSTINVSNNATINDYASLIASNGSHLNFNGAVHFNSANITTSLNNSSIVFKGASSLGGQFNLSNNSSLDFQGSSAITSNTAFNFYDNAFSQSPITFHQTLDIKAPLSLGGNLLNPNSSSVLNLKNSQLVFGDQGSLNIANIDLLSDLNDNKNRVYNIIQADMNSNWYERISFFGMRINDGIYDAKNQTYSFTNPLNNALKITESFKDNQLSVTLSQIPGIKNTLYNIGSEIFNYQKVYNNANGVYSYSDDAEGVFYLTSNVKSYYNPNQSYQANGSNNTTKNNNLSSESSVISQTYNAQGNPISALHVYNKGYDFNNIKALGQMVLKLYPEIKKILGNDFSLSSLSDLKGDALNQLTKLITPSDWKNINELIDNASNSVVQNFNNGALIIGATKIGQTDTNSAVVFGGLGYQTPCDYTDIVCQKFRGTYLGQLLESSSADLGYIDTTFNAKEIYLTGTLGSGNAWGTGGSASVTFNSQTSLILNQANIVSSQTDGIFSMLGQEGINKVFNQAGLANILGEVAMQSINKAGGLGNLIVNTLGSGSVIGGYLTPEQKNQTLSQLLGQNNFDNLMNDSGLNTAIKDLIRQKLGFWTGLVGGLAGLGGIDLQNPEKLIGSMSINDLLSKKGLLNQITGFISANDIGQVISVMLQDIVKPSNALKNDVVALGKQMIGEFLGQDTLNSLESLLQNQQIKSVLDKVLAAKGLGSIYEQGLGDLIPNLGKKGLFAPYGLSQVWQKGDFSFNAQGNVFVQNSTFSNANGGTLSFNAGNSLIFAGNNHIAFTNHFGTLQLLSNQVSNINITTLDASNGLKINAGSNNISVSQGDLFINASCVQQSTPTAANATNPCTLSTQSANGASSSNASNNAPIALNNNDESLMVTANDFNFSGNIYANGVVDFSKIKGSANVKNLYLYNNAQFQSNNLIISNQAVLEKNASFTANNLNIQGAFNNNATQKIEVLQNLVIASNASLSTGIYGLEVGGALNNLGTIHFNLENSQTPVNPLIQAEGIINLNTTQTPFINVNNSMANNTTYTLLKSSRYIDYNINPNSLQSYLKLYTLININGNHIEEKNGVLTYLGQRVLLQDKGLLLSVVLPDSNNAHQNNILSLSVLYNQIKMSYGDKAMDFTPPTLQDYIVGIQGQSALNQIEAVGGNAIKWLSTLMMETKENPLFAPIYLKSHSLNEILGVTKDLLNTASLISNPNFRNNATNLLELASYTQQTSRLTKLSDFRSREGESDFSERLLELKNKRFSDPNPGEVFVKYSQLSKHPNNLWAQGIGGASFIAGGNGTLYGLNAGYDRLVKNVILGGYVAYGYSDFNGNIMRSLANNVDVGMYARAFLKRNEFTLSANETYGGNANNINSSNPLLSVLNQRYNYNTWTTSVNGNYGYDFMFKQKSVVLKPQVGLSYHFIGLSGMKGKMNDAAYKQFLMHSNPSNESVLTLNMGLESRKYFGQNSYYFVTARLGRDLLIKSKGGNMVRFVGENTLLYRKGEVFNTFASVITGGEIHLWRLMYVNAGVGLKMGLQYQDINITGNVGMRVAF

SEQ ID NO: 13254 - protein, 733 aa, Helicobacter pylori
MKKHILSLALGSLLVSTLSAEDDGFYTSVGYQIGEAAQMVTNTKGIQQLSDNYENLNNLLTRYSTLNTLIKLSADPSAINAVRENLGASAKNLIGDKANSPAYQAVLLAINAAVGFWNVVGYVTQCGGNANGQESTSSTTIFNNEPGYRSTSITCSLNGHKPGYYGPMSIENFKKLNEAYQILQTALKNGLPALKENNGKVSVTYTYTCSGQGNNNCSPSVNGTKTTTQTIDGKSVTTTISSKVVGSIASGNTSHVITNKLDGVPDSAQALLAQASTLINTINEACPYFHATNSSEANAPKFSTTTGKICGAFSEEISAIQKMITDAQELVNQTSVINSNEQSTPVGNNNGKPFNPFTDASFAQGMLANASAQAKMLNLAHQVGQAINPENLSENFKNFVTGFLATCNNKSTAGTGGTQGSAPGTVTTQTFASGCAYVEQTLTNLGNSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVNSQTNNGAMNGIGIQVGYKQFFGQKRKWGARYYGFFDYNHAFIKSSFFNSASDVWTYGFGADALYNFINDKATNFLGKNNKLSLGLFGGIALAGTSWLNSEYVNLATVNNVYNAKMNVANFQFLFNMGVRMNLARSKKKGSDHAAQHGIELGLKIPTINTNYYSFMGAELKYRRLYSVYLNYVFAY

SEQ ID NO: 13255 - protein, 262 aa, Helicobacter pylori
MKLNKILSFFTLTSIALSSSAFAANWSSTALHINNGDQKNPFTEQESDTTVYSVQHASGYDYGDNFFFIDYSKDDKADGYQDSDFYGEWYSTVSLSALSGEKIGTGALLDVGLTGGINIAGDAKMVKYLPGVKLNWDVPGFNFFQTIVTAYIDDSEGVAKGGAPIETNSWMFDVAFEYPFTIGSQKFSFKGHAEYIAEREDEFGNDVEAWILAQPILVWDMGHAFEMKENTLLLGMELQYWHNKLGTEVTESVPQIHVEWTF

SEQ ID NO: 13256 - protein, 698 aa, Helicobacter pylori
MLRFVSKTICLSLIGLFNPLEAFQKHQKDGFFIEAGFETGLLEGTQTKEEATAQNIPKIYKNPLTHPQSKEQNKSDTATPQSVYGRYYILQSTILEKATELFTTDNIENGLTFYSQNPVYANMVNGNVTIQNFLPYNLNNVELSFKDAQGKVVNLGVIETIPKDSQIILPASLFNDSEFEQADSFNYQQLQATATQFSDANTQSLFEKISQITTNVTMSYENADTNNFKGNCHDCVSDFTPQTAEELTNLMLDMIAVFDSKSWEEAVLNAPFQFSNSPSECGSDFPKCVNPFNNGRVAPIYEKYVLTPQSVIDAFRRTINLEVNILKSGFVGLGYELDDNDGNLGIAASALNPEKLFGKTLNKVDIVELRDIIHEFSHTKGYTHNGNMTYQRVRLCQENGGAIQECEGGKEELVNGKEELKFTNGKEVKDQDGYTYNVCSFYKDNHQVYTAGNYPNSIYTNCAQVPAGLIGVTTAVWQQLINQNALPINFANLNSPTSHLNAGLNAQNFATSMVNAIAQNFSTTSTTTYRSSNKNFRSPILGVNVKIGYQHYFNDYIGLAYYGIIKYNYAQANDEKIQQLSYGGGMDVLFDFITTYTNKKQNNPTKKVFASSFGVFGGLRGLYNSYYVFNQVKGSGNLDIVTGFNYRYKHSKYSVGISVPLIQSNIQIASSNGIYANSVVLNEGGSHFKVFFNYGWIF

SEQ ID NO: 13257 - protein, 237 aa, Helicobacter pylori
MQKALITLATASLISIPAQAEQFWSDTSISILNGDDYEFTDEDITTMTLEHVSGHSWGSLFFFQDRHKGGSYSESYGEFSPAYTLTKLSDDGFFKDINAAFTYEFGTTQGGQSLDNYLFGIGSNLNVPGLDFASATVYMANNEEYYGNSKDYQLTLVFGYSQGNFAIDGFMDYAFNSDNDSTEDSMNFTPQITYNIGPMLGTQNKVKVGVEYSYWTNQFGTDGQDQNAVSLLLKAHL

SEQ ID NO: 13258 - protein, 362 aa, Helicobacter pylori
MVGIVGLHAHAAWSQSAVTLYGVIDEAIRYDNHQTRDGGHNITMGTGGALLGSRWGLRGTEDLGGGSKAIFVLESGFVANTGALAFSTPGGQQRLFGRQAFVGFSHQGLGTVTFGRQYALAYLMGSAHDVFGFANYAATWGFQSAGLVGGARLDNTVQYTSDKLFGFTVSGAYTFGGVAGDIHRYSSPAVSLSYDVGPLNIGAVYQQVNNIGGATPASTQYGNTYFGIAIPDSSQKIAMVGATYALAQAKIYAQYIFSHVYPADYRNDSFSVGASYLFTPSIELRGAAYVDILHHADGEGTRVTAGPILLYHLSKRTDLYSGVNYNHLTGQWTKLASTSGFTQSFNGYNSLFEGVVGMIHRF

SEQ ID NO: 13259 - protein, 917 aa, Helicobacter pylori
MQFSTPLSAITLAIVAAGFSANVLAVGKLEGQVRDKNSQQPLAGASVTIKELNLSQQAGRDGRYFFVGINDGDYTLVVNYLGATPMEHKVLIADKQTTQLDVSLSSKDVEHIMVVGQQGALSKSMNRQRGADNVLNVVSADVLGNFPDSNISESLQRVPGLSIERDQGEGRFVRVRGMAPDYNSVSMNGTRLPSPESDRRAVALDVVPSDLLQSVEVSKTLTPDMDADALGGAIEVKSLSAFDREDTYVNLSAEASQDSLTDNTNPKLAASYSDVIGEKLGIAIGASWYNRDFGSDNVETGGNWDFTDDTGYGNAALESVDHRDYEINRERLGIGVNFDYRPSDDTDLYLRTLYSEFDDTETRNSAKTKWKSPLQAGELSQGKTTRSLKSRSENQNITSYVLGGETRFERWTLDYQASHSTASADKPRDIAGADFVAKIDETGFSDSQQPQIIAPESYYQTDNFELDEIEIAESKAKDTINSAQFDLSRQLSLGDYPAEVKTGVKLSRRDKTNREEVWIYSDFADQGVSDDALLLSQYSGNEVDYSLGRFGTGINASPVWDLVDSLDANSNRDEIESTINDFDITEDVNAAYLMGHLDIGKLRILTGLRFEQNKWDSQGYGFDGVSGEFTDINNTSDEDHWLPGLHLTYRYSDNTVLRGAWTNTLVRPTFGQLAPGYLREEDDGDIDLTFGNPNLKSLESMNLDLSIEHYFGNIGLVSAGLFYKDIDNFIYKADLAGRGDYVDAHSAVTYINGNSAHISGIELSYVQEFSFLPEPFNGLVLNSNLTYTDSVASISWLDDGTENSRDIPMPSQSDITANLSLGYENTYASVWLSAAYKSEYLQEVSELDDERLDLYEDAHLQWDFVAKAHITTSLTLYFKGVNLTDEPYYSYAGHSDYNAQYEAYGRTFQLGLQYTNY

SEQ ID NO: 13260 - protein, 307 aa, Helicobacter pylori
MKKALLLTLSLSFWLHAERNGFYLGLNFLEGSYIKGQGSIGKKASAENALNEAINNAKNSLFPEQNTKAIRDAQNALNAVKDSNKIANRFAGNGGSGGLFNELSFGYKYFLGKKRIIGFRHSLFFGYQLGGVGSVPGSGLIAFLPYGFNTDLLINWTNDKRASQKYVERRVKGLSIFYKDMTGRTLDANTLKKASRHVFRKSSGLVIGMELGGSTWFASNNLTPFNQVKSRTIFQLQGKFGVRWNNDEYDIDRYGNEIYLGGSSVELGVKVPAFKVNYYSDDYGDKLDYKRVVSVYLNYTYNFKNKH

SEQ ID NO: 13261 - protein, 270 aa, Helicobacter pylori
MKKFVVFKTLCLSVVLGNSLVAAEGSTEVQKQLEKPKDYKAVKGEKNAWYLGISYQVGQASQSVKNPPKSSEFNYPKFPVGKTDYLAVMQGLGLTVGYKQFFGEKRWFGARYYGFMDYGHAVFGANALTSDNGGVCKLNEPCATKVGTMGNLSDMFTYGVGIDTLYNVINKEDASFGFFFGAQIAGNSWGNTTGAFLETKSPYKHTSYSLDPAIFQFLFNLGIRTHIGQHQEFDFGVKIPTINVYYFNHGNLSFTYRRQYSLYVGYRYNF

SEQ ID NO: 13262 - protein, 767 aa, Helicobacter pylori
MKRILVSLAVLSHGVHAVETHNLERVEASGRANNEEAPLSWRSKEVRNYMGSRTVISNKQLTEGANQSIEEALQNVPGVHIRNATGIGAVPSFSVRGFGGGSSGHSNTGMILVNGIPVYVAPYVDIGMPIFPVTFQSVDRISVTKGGESVRYGPNVFGGVINVITKGIPTKWDSQASERATFWGKSENGGFFNQNSKNLDKSLANNMLFDTYLKTGGMMNKHFGIQAQANWIKGQGFRYNSPTNIQNYILDSLYQINDSNKITAFFQYYNYFMADPGSLGIAAYNQNRFQNNRPNNNKSGRAKRWGAVYQNFFGDTDKIGGDFTFSYYGHDMSRDFQFDSNFLNVNTNPKLGPVYTDQNYPGFFIFDHLRRYIMNAFEPNLNLVVNTNKVKQTFNVGMRFMTMDMYFRLDQSTCEKANIIDGVCHMPPFVLSKTPTNNQEMFNNYTAVWLSDKIELFNSKLVLTPGLRYTFLNYNNREPEKDDFSVWKTTKQRQNEWSPAFSIGYKPVENWIWYANYRRSFIPPQHKMVGIFRTNYNQIFNEIEVGQRYSYKNLLSFNTNYFVIFANRYYAGGYSPQPINARSQGVELELYYAPIRGLQFHVAYTYIDARITSNADDITYYFTGIVNKPFDIKGKRLPYVSPNQFIFDMMYTYKYTTFGISSYFYSRAYSSMLNQAKSQTVCLPLNPKYTGGLEYGCNSVGLLPWYFVLNVQVSSVLWQSGRHKITGSLQINNLFNMKYYFRGIGTSPTGREPAPGRSVTAYLNYEF

SEQ ID NO: 13263 - protein, 273 aa, Helicobacter pylori
MEFMKKFVALGLLSAVLSSSLLAEGDGVYIGTNYQLGQARLNSNIYNTGDCTGSVVGCPPGLTANKHNPGGTNINWHAKYANGALNGLGLNVGYKKFFQFKSFDMTSKWFGFRVYGLFDYGHATLGKQVYAPNKIQLDMVSWGVGSDLLADIIDKDNASFGIFGGVAIGGNTWKSSAANYWKEQIIEAKGPDVCTPTYCNPNAPYSTKTSTVAFQVWLNFGVRANIYKHNGVEFGVRVPLLINKFLSAGPNATNLYYHLKRDYSLYLGYNYTF

SEQ ID NO: 13264 - protein, 662 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLSNVKLSFTDAQGNVIDLGVIETIPKHSKIVLPGEAFDSLKEAFDKINPYTFFFPKFEATSTSVSDANTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDSKVDQQYVLNKQGIVNNFRKKIEIDAVVLKNSGVVGLANGYGNDGEYGTLGVEAYALEPQKLFGNNLKTINLEDLRTILHEFSHTKGYTHNGNMTYQRVPTGQNENDKPKDSDGLPYNVCSLYGGSNQSAFPSNYPNSIYHNCADVPAGFLGVTAAVWQQLINQNALPINFANLGSQTNYNLNASLNTQDLANSMLGTIQKTFVTSSVTNHYSSSASQSFRSPILGVNAKIGYQNYFNDFIGLAYYGIVKYNYSKALNQKFQQLSYGGGIDLLLDFITTYSNKNNPTGVQTKRNFSSSFGIFGGLRGLYNSYYVLNKVKGSGNLDVATGLNYRYKHSKYSVGISIPLIQRKASVISSGSDYTNSFVFNEGASHFKVFFNYGWVF

SEQ ID NO: 13265 - protein, 305 aa, Helicobacter pylori
MGRIESKKRLKALVFLASLGVLWGNAAEKTPFFKTKNHIYLGFRLGTGANVSTSMWQQAYKDNPTCHSSVCYGEKLEAHYKGGKNLSYTGQIGDEIAFDKYHILGLRVWGDIEYAKAQLGQKVGGNTLLSQANYNPSAIKTYDSASNTQGSLNLQKTPNPQDFLFNNGHFMAFGLNVNVFVNLPIDTLLKLALKTEKMLFFKIGVFGGGGVEYAILWSSQYKNQNTNQDDKFFAAGGGFFVNFGGSLYIGKRNRFNVGLKIPYYSLSAQSWRNFGSSNVWQQQTIRQNFSVFRNKEVFVSYAFLF

SEQ ID NO: 13266 - protein, 278 aa, Helicobacter pylori
MNKLLKKGFLAFFLSVYLRADDLVTYTITKEEDLGYQRFLAKKCLRGKTHSPCFTEPKKPNKKLFNIDKSSHYYGTSVVQMSWLQSREKFENHSKYRDIPFAEVSLIYGYKQFFPKKERYGFRFYISLDYAYGFFLKNKGVLGDSLRESSQIPKSYREKLQRKETFINAIFYGVGADFLYKRAFGTLILGMNLVGETWFYETRIFKKWAKDPSSVYHPYMFQVMLNVGYRYRFSRYKNWAIELGARIPFLTNDYFKTPLYTLHFRRNISVYLTSTYDF

SEQ ID NO: 13267 - protein, 792 aa, Helicobacter pylori
MNGYLRVKTPYFLASVVLTFWTFNSFMSAKDKHHFLKKVTTTEQKFSSSAPISWQSEEVRNSTSSRTVISNKELKKTGNLNIENALQNVPGIQIRDATGTGVLPKISVRGFGGGGNGHSNTNMILVNGIPIYGAPYSNIELAIFPVTFQSVDRIDVIKGGTSVQYGPNTFGGVVNVITKEIPKEWENQAAERITFWGRSSNGNFVDPKEKGKPLAQTLGNQMLFNTYGRTAGMLGKYIGISAQGNWINGQGFRQNSPTKVQNYLLDAIYKINATNTFKAYYQYYQYNSYHPGTLSAQDYAYNRFINERPDNQDGGRAKRFGIVYQNYFGDPDRKVGGDFKFTYFTHDMSRDFGFSNQYQSVYMSGQNKILPFKGKGEISAKNPNCGLYSYSDTNSPCWQFFDNIRRSVVNAFEPKLNLIVNTGKVKQTFNMGMRFLTEDLYRRSTTRKNPSMPNNGSGFDAGTSLNNFNNYTAVYASDEINFNNGMLTITPGLRYTFLNYEKKDAPPFKVGQTPKTTKERYNQWNPAVNVGYKPIKELLFYFNYQRSYIPPQFSNIGNFVGTSTDYFQIFNVMEGGSRYYFNHQVSFNANYFVIFANHYFTGRYGDNREPVNARSQGVELELYYTPIRGLNFHAAYTFIDANITSHTMVTNPANPKGPKKDIFGKKLPFVSPHQFILDASYTYAKTTIGLSSFFYSRAYSDVLNTVPFTEYAPTIKNGAIVTKTAGMTPYYWVWNLQISTTLWERKNQSVNASLQINNIFNMKYWFSGIGTSPNGKEAAPPRSITAYVSYNF

SEQ ID NO: 13268 - protein, 1056 aa, Helicobacter pylori
MKNFSKMRQGLSCVVIAFLLMLIPAGVFAQNSISVSGIVMDDTNEPVIGAAVMVKGTTIGVITDIDGRYTISIPADGILSFSYVGLKDKEEKVNGRTTINIIMQTDSKMIDEVVVIGYGTQRRGSVTGAVSAVKGQDMIKTKNENPQNMLTGRIPGLRVWQKSSEPGTFNNSFDIRGMGSPLIIIDGIPRSTEEFQRLNAMDIDDISVLKDASAAIYGVRAANGVVLVTTKKGGAGKTEFSYNGSYTFQQPSRMPELCDPYESMTLFNEMSMNNINGGSWVFSEESFEAFRNGTRRTTDWNDLIISNVAPQTQHDISISGGNEKTKFYISMGYFYQEGIFRSGDLNYNKFNLRSNISTEVAKGIKFELGVSGISDERNTPYSSAQDIIRNYWRQGVLYPAYADPEGTMLNYNGLDMEQNTVAMMTADISGYKKYKQKYFQSSATLTVDFSEYTPVLKGLTAKAMFSYDYRADNNETFRKEYYQYAYDEQTGTYNQKVYNESSPSNMRREFYDKSQMLGQFTVNYDRTFNDVHHVGGVVGWEVQKRNGDNFYAVRDLAFSMPYLLAGVTEGQIGAMQTGNNDLYEQANEALIGRVNYSFADRYLLEAQFRYDGSSKFAKGHQWGFFPSVSAGWRVSEEPFFKSIDALKFVNQLKLRASYGVLGDDGDLNYDWAMGYTYPATSGNISNGDYNGYSPGYIFGGKFISAASPMALPNENITWFKSKTFDVGFDFEAWNGLLGVSFDYFNRLRTGRFARRTGDLPTVVGASAPRENLDSDRQFGMELELTHRNKIGQVAYNLKGIATVTRQKYLTASEKGPWANSYDRWRNDNLTNRYQGVQFGYTSAGRYTSWNDIWSYPGYKERDILPGDYKYEDWNGDGEINGQDEHPFALDQTPWLQFSLNAGLQWKNFDFNMLLQGSALGSMEYKEPLHEIWGKNGGGALTQFLDRWHPVDPKADPYDPSTVWTSGHYAYTGRWAKNNSAFNRVSTAYLRLKSIELGYTFPKLKQIPNASLRIYANAYNLLTFTGVKFVDPEHPDDDLGRMYPLNKTYTLGVSLSF

SEQ ID NO: 13269 - protein, 430 aa, Helicobacter pylori
MFLRVSAKSFLLGAVSAVALMSAAQAADVVQPVEASGFNWSGAYIGIGGGFGASVHKFSVAPIIDFNGIGGNGVFGELTAGYDYMVSDRFLLGGFIDANGGNIGPSISIPGADIDLTNSYGFDVGLRAGYLLNPDTLGYVLGGYSWQHFKLDGSGFAEGLNFTQNRSGYVLGVGMETVLRGNWTLKTEYRYAAYGDKSVIDFGGGSLNVEPSTHTFHIAANYRFGAQNGGGASFAAPTYNWTGFYVGGALGAGTAVHDLGVDLGGGALDLNGIGSEGVLGEASIGYDYDFGSWVAGVQLDASYSGIRSKLDIPGGSIKLDNDYGFDALARVGAKVNESTLAYVIGGYSYQHFDLHASDPVGDIIDWNKSGFTVGGGLETAVSSNMTVGLEYRYSQFGKKDFSSEFGAPDGTLTDKASFQTVRIGAKYKFN

SEQ ID NO: 13270 - protein, 738 aa, Helicobacter pylori
MKKTLLLSLSLSLSFLLHAEDDGFYTSVGYQIGEAAQMVKNTKGIQDLSDNYEKLNNLLTRYSTLNTLIKLSADPSAVSGAINNLNAGATGLLKEKTNSPAYQAVSLALNAAVGLWNTIGYAVMCGNGNGTGSGPGSVVFDGEPGQGSTQITCNRYESTGPGKSMSIDEFKKLNEAYQIIQQALKNQNGFPELGGQGTTVNVHYEYECKQTADINGGVNQFCQAKNGSSSSGSSGSNGTSTQTTTQDGVTIATTYNNNKATVDFSITNNAQQLLNQAANIMQVLNTQCPLVRSTGNESAAGGGQPWGLSTSGNACQIFQQEFSAVTSMIKNAQEIVAQSKIANANQQAEITNPSNFNPFTDAGFAQDMLKNAKAQAEMFNLAEQVRKNLEVMENNNNVNAELSGFGKEMTNFVSAFLATCKKDGTLPNAGVTSNTWGAGCAYVGETITALNNSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSFGLFGGIALAGTSWLNSEYVNLATMNNVYNAKMNVANFQFLFNMGVRMNLARSKKKGSDHAAQHGIELGLKIPTINTNYYSFMGAELKYRRLYSVYLNYVFAY

SEQ ID NO: 13271 - protein, 516 aa, Helicobacter pylori
MIKKNRTLFLSLALCASISYAEDDGGFFTVGYQLGQVMQDVQNPGGAKSDELARELNADVTNNILNNNTGGNVAGALSNAFSQYLYSLLGAYPTKLNGNDVSANALLQGAVGSGTCAAAGTANSSSLDNSQSACTAAGYYWLPSLTDKILSTIGSQTNYGTNTNFPNMQQQLTYLNAGNVFFNAMNKALEAKNGTTTNSGATGSDGQTYSTQAIQYLQSQQNILNNAANLLKQDELLLEAFNSTVAANIGNKEFNSAAFTGLVQGIIDQSQAVYNELTKNTISGSAVNNAGINSNQANAVQGRASQLPNALYNAQVTLNKINALNNQVRSMPYLPQFRAGNSRSTNIMNGFYTKIGYKQFFGKKRNIGLRYYGFFSYNGASVGFRSTQNSVGLYTYGVGTDVLYNIFSRSYQNRSVDMGFFSGIQLAGETVQSTLRDDPNVKLHGKINNTHFQFLFDFGMRMNFGKLDGKSNRHNQHTVEFGVVVPTIYNTYYKSAGTTVKYFRPYSVYWSYGYSF

SEQ ID NO: 13272 - protein, 529 aa, Helicobacter pylori
MKQNLKPFKMIKENLMTQSQKVRFLAPLSLALSLSFNPVGAEEDGGFMTFGYELGQVVQQVKNPGKIKAEELAGLLNSNTTNNTNINIAGTGGNVAGTLGNLFMNQLGNLINLYPTLNTGSIHQCGATNNGGGGGVTAAATTSNSPCFQGNLALYNEMVGSIKTLSQNISKNIFQGNNNTTSQNLSNQLSELNTASVYLTYMNSFLNANNQAGGIFQNNTNQVYGSGVTAQQIAYVLKQASITMGPSGDSGAAAAFLDAALAQHVFNSANAGNDLSAKEFTSLVQNIVNNSQNALTLANNANISNSTGYQVSYGGNIDQARSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 13273 - protein, 69 aa, Helicobacter pylori
MAKIKGQVKWFNESKGFGFITPADGSKDVFVHFSAIQGNGFKTLAEGQNVEFEIQDGQKGPAAVNVTAI

SEQ ID NO: 13274 - protein, 2372 aa, Helicobacter pylori
MAFKKAKLISNLISKGSFKLNKISKKIFKLNQILKCEKPLKRHKKTKSIKKPFNKNKSFLKASILLIGALGGLSHLRANECRYWSWSSWSYQDNIESGPNSPTHNSYCLFSSTQGSGTYYLNTLTTYSAGGASFTQKFNGGTLNVGGNIRFGGTGINGGDVGYITGAYDAQTINFNSSHLTTGNSYSDGGGATLNFNATNNITINQASLDNSDAGAQKSYMNFKGSNINVSGSSFTDDTDGGFSFSGNNNHSAISFNQTNFNQGTYHFNSTQSTFENSNFNQGTYNFNDNTSFNNDTFNQGTYSFNTSKVSFSGINTLNSSSPFASLKGSVSFGSDAVFNLNQTLNSNQTYDILTTNGAIQYGVYQSYLWDLINYKGDKAISHVGVGNNTYDVTFDINGQDETLQETFNKQSIITQFLGDDLQQQAQKTYQEDVAHSQNALNNVTSDNKIANSDTDYTKSSNPTINKDAQNLEHTNQQIAQDEQALQQDLDKLKQLANSTTGFNEQAFNQAQKQEQQDEQTLQNEENAFNAEQEGLKQAIAKPTSPTPSPTPTPTKHTAQNTPPNKVPPPAQNLPTTNVWNGVYNLQNQTYSNKGVYYIDPNLSGQSGQSGNTLSTYTANLFGRSFGVNIQNGTLIIGNNTESVNDNGLIWIGHGGFGYITGTFSAANIYLTNNFKTGEGVSNSDGGGANITFKASDNITMDGLNYNDAETVTKMIQTGASQHSYAAFDATNNISVTNSSFSDMTWGKFSFSAKNISFSNASFSGFTNPGGSSTISANAANSLSFVNSRLNGGAIYNLQANSLIFNNTQAVFNVLYSRGTSNFNATTQLLGNTNFTLSSQSLLNFNGDTTLQNNANITLGNKSQADFKNSLTLNNNSNLSLDNQSVLNANGTSAFNNQASLNIYNGSQATFSSLFFNGGTLSLNASSKLNASSASFSNNTTINLDDSVLSANNTSSLNANINFQGASQADFGGNTTIDTASFNFDSASSLNFNNLTANGALNFNGYALSLTKALISVSGQFVLGNNGDINLSDINIFDNITKSVTYNILNAQKGITGISGANGYEKILFYGMKIQNAIYSDNNNIQTWSFINPLNSSQIIQESIKNGDLTIEVLNNPNSASNTIFNIAPELYNYQASKQNPTGYSYDYSDNQAGTYYLTSNIKGLFTPKGSQTPQTPGTYSPFNQPLNSLNIYNKGFSSENLKTLLGFLSQNSATLKEMIESNQLDNITNINEVLQLLDKIKITQTQKQALLDIINHLTDNINQTFSNGNLIIGATQDNVTNSTSSIWFGGNGYSSPCTLDSATCSSFRNTYLGQLLGSTSPYLGYINADFKAKSIYITGTIGSGNAFESGGSADVTFQSANNLVLNKANIEAQATDNIFNLLGQKGINEIFNQGNLANVLSQMAMEKIKQAGGLGNFIENALSPLSKELPSSLQSETLGQLIGQNNLDDLLNNSGVMNAIQNIISKKLSIFGNFVTPSIIENYLAKQSLKSMLDDKGLLNFIGGYIDASELSSILGVILKDITNPPTSLQKDIGVVANDLLNEFLGQDVVEKLESQGLVNNIINNIISQGGLSGVYNQGLGSVLPPSLQNALKENDLGALLSPRGLHDFWQKGYFNFLSNGYVFVNNSSFSNATGGSLNFVANKSIIFNGDNTIDFSKYQGALIFASNGVSNINITTLNATNGLSLNAGLNNVSVQKGEICVNLANCPTTKNSSSTNSSVTPTNESLSVRANNFTFLGAITSNGAIDLSQVTNNSVIGTLNLNENATLQANNLTITNAFNNASNSTANINGNFTLNQQATLSTNASGLNVMGNFNSYGDLVFNLSHSVSHAIINAQGAATIMANDNNPLIQFNTSSKEAGTYTLIDSAKAIYYGYNDQITGGSSLDNYLKLYVLIDINGKHMVMTDNGLTYNGQAVNIKDGGLVVGFKDSQNQYIYTSILYNKVKIAVSNDPINNLQAPTLKQYIAQIQGTQGVDSIDQAGGNQAINWLNKIFETKGSPLFAPYYLESHSVKDLTTIAGDIANTLEVIANPDFKNDATNILQINTYTQQMSRLAKLSDTSTFARSDFLERLEALKNKRFADAIPNAMDVILKYSQRNRVKNNVWATGVGGASFINGGTGTLYGINVGYDRFIKGVIVGGYAAYGYSGFHGNITQSGSSNVNMGVYSRAFIKRSELTMSLNETWGYNKTFINSYDPLLSIINQSYRYDTWTTDAKINYGYDFMFKDKSVIFKPQVGLAYYYIGLSGLRGIMDDPIYNQFRANADPNKKSVLTINFALESRHYFNKNSYYFVIADVGRDLFINSMGDKMVRFIGNNTLSYRDGGRYNTFASIITGGEIRLFKTFYVNAGIGARFGLDYKDINITGNIGMRYAF

SEQ ID NO: 13275 - protein, 751 aa, Helicobacter pylori
MQFPRRQRRLSMIIPPRRAALLAATGLAALSTAAFAQTTPATPPAKKDPSNQVQGVTITAPASQDMRTSIDRRSYSLGKDLQATTGSVADVLRNVPSVQVDVQGNVSLRGDPNVTIMIDGKPSGMFKGDNRGQVLQQIPANQFERVEVMTNPSAAFSPEGTAGIINLITKQQRGVGMTGSVRGNFGSEGRKNASVSLAQNTKNLTVSADAGWRRDKAKGEIVDERERLDPTSGAYATSRQKVNFISRGQSHNARASVDYDLDKRTRLSAEARYNDMRYDSVSGSSFEGKTPAGIPNVRFQRLSDGAMKRSVAGLSGDLRRKLSGDDHEFTLNGSLERTRNSQGGLAETFSQLPIVPTALENVRTSDELVQTRLKAEYKRPLQGGAKLVAGYELQLNENDYDNYGARGPKGGVLVVDPALTNRFQFDQAVNALYATYSRPIGDWTVMPGLRVEQVTIDTNQITSRLTDSYDYLRAYPSLHLQYKVDDLRQVNASYSRRIQRPSAQDLNPYRIFQDPYSYRQGDPRLKPQVTDAFEVAYQVRKGFNYYLGTLYWREARDGVTDVVRDIGDGVLLTTKANLAKSRSGGLELVANARLSPKLSYTISGNTAWTEIGATDLGFPEKRSAWTVSGYAALNIQATPKDFLQISGFATGKRLTPQGYKAPTGMLLLGYRHKFNDRLSGVVTVQDALKTFGDKTVINTPALKNRRDMDLDLRAVFVGFTYGFGGQGVPNPRRAREPAFDFQTTPGGVGPM

SEQ ID NO: 13276 - protein, 314 aa, Helicobacter pylori
MLKFKYGLIYIALIIGLQATDYDNLEEENQQLDEKINHLKQQLTEKGVSPKEMDKDKFEEEYLERTYPKISSKKRNKLLKFFSIADDKSGVFLGGGYAYGELNLSYQGEMNDKYGVNAPSAFKNNININAPVSMISAKFGYQKYFVPYFGTRFYGDLLLGGGALKENALKQPVGSFFYVLGAMNTDLLFDMPLDFKTKKHFLGVYAGFGIGLMLYQDRPNQNGRNLVMGGYSSPNFLWKSLIEVDYTFNVGVSLTLYRKHRLEIGTKLPISYLRMGVEERALYQNKEDDERLLVSANNQFKRSSFLLVNYAFIF

SEQ ID NO: 13277 - protein, 289 aa, Helicobacter pylori
MGINMCSKKIRNLILCFGFILSLCAEENITKENMTETNTTEENTPKDAPILLEEKRAQTLELKEENEVAKKIDEKSLLEEIHKKKRQLYMLKGELHEKNESILFQQMAKNKSGFFIGVILGDIGINANPYEKFELLSNIQASPLLYGLRSGYQKYFANGISALRFYGEYLGGAMKGFKSDSLASYQTASLNIDLLMDKPIDKEKRFALGIFGGVGVGWNGMYQNLKEIRGYSQPNAFGLVLNLGVSMTLNLKHRFELALKMPPLKETSQTFLYYFKSTNIYYISYNYLL

SEQ ID NO: 13278 - protein, 240 aa, Helicobacter pylori
MGLKKRAILWSLMGFYAGLNALDYDTLDPKYYKYIKYYKAYEDKEVEELIRDLKRANAKSGLILGINTGFFYNHEIMVRTNSSSITGNILNYLFAYGLRFGYQTFRPSFFARLVKPNIIGRRIYIQYYGGAPKKAGFGSVGFQSVMLNGDFLLDFPLPFVGKYLYMGGYMGLGLGVVAHGVNYTAEWGMSFNAGLALTVLEKNRIEFGFKILNNFPFLQSNSSKETWWGAIASIGYQYVF

SEQ ID NO: 13279 - protein, 680 aa, Helicobacter pylori
MHYLRIIIIRRNYPRKNDMSRLIRRTRKTSHTSGAALSPKLSLLSRAIGLSLLLPAAWATAAAPQDATPEMERMVITATQTQHSELSAPASVSVINRSELEALVIDDLASAVRYLQGVNISEGTPYGRNEISLRGLDSDYTLILINGRRVNSREALTSGYGNDFDLSSIPMSAIERIEVVRGPMSSLYGSEALGGVVNVILRQPTDDWQTSVGVQYDTPTSGKGGDSTKYNFYTSGALIKDKLLANLIVDSNQRDAWRSDLKPTIDALEDRDEISALANLQWLIDSQQDLQFDLSYANDERESDWNNYGTILTNNQQAERISSGLTHNGHWNWGDTRLRYYYENVEVTDDSALIAEIGHITQTNHNLDGQTTVLLGDHMLTSGAEYRWTQLENSRNILGDGTLDDSQSALYLQDEFSLGELNITLGGRVDHHDVYGTEFSPRVYLVYNLSSEWVIKGGGGKAFKAPNMSQSQADYIIPACRGACTVAGNPDLQPETSVNYELSTQYQTTDFGGSITYFHNDVENKIITETWDRTPGAVLTYQNVNEAKITGWELQAWYDVTDTVSFSGNYSKTDAEDKQNGAPFTLTPDDSYNLKLQWQALEGLSTFIAYHYTGDQYLRTNVKSTGYGSLDLGANYQINPMFRVKLGVTNLTDTERDQVATDLDYIQKSRSIYAGVTASF

SEQ ID NO: 13280 - protein, 820 aa, Helicobacter pylori
MGQDKIKLPVTNARIIAQTSAPTQQTLILITGVKANSTEKGVEVILETTQGEQLQVTNRSTGNNFIADITTGQLQLPNGDAFTYRSEKPINGITEITVANLDANTVRVTVVGEKALPAVELFDDDAGLILAVESTTTATQPPATPTSDAPPAEPIAQQDDPIELVVTGEQDRYRVPTASTATKTDTPVRDIPGSIQVIPRQILEDQKTTRIQEVLQNVSGVNKQGNYGGTDAGGYRIRGFDQDGNFRNGFNDTDFYSLVDTANIDRIEVLKGPASVLFGQAEPGGIINVVTKQPLRTPYYAAELNVGNYAFYRPSFDISGPLTDDGSLLYRLNVAYQNSGSFRDYNFLERVFVAPVITWNISDRTSLTFDLEYQDNDYLFDRGIPSIGDRPAPIPISRFVGLPHVYNDSTFRIGYRLEHDFSKDWQLRNAFSFVSGKSSGTYAYGGYDLIDDQFAPIYVSRDEFTRDIYTLQTEVVGKFKTGSIVHQPLIGVELRRNTWKYTSFDVADPILLDIFNPNYDVELPATPDESTFSYTTRRDTLGIYVQDQITFADNLKLLVGGRFDAFQRKEEGFSETASEESLSAFSPRIGIVYQPIQAISLYASYSQSFKPDRFFGRSASNEPFKPTRGTQYEVGIKADISEKLSATLAAYEITKTNVVTSDPNDPNLSVQVGEQRSRGIELDIGGEIVPGWNIIASYTYTDAITSKDNTIPVGNRIDNVPEHAASLWTSYELQSGDLKGLGFGLGLYYVGDRYADVENTSLLSSYFRTDSAIYYKRDNWRLALNFRNLFNETYYETSQARNTIYPGAPFTVIGSFSIQF

SEQ ID NO: 13281 - protein, 277 aa, Helicobacter pylori
MKRALYLILGLFCTLNAESFKDVLTKGDYTFFNQKVVSPIKRYADRSAFYLGLGYQLGSIQHNYSNLNLSQQFNKSQIIFSDGLSPVFKNSYVSNGFGVQVGYKWVGKHEETKWFGFRWGLFYDLSASLYGQKESQSIIISTYGTYMDLLLNAYNGGKFFAGFNLGIAFAGVYDKLSDALLYQALLLDTFGGKVDPNGFQFLVNLGVRLGNKRNQFGFGIKIPTYYFNHYYSMNNISNNSGDVLKVLRFLEYGINSLLYQVDFRRNYSVYFNYTYSF

SEQ ID NO: 13282 - protein, 697 aa, Helicobacter pylori
MQNFVFNKKWLIYSSLLPLFFLNPLMAEDDGFFMGVSYQTSLAVQRVDNSGLNASQDASTYIRQNAIALESAAVPLAYYLEAMGQQTRVLMQMLCPDPSKRCLLYAGGYQNGQNNNGDTGNNPPRGNVNATFDMQSLVNNLNKLTQLIGETLIRNPENLPNSKVFNVKFGNQSTVIALPEGLANTMDALNNDITNALTTLWYNQTLTNKSFSTPSNTSVNFSPQVLQHLLQDGLATANNNQTICSTQNQCTATNEAKSIAQNAQNIFQALMQAGILGGLANEKQFGFTYNKAPNGSDSQQGYQSFSGPGYYTKNDNTTQAPLKALPAGATIGSGNGQYTYHPSSAVYYLADSIIANGITASMIFSGMQNFANKAAKLIGTSSYNQMQDAINYGESLLSNTVAYGDFITNWVAPYLDLNNKGLNFLPNYGGQLNGANNQTPQLTPQQAQQEQKVIMNQLEQATNAPTPAQINRILANPYSPTAKTLMAYGLYRSKAVIGGVIDEMQTKVNQVYQMGFARNFLEHNSNSNNMNGFGVKMGYKQFFGKKRMFGLRYYGFYDFGYAQFGTESSLVKATLSSYGAGTDFLYNVFTRKRGTEAIDIGFFAGIQLAGQTWKTNFLDQVDGNHLKPKDTSFQFLFDLGIRTNFSKIAHQKRSRFSQGIEFGLKIPVLYHTYYQSEGVTAKYRRDFSFYVGYNIGF

SEQ ID NO: 13283 - protein, 1240 aa, Helicobacter pylori
MIKKARKFIPFFLIGSLLAEDNGWYMSVGYQIGGTQQFINNKQLLENQNIINSVTQSAINIAGPTTGLITLSSQSVIDALGYGVSNTVGNQLEGISNILNQIGKRKDFYSSRQISSISQQIIGLKGSSDPLKAHSSQITAKLLSNTQSAFDQGIALSTSIISSINSLNPSNNTQEVKAQLQNTVQSMTELLQQIEHSITKTTSTTYAQSLLSNLTDAVNASSNNTAYVSALVNALNTLGVGVFPTTTSTHVVLNPPGQVVFYPTNSLLGSTSSNSNNQQQYNNTLLMNTLQGTLSANTQNNPNGCANQVQCLEQFIQNLAPLATTPTSNNQANQQVQAIAQKLQSVAINTLDNNAINNTTYNLNNLHNALNFQAYESTIEQYNNALKQISWISFSEPKNLLKNTSNNYQIGTVTNAQGQNISAYDCASATGSLSSDASSGISCSATSSTSSANGSTNSTNSFDNSLVATSKVQTINGKEQIGVNSFNLVSQVWSVYNSLKTSEENLKKNANILCANGTQSGTSSCNSSSGGLSISGNAQLQNILSPTNGTTTNAQAKSNASKLKAMVMVNNEEEAKTTNLAQSSGTTTQSSNSTVMGALNTVLQNVNNFQQSIQSTFQNQESNIQAWANAIYNTNGSQSQDMTLNTNQNLRIQLRANFYQLINTINQQVPTDMSALINQSQQTQQTSGATSNNNACASGTNGSNSNWCYQQWSDSKAYYSGLQSALGYQTQATTQNGSSGGSNITYNVQQITLTSNGLLNQIITNLKGVNGNSGNNGGSSGGGNGTSQINTAYQMLTDASDGKLGTYSSSNSGNNNGYTPCNSTNGSNGTSGSNCYEPNKQQSATTATTNENNSLQKVYNDAQKIANIIASSGNNKGVENGLKQFFEALKNNSSSLSNLCNSSSGSSSSTCTGGLINLLGAIPTNGVSDTNNLINLLTEFIKTAGFIQNNDNNASNESLKSAFQAITSAISQGFQALQNDISPNAILTLLQEITSNTTTIQAFSQTLRQLLGDKTFFMVQQKLIDAMINARNQVQNAQNQANNYGSQPILSQYAAAKSTQHGMSNGLGVSLGYKYFFGKARKLGLRHYFFFDYGFSEIGLANQSVKANIFAYGVGTDFLWNLFRRTYNTKALNFGLFAGVQLGGATWLSSLRQQIIDNWGNANDIHSTNFQVALNFGVRTNFAEFKRFAKKFHNQGVISQKSVEFGIKVPLINQAYLRSAGADVSYRRLYTFYINYIMGF

SEQ ID NO: 13284 - protein, 645 aa, Helicobacter pylori
MKKTKKTILLSLTLAASLLHAEDNGVFLSVGYQIGEAVQKVKNADKVQKLSDFYEKLSRLLTNDNGTGSKTSAQAINQAVNNLNERAKTLAGGTTQSPAYQATLLALRSVLGLWNSMGYAVVCGGYTKSPSENNQKNFHYTDENGNGTIINCGGSINSDGTHSFNGTNMLKAGKNSSLSIEQYEKIYEAYQILSKALKQAGLAPLNSKGEKLEAHVTTSSKYQQEKQTKTTTSVIDTTNDAQNLLTQAQTIVNTLKDYCPMLIAKSSSGNGMTNSANTPSWQTAGGVKNSCATFGAEFSAASDMINNAQKIVQETQQLSANQPKNITQPHNLNLNTPSSLTALAQKMLKNAQSQAEILKLANQVESDFNKLSSGYLKDYIGKCDASGVSSVSGANMTMRNQKNNWGNGCAGVEETLDSLKSSNASFDSQTPQINQAETLANTIVQELGNNPFRNMGMIASSTTNNGALNGLGVQVGYKQFFGKKKRWGLRYYGFFDYNHAYIKSSFFNSASDIWTYGVGSDLLFNFINDKNTNFLGKNNKISVGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 13285 - protein, 721 aa, Helicobacter pylori
MKKHILSLALGSLLVSTLSAEDDGFYTSVGYQIGEAAQMVTNTKGIQELSDNYEKLNNLLTRYSTLNTLIKLSADPSAINAARENLGASAKNLIGDKANSPAYQAVLLAINAAVGFWNVVGYVSQCGGNANGKKSTSSTTIFNNEPGYRSTSITCSLNGYTPGVEGPISIENMKKINEAYQILQTALKQGLPALKENNGTVKVEYTYTCSGRGNDNCPKEATGVNNQQNGTKTETKITGDKTVTTISLKVPDSAQALLAQASTLINTINSACPWFIATSSNSSNAPQWKWSAHSGGLCGAFKDEISAIQKMITDAQELVNQTSVINSHEQSTPIGGNNGKPFNPFMDASFAQGMLANASAQAKMLNLAHQVGQTINPDNLTGNFQYFVKEYLATCNNKSTAGTGGTQGSPPGEVTTQTFASGCAYVEQTITNLENSIAHFGTQEQQIQQAENIADTLVNFKSRYSELGNTYNSITTVLSSIPNAQSLQNVVGKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARPKKKGSDHAAQHGIELGLKIPTINTNYYSFMGAELKYRRLYSVYLNYVFAY

SEQ ID NO: 13286 - protein, 242 aa, Helicobacter pylori
MKKIFSQSLLALIVSMNALLAMDGNGVFLGAGYLQGQAQMHADINSQKQATNATIKGFDALLGYQFFFGKYFGLRAYGFFDYAHANSIRLKNPNYNNEVAQLTGQVLGKQEINRLTSLADPKTFEPNMLTYGGAMDLMVNVINNGIMSLGAFGGVQLAGNSWLMATPSFEGILVEQALVSKKATSFQFLFNVGARLRILKHSSIEAGVKFPMLKKNPYITAKNLDIGFRRVYSWYVNYVFTF

SEQ ID NO: 13287 - protein, 613 aa, Helicobacter pylori
MLHKKNLLWLALVVAGGAQAQGDQRLSDLQVTANRLPQSQSDVLASTTVIDRDDIERSQAGSIIDLLQGRAGIEIAQSGPPGTLSSLFMRGTESDHSLVLVDGVRINSATSGGASLEMLPLEAIERIEIVRGPRAAAYGADAIGGVIQVFTRRGAATGTQVGLKASAGSDSTQRQSAWVATGDDDTRLNASLFHRDGDGFNATQADDSGERDGFERAGAQLGLSHRFNDDVEVSVNALRQNFEGEYDNCYPAGAFTPTQDCVTKGYLQSFGGQLDVQLQPDWQMSITAGHFDEQREERYAGERQSLIESHRDEVGLQHRFTRDNGVDVLGIDYRHDSVDFDSASPYAGDYVRDSRENIGIYAMMQRTYGAHEVSGSLRHDDDSLFGDETTGSLGYAYRLTPYQRLGASVSTAYKAPNLIDLYGPYGTNPDLDAETAENLEAFWAYERDGWQGRVTVFDNRIDDLIGYDPMTSIPYNVDEARIRGVELSGGWQSGGLTLNASLTHQNPEDRQTGERLQRRARTFGRLDADYAVADWTFGATLRAAGDRHDSDFVTYGDTTVAGYGVVDLRTAWQVTSMIELSAKVENAFDKEYQLIDGYNTQDRYVEGGVTLRF

SEQ ID NO: 13288 - protein, 746 aa, Helicobacter pylori
MLKLASKTICLSLIGSFTALEAYQKHQKDGFFIEAGFETGLLQGTQTQEQTIATTQEKPKPKPKPKPITPQSTYGKYYISQSTVLKNATELFAEDNITNLTFYSLTPVYVTAYNQESAEEAGYGDSSLIMIQNFLPYNLNNIELSYTDNQGNVVSLGVIETIPKQSQIILPASLFNDPQLNTDGFQQLQTNTTRFSDASTQNLLDKLSRVTTNLQMTYINYNQFSSGNGTGSKPPCPPYENQENCTAKVPPFTSQDAKNLTNLMLNMMAVFDSKSWEDAIKNAPFQFSDNNLSVPCYSNYSTCVNPYNDGLVDPKLIAKNAGDEYNIENGQTGSVILTPQDVIYSYRVTNNLYVNLLPPRGGDLGLGSQYGGPNGPGDDGTNFGALGILSPFLDPEILFGKELNKVAIMQLRDIIHEYGHTLGYTHNGNMTYQRVRMCEEGNGPEERCKGGKIEQVDGQEVQVFDNGHEVRDTDGSTYDVCSRFGGQNQPAFPSSYPNSIYTDCSQVPAGLIGVTSAVWQQLIDQNALPVDYTNLSSQTNYLNASLNTQDFATTMLSAISQSLSSTKSSATTYRTSKTSRPFGAPLLGVNLKMGYQKYFNDYLGLSSYGIIKYNYAQANNEKIQQLSYGVGMDMLFDFITNYTNEKNPKNNLTKKVFTSSLGVFGGLRGLYNSYYLLNQYKGSGNLNVTGGLNYRYKHSKYSVGISVPLVQLKSRVVSSDGATTNSITLNEGGSHFKVFFNYGWIF

SEQ ID NO: 13289 - protein, 231 aa, Helicobacter pylori
MFKKIIFFGVFLMGGFAVSPLDAMPILHDKTPKKNYQEAHEKLYRSIINRQKLTRKKSGWYFLGGFGAVEAIKDYQGQEMKDWIATLNLKTGVQSFFKKYIGIRGVFAWDLGSGKVNYQSHKDPTNSFFTMLAVGLDVIMEFPLGSYKHYLGAFGGARGALVVYTDKQNFKFFKHSVVSGGLAINGGVMLTLFLRHRIELGFKILPTARLLSSSKRFETSPLFYAAYSYKF

SEQ ID NO: 13290 - protein, 248 aa, Helicobacter pylori
MLKRMILLGALGVLASAEESAAFVGVNYQVSMIQNQTKMVNANGLQKPLMKFPPYAGAGFEVGYKQFFGKKKWFGARYYGFFDYTHDRFGVMKKGIAVGESGFIYNSFSFGGTTLTERDSYQGQYYVNLFTYGVGLDTLWNFVNKENMVFGFVVGIQLAGDSWATSISKEIANYAKHHSNSSYSPANFQFLWKFGVRTHIAKHNSLELGIKVPTITHQLFSLTNEKGYTLQADVRRVYAFQISYLRDF

SEQ ID NO: 13291 - protein, 860 aa, Helicobacter pylori
MMLLSLLSGPALAQQNDTSADENQQKNNAESEEEQQGDSSSGNSEDTILVRSTPTSQSMGMQIINAEQIKKMPTGNGSVTELLKNNPNVQFSNTASSSNIPGELAPENVSFHGEKFYNNNFMVDGLSNNNNINPGANNGELNQQPDGYSPADLPAGGPQSFWINSELIESLEVFDSNISAKYGDFTGGVVDAKTMDPKLDKSSGKISYRTTRDSWTKYHISEVISEEFYSGTNLYYQPKFKKHFYSATFNQPLSDKAGFIFAYNRQQSDIPYYHEYLQQWDDQERINETYLLKGTYLTDSGDIIRMTGMYSPHESKFYKKDVKNGGFTNSGGGYRFNMEWEHNASWGKMTSLAGYQYTEDKTEHEADSYQTWRRFSSGFVSNVIDWSSSGGANGQNSNIGGYGSFATNTSSFSLKQDYELNPVSWYGINHQIDFGWETDFYTSRYRRFSDVYTGGVLVVPTGASAGSVVCQSGDELCIPGEQYSRTRILYPERNVQVSNVNYAAYLQNSMSYGRLEVTPGVRVSYDDFLENLNIAPRFSASYDVFGDRSTRLFGGANRYYAGNILAYKMRQGIGSNIQESRISPTAPWTTPTLRTGTNYNVSDLNTPYSDELSLGLSQRVMSTVWTAKWVNRQGKEQFGRETTTIDGQSYRVMNNKGHTEGNTFSLEVEPISPHRFSFAEVNWKLGASVTKNKSNSIYYYDSANQDEQRVIFDDKLMYRGDIDAMNFNTPWRAFLNVNTYFPAVRLSWDQRVGYTAGYKGYTTSSIQVQCPGGSSACNGDPSFVGGATEYFPTQYDDFISYDWRFSYSQPVYKTQTLDITLDVLNVLDNVVETNQTGTSNKPIVIYKPGRQFWLGVAYTW

SEQ ID NO: 13292 - protein, 863 aa, Helicobacter pylori
MLRNKFRIVFVSCIVASSLQAQETTHTLGKVTTKGERTFEYNNKMYIERKELQQRQSNQIRDIFRTRADVNVASGGLMAQKIYVRGIESRLLRVTIDGVAQNGNIFHHDANTVIDPNMIKEVEVIKGAANASAGPGAVAGKLSFTTIDANDFLRKNQTYGAKAEAGFYTNFGYRMNATAAYRGKNWDILAYYNHQNIFYYRDGNNAFRNLFHPNYDLQDPSNSDIGVGTPSEINSVLGKVNGYINDTDTISLSYNMTRENSTRLLRPNTTSALSKANDPGSQPAPFVIDFGKELAHTINFNHNLSLKYKHDGGTSFSQPRVESTAFLGVRGGDYNPVVNPFAYNSNEPANPDYIPEVKDWCNNPDNISQCTQGAIRPSDGGYQIGYGQPGSINWQGASAISTGSNIYHGLVPKNPDYDMTPPNAQNPSANDWTLGNADAEGTLARRIFLINSGVNFKVTHPISEDYGNVFEYGMIYQNLSVFSGLDKGKNGYYKNNIDPNDPNGPGLPYRHYYTDQSSQYPQNLNAPNPLYRNMPQNSHAIGNIIGGFMQANYNLLKNLIVGAGTRYDIYTLLDKNGRTHVTSGFSPSATVLYNPIESIGLKVSYAYVTKGALPGDGVLMRDPTVIYQRNLRPAIGQNVEFNVDYNSKYFNVRGAAFYQVINNFINSYGQDTSKNGGGNATAKNMSGNLPETINIYGYEVSGNVQYKNFVGTFSVARSWPTARGHLLADTYALAATTGNVFILKADYNIHRWGLTLTWLSRFVTNMFYEGYSIYYPQYGLMRIHKPGYGVHNVFINWTPPSKKWQGLRISAVFNNILNKQYVSQASVWQASADAPASDMIPKDKRMALPAPGFNARFEVSYQF

SEQ ID NO: 13293 - protein, 906 aa, Helicobacter pylori
MKLFSKAVAMGTTAILSGLFAGSAMAQVDVITVTSQKREQTLQDTPVSVAVVTGEQLEQSQIRDAADLQTLVPALRVSEFATSTNTEFNLRGIGTSSFNPGLEPSVGVFIDGVYRPRSGSAINDLMSVERIEVIRGPQSTIFGRNTPAGVVSVITMAPDFDFNYAGEVTVGNYGMRQTRGTVTGPLSDNMAFRLDGNIHQNDGYIDVVDGREANNRDRMSFRGQLLFNPSDNTEVRIIADWGQLDENCCAAPFAFYDPIDLGALVGLGGTAVPADVNGGDTIAIDGDLNTDLTTQGISAQIEHDFDGFTFTSITAYRQYDEDQIFDADFSDLDLISLRSIQNQYDSFTQEFRVTSTGDNAVDWMFGGFYYNNELSYDNSTPYGADARTFFDAASAGSVADLVASFGLPAGTGGVSLLEIFLDMNQAAGVGGFVPLASGNGALPTTPAEGFISTQHGLISESYQYDTTAWSAFGTVDWHLTDQFTVTIGGRYSDEDKEMVTAINQPDPMSAFSFADLAQDLRLVTPGTCDPGLFGVIGGDACAYLVPSILFGQAQAEAIGGDPTLLNTLLALGISPTSPLTAAQAANPALNPLLGFTAFQNFPPVNAGNFPTSRNDSNFSGNIILSYDVSDTFNVYASYATGYKPGGFNVSTNAAFTGVFEFEEETAENIEFGAKGSFDDGRFVYAAAYFRQEVTDFQTNNFVGNGFALENAGSIEVSGIEFEGQWAPTDNLLITGGFTYLFESKYGEYLYAPCPDSFDATDPDFALCVPGAERTNGAGVTALFNDLSGRDRGNSEFLGALTATYTHQLGEGMEMSWRGEMNHVSEFGHTTSQDPRPFANQDAFQLYNASVTLGADDGAWAVQLWGRNIFDENYTKGGFPSVGYLGTSYNAYPGDPQTYGITLRVRG

SEQ ID NO: 13294 - protein, 1080 aa, Flavobacterium johnsoniae
MKNILTGRMRKVLFIAVCIRSSLWGEICYSAETGRILSGSDTGKEWVSSALQQNKSIIVTGVVTSEGGEPIIGATVQVKGTSTGVITDIDGRYTITVPDGNSILSVSFIGYQSQEIKVNSRRGINVCLQENVQSLDEVMVVAYGVQKKATLTGAISSVGTEALLKSPSASVTNSLAGQLPGVSSMQASGQPGADNAKIFVRGVGSLTEGGAAPLILVDGVERSFYQMDPNEIESINVLKDASATAVFGVRGANGVILVTTRRGEEGKAKISISSNVGIQMPTRILDVADSYTTASLFREAQRNDGAADDLLAFSDYDMERFRLGDSPILYPNVNWYDYLMNKAAVQTQHNVSISGGTKDIRYFVSLGFLFQNGLFKQLDGLDYDNNYSYTRYNYRANLDVNLTRTTTLKFGMGGIVGNQRDPGGSGNVWKQLTWSLPFSSPGIIDGKKVVTQSTRFPGVKMENQVINGFYGYGYDRKVSNNMTFDLNLSQNLDFITKGLSIEVKGAYNTDYSYIKTVRGHVETYTPFYKSEIDGSGLDVGDPDFDKSLVYRITGENMMKTYGTGDKKRARDWYVEGSIRYNRKFGEHNVGALLLYNQSKKYYPNYPNKFWDVPTAYVGLVGRLTYDYKSKYIAEFNIGYNGSENFAPDKRFGTFPAGSIGYVITEEKFIPKNDFLTYLKVRASVGLVGNDNMSSNRFLYLPDSYSINNSDWLQKAYQDKNGYIFGLTNTVYQTAAKELMLGNSNVTWETALKQNYGIDAYFFSDRLKLTVDYFRENRRDILIQRSTVPSLIAMNGILPVVNMGKVNNQGYEVDLKWNDRIKDFSYYINANVSYSKNKIIYQDEVEPNEPYMWRTGHEVGARFGYLAQGFYNENDFDADGNVRGDLPQPQGKKYPGDIKFADLNGDNIIDNDDQTKIGNPKRPAYTFGLNLGGEYKGFFASMNWTGVAQCDIEMANAYKRPFYEGQVLYQYMADGRWTPETAATAVYPRLSISSSTNQETSSVWLKDASYIKLKNLTIGYNITQQKILKAIGASKLTVQFTGYNLLTFDKLKVFDPEGELTRDTNTYPIMKIFSLGVNVTF

SEQ ID NO: 13295 - protein, 238 aa, Neisseria meningitidis
ASEDGSRSPYYVQADLAYAAERITHDYPQATGANNTSTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRLGLGVIAGVGFDITPKLTLDTGYRYHNWGRLENTRFKTHEVSLGMRYRF

SEQ ID NO: 13296 - protein, 235 aa, Neisseria meningitidis
ASEDGSRSPYYVQADLAYAAERITHDYPQATGANNTSTVSDYFRNIRAHSIHPRVSVGYDFGGWRIAADYASYRKWKESNSSTKKVTEEINNNYKETQTKHQGNGSFHASSSLGLSAIYDFKLNDKFKPYIGARVAYGHVKHQVHSVETKTTIVTSKPTQGAAQGGPIIQTDPSKPPYHESHSISSVGLGVIAGVGFDITPKLTLDTGYRYHNWGRLENTRFKTHEVSLGMRYRF

SEQ ID NO: 13297 - protein, 240 aa, Neisseria meningitidis
ASENSSRSPYYVQADLAYAAERITHDYPQATGANNTSTVSDYFRNIRAHSIHPRVSVGYDFGGWRIAADYASYRKWNNNKYSVNTKEVERNNTSGNWKELKTENQENGSFHAVSSLGLSAIYDFKLNDKFDKFKPYIGVRVAYGHVKHQVHSVRKETTTAFLKPSKGATEPGKIPSLVTKPAYHESHSTSSLGLGVIAGVGFDITPKLTLDTGYRYHNWGRLENTRFKTHEVSLGMRYRF

SEQ ID NO: 13298 - protein, 241 aa, Neisseria meningitidis
ASEDGSRSPYYVQADLAYAAERITHDYPKATGANNTSTVSDYFRNIRAHSIHPRVSVGYDFGGWRIAADYASYRKWNNNKYSVNTKELQKNNSSGIWQELKTENQENGTFHAASSLGLSAIYDFKLNDKFDKFKPYIGARVAYGHVKHQVHSVRKETTTTFSPPAQGATVPGKIVQGPTNKPAYHESNSISSLGLGVIAGVGFDITPKLTLDTGYRYHNWGRLENTRFKTHEVSLGMRYHF

SEQ ID NO: 13299 - protein, 234 aa, Neisseria meningitidis
ASEDGSRSPYYVQADLAYAAERITHDYPKATGANNTSTVSDYFRNIRAHSIHPRVSVGYDFGDWRIAADYASYRKWNNNKYSVNTKELENKNNNKRDLKTENQENGSFHAASSLGLSAIYDFKLNDKFKPYIGARVAYGHVRHSIDSTKKTTEVLTSSHAPGTAPTIYNVPKTQNAYHESHSIRRLGLGVIAGVGFDITPKLTLDTGYRYHNWGRLENTRFKTHEVSLGMRYHF

SEQ ID NO: 13300 - protein, 234 aa, Neisseria meningitidis
ASEGNGRGPYVQADLAYAYEHITHDYPEQTGTKKDKISTVSDYFRNIRTHSIHPRVSVGYDFGGWRIAADYARYRKWNDNKYSVDIKELENKNQNKRDLKTENQENGTFHAVSSLGLSAVYDFKLNGKFKPYIGARVAYGHVRHSIDSTKKTTKFLTSSYGGLNPTVYTEENTQNAHHQSNSIRRVGLGVIAGVGFDITPKLTLDTGYRYHYWGRLENTRFKTHEASLGVRYRF

SEQ ID NO: 13301 - protein, 241 aa, Neisseria meningitidis
ASEDGSRSPYYVQADLAYAAERITHDYPKATGTDKDKISTVSDYFRNIRAHSIHPRVSVGYDFGGWRIAADYASYRKWSNNKYSVNTKVLKENQGNRIKLKTENQGNGTFHASSSLGLSAIYDFKLNDKFDKFKPYIGARVAYGHVKHQVHSVETKTTIYTTAPTGDATVGGTIPERPSSKPAYHESNSISSLGLGVIAGVGFDITPKLTLDTGYRYHNWGRLENTRFKTHEVSLGMRYHF

SEQ ID NO: 13302 - protein, 237 aa, Neisseria meningitidis
ASEDGSRSPYYVQADLAYAAERITHDYPKASGANNTSTVSDYFRNIRAHSIHPRVSVGYDFGDWRIAADYASYRKWNNNKYSVNTKNVQVNKSNGNRQDLKTENQENGTFHAVSSLGLSAVYDFNTGSRFKPYAGVRVAYGHVRHSIDSTKKTTNVLTVPTNIPGGTPTIYNQGSTQDAYHESHSIRRLGLGVVAGVGFDITPKLTLDTGYRYHNWGRLENTRFKTHEVSLGVRYRF

SEQ ID NO: 13303 - protein, 517 aa, Neisseria meningitidis
RLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 13304 - protein, 241 aa, Neisseria meningitidis
ASEDGSRSPYYVQADLAYAAERITHDYPKASGANNTSTVSDYFRNIRAHSIHPRVSVGYDFGDWRIAADYASYRKWNNNKYSVNTKEVRRNNNAGNWRELKTENQENGSFHASSSLGLSAIYDFKLNDKFDKFKPYIGVRVAYGHVKHQVHSVKKETTTTFLAPTGDAKVPGKIVEGPFSKPAYHESHSISSLGLGVIAGVGFDITPKLTLDTGYRYHNWGRLENTRFKTHEVSLGVRYRF

SEQ ID NO: 13305 - protein, 232 aa, Neisseria meningitidis
ASEDGSRSPYYVQADLAYAAERITHNYPEPTGADKDKISTVSDYFRNIRAHSIHPRVSVGYDFGDWRIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSVGLGVIAGVGFDITPKLTLDTGYRYHNWGRLENTRFKTHEVSLGMRYHF

SEQ ID NO: 13306 - protein, 236 aa, Neisseria meningitidis
ASEDGGRGPYVQADLAYAYEHITHDYPKPTDPSKGKISTVSDYFRNIRTHSIHPRVSVGYDFGGWRIAADYARYRKWSDNKYSVSIKNMRVHKHNSNRKNLKTENQENGSFHAVSSLGLSAIYDFQINDKFKPYIGARVAYGHVRHSIDSTKKITGLLTTSTPGIMSGVYKVLRTPGAHRESDSIRRVGLGVIAGVGFDITPKLTLDAGYRYHNWGRLENTRFKTHEASLGVRYRF

SEQ ID NO: 13307 - protein, 240 aa, Neisseria meningitidis
ASEDGSRSPYYVQADLAYAAERITHDYPEPTGADKDKISTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRLGLGVVAGVGFDITPKLTLDTGYRYHNWGRLENTRFKTHEVSLGVRYRF

SEQ ID NO: 13308 - protein, 232 aa, Neisseria meningitidis
ASEDGSRSPYYVQADLAYAAERITHDYPQATGADKDKISTVSDYFRNIRAHSIHPRVSVGYDFGGWRIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSVGLGVIAGVGFDITPKLTLDTGYRYHNWGRLENTRFKTHEVSLGMRYHF

SEQ ID NO: 13309 - protein, 230 aa, Neisseria meningitidis
ASEDGSRSPYYVQADLAYAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSVGLGVIAGVGFDITPKLTLDTGYRYHNWGRLENTRFKTHEVSLGMRYHF

SEQ ID NO: 13310 - protein, 235 aa, Neisseria meningitidis
ASEDGSRSPYYVQADLAYAAERITHDYPQATGANNTSTVSDYFRNIRTHSIHPRVSVGYDFGDWRIAADYASYRKWNDNKYSVNTKNVQVNKSNGNRQDLKTENQENGTFHAVSSLGLSAIYDFKLNDKFDKFKPYIGVRVAYGHVKHQVHSVESKTTIVTSKPTKGATQPGKLVSGPTPKPAYHESNSISSLGLGVIAGVGFDITPKLTLDTGYRYHNWGRLENTRFKTHEASL

SEQ ID NO: 13311 - protein, 241 aa, Neisseria meningitidis
ASEDGSRSPYYVQADLAYAAERITHDYPKASGANNTSTVSDYFRNIRAHSIHPRVSVGYDFGDWRIAADYASYRKWNNNKYSVNTKNVQVNKSNGNRQDLKTENQENGTFHASSSLGLSAIYDFKLNDKFDKFKPYIGVRVAYGHVKHQVHSVKKETTTTFLAPTGDAKVPGKIVEGPFSKPAYHESHSISSLGLGVIAGVGFDITPKLTLDTGYRYHNWGRLENTRFKTHEVSLGMRYHF

SEQ ID NO: 13312 - protein, 240 aa, Neisseria meningitidis
ASEDGSRSPYYVQADLAYAAERITHNYPEPTGADKDKISTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRLGLGVIAGVGFDITPKLTLDTGYRYHNWGRLENTRFKTHEVSLGMRYHF

SEQ ID NO: 13313 - protein, 448 aa, Pseudomonas aeruginosa
MQGDGKKRLWTLPLLLGAGVMASAVAEENAERSKEGFIEGSEVNLLLRNFYFNRDFRKGQSSPAGGGYTEEWVQGFMANFSSGFTQGTLGVGIDAFAQLGVRLDSGGGRSGAGGSVDLLPYDDQGRPQDDYSRAGGAVKLRWYGTVLRVGDVFPETPVIQYGNSRLFPSSFRGFTLVNDSLAKGLTLQAGKLNSMTQPNSTSGSDDFYSFYTGRRIDSPWVAYAGGDYQATEHWSVSLYGSRQKDAWDQYYAGTSFNYPLDDKLSLLGGANYYKVKDQGRQVMGELDNDIWSVRGGFAYGPHQVLLSYQRNNGDDDFDYLRQTDSIYLDNSIQYSDFNSPKERSLMLRYDLDMAAFGVPGLSFMTRYGKGWDADYSNANSVYMRTDANGNPLTNQGRWERDVEVKYVVQGGAAKDLAFRVRQATVRSDSFESDLDEVRLIVEYPLQIL

SEQ ID NO: 13314 - protein, 518 aa, Helicobacter pylori
MIKKNGTLFLSLALCASISYAEDDGGFFTVGYQLGQVMQDVQNPGGAKSDELARELNADVTNNILNNNTGGNVAGALSNAFSQYLYSLLGAYPTKLNSNDVSANALLSGAVGSGTCAAAGTAGGSTLNTQSACTAAGYYWLPSLTDRILSTIGSQTNYGTNTNFPNMQQQLTYLNAGNVFFNAMNKALEKNGTTNGASGTNGATGSDGQTYSQQAIQYLQGQQNILNNAANLLKQDELLLEAFNSAVAANIGNKEFNSAAFTGLVQGIIDQSQLVYNELTKNTISGSAVNSAGINSNQANAVQGRASQLPNALYNAQVTLDKINALNNQVRSMPYLPQFRAGNSRSTNILNGFYTKIGYKQFFGKKRNIGLRYYGFFSYNGASVGFRSTQNNVGLYTYGVGTDVLYNIFSRSYQNRSVDMGFFSGIQLAGETFQSTLRDDPNVKLHGKINNTHFQFLFDFGMRMNFGKLDGKSNRHNQHTVEFGVVVPTIYNTYYKSAGTTVKYFRPYSVYWSYGYSF

SEQ ID NO: 13315 - protein, 745 aa, Helicobacter pylori
MTQSLDLLPSPHRRASRPAAAPRTLVRSLSAAAATLCTLGAATAAHAQQAAATGGAPAAEATLAPVTVSADGQQENPVNPVAGFVARRALSATKTDTPLIETPQAISVVTRDQMEAQGAQTLRQTTAYTAGMVSNYFDSRVDSFKARGGDVTQYLDGLLRIYGTYNNIKADPYLLERVEFLRGPSSVLYGQGSVGGVLNLTSKRPQAEPLREVQVQLGNYARKQITADLTGPLTQDGQWLYRLVAVGRDSDSQVDHVGDDRQVFAPTLTWKPSAATSLTLQFTHQKDRSGSLIGFFPWQGTQLPSPHGQIPTSAFISEPGWDAYDSENNSWGYLFSHQLNGAWTLRQNLRRTVSDVDYRSMYTSFTANRATGRPARPVFEADNRTLLRDASWQRNASRLLMVDTQLEGRLRAGATEHTLLFGMDAQRNTTSQSSWLKTVSGIDVYAPVYGNFTPPSESDLARQPGVRQRQMGFYAQDQIRWNRWTATLGLRHDRARTDTEGRPAAAVDDSAWTKRLGATYQMDGGWAPYLSYSESFQPLGGVDFYGTPFKPQRGQQWEAGVKWQPEGRGISAYAAIYQVREKNRKTTDPANPRNNLQIGETKARGLEAELTASIARSWDATLAYAYTDTEISRSNAGDQGQPVAGVPKHTASAWLSHRFGTGGRGQWTVGGGLRYTGSQWTGTTAITTPSSTIADAMVAYDAGDWRLAFNVVNLADKVQVTQCLARGDCFYGQRRTYMLTSTYRF

SEQ ID NO: 13316 - protein, 243 aa, Neisseria meningitidis
AAQAASEDSSRSPYYVQADLAYAAERITHDYPKATGANNTSTVSDYFRNIRAHSIHPRVSVGYDFGGWRIAADYASYRKWNNNKYSVNTKELENKHNNKKDLKTENQENGTFPAASSLGLSAIYDFKLNDKFDKFKPYIGVRVAYGHVKHQVHSVESKTTIVTSKPTKGATQPGKLVSGPTPKPAYHESNSISSLGLGVIAGVGFDITPKLTLDTGYRYHNWGRLENTRFKTHEASLGVRYRF

SEQ ID NO: 13317 - protein, 256 aa, Neisseria meningitidis
PPKTFSSLLFSSLLFSSAAQAASEDSGHGPYYVQADLAYAAERITHDYPKATGANNTSTVSDYFRNIRAHSIHPRVSVGYDFGDWRIAADYASYRKWNNNKYSVNTKELENKHNNKKDLKTENQENGTFHAASSLGLSAIYDFKLNDKFKPYIGARVAYGHVRHSIDSTKKTTEVVTSTHGGADTKPTIYNGESTQNAYHESHSIRRLGLGVVAGVGFDITPKLTLDTGYRYHNWGRLENTRFKTHEVSLGMRYHF

SEQ ID NO: 13318 - protein, 259 aa, Neisseria meningitidis
PKNLLFSSLLFSSLLFSSAAQAASEDSSRSPYYVQADLAYAAERITHNYPEPTGADKDKISTVSDYFRNIRAHSIHPRVSVGYDFGDWRIAADYASYRKWKESNSSTNAENRDNAKNYVKIETKHQGNGSFHAASSLGLSAIYDFKLNDKFKPYIGARVAYGHVKHQVHSVETKTTTVTSKPTATSPQGGPIIQTDPSKPPYHESHSISSLGLGVIAGVGFDITPKLTLDTGYRYHNWGRLENTRFKTHEVSLGMRYHF

SEQ ID NO: 13319 - protein, 979 aa, Neisseria meningitidis
PKIAETVKTAKTLEREQANNIKDIVKYETGVTVVEAGRFGQSGFAIRGVDENRVAITVDGVAQAETLSSQGFKDLFEGYGNFNNTRNGIEIETLSDAKITKGADSLMSGSGALGGSVIYKTKDARDLLLNKNYAFKYKTGFTSENDERLNSITFAGKASIFDVLAVGTWRNGHEIKNYDYKSADDILGKLREKTDPYNKKDRSLLLKIGTNLGENNRIAVAYDRRRVENKGLDKSYSLHGCTKYVCDDNEIDTRHTHDESIRTSKSIAFENTNINPLWDTLKLSYTDQSITQRARSDEHCDGERCPGVQNPIGLHYNNDNKLVDKNNNPVTYKLENSSVTYYSYIDESTFNQYSYFKEEVPADLAKKWKLKKQYDGKYYIESRLCFKDHDDTNHAGMCRLRSDVKEEKETLVANNITYDLKKEHFINSRLTNSDNLLSCDGINCDKNTIQGFKADGTPKDLPIKIIQKEGKKFALIEKILDENGYNIGPEKASRFLVPNSPGYNRNIWKKRDLDTRTQQINLDLTKHFELGKSQHDLSYGLVWSKTTKSMINKEGLKVNSGKWWIDYPKDCESSTSDLCTKNSTASFLIPVETKDGSLYFKDEFRVNDRLGLDIGYRYDKVKYKTNYQPGITPKIPDDMLVNLFIKEPFVKNTRSLNPNDPNEINRRKNAEANINYISQPKKFNASSYALSTKFDPLDWLQVQAKYSKGFRAPTADELYFTFKHPEFTVLPGSKLKPEIAKTKELSLTLHDDEIGFISGGYFITNYNNFIDLSYLGTKSFGSQATKHELYQSVNLDNAKVTGFELKTKFTLGKWISWLKNVDFGYQLTKQKGKASDNRPLNAIQPMTQVMSLAYTHPDNLFGANLYLTHVSQKEASDTYNIYSKDATAGDKEYVQNKHIKWRSKAYTVTDFTFFVKPMKNLTLRAGVYNLFDKKYMTWDSARSIRMFGTSNLINQETGAGINRFYAPGKNYRMSVQFEF

SEQ ID NO: 13320 - protein, 1033 aa, Pseudomonas putida
MIKRRNIQLSRFVALVMCFAGNVALAQGTSVLLGKIVDSATGAPLADAVITATSPNLQGEQVVLSDASGEYRIPQLPPGLYTLRFERDAFQPFVRDGIALRLDSSLRVNVELLPDGFVEEIAVVARAPTVDVGSASTGININESFIRNIAVVVPGGKGAAARSFEALAELAPGAHADTYGVSISGATSPENQYVLDGVSVNDPGFGINGSQLSVEFIREVNVISGGYLPEYGRATGGVLNAVTKSGSNEFHGSVFGNLSPGSLASSGREIQRTAGTVSGRSRLWNQGDFGADLGGPILKDKLWFYLGMAPSFSRFRLERNLDSIELGADGQPLRDEDGLVRTQRIPGSQRFFFADNRAFQYIGKLTYLVDSNHNLTVSVSGTPSTAGGPGRFSVSDRTGMSETDLINGLPESIATQKVNSSTDASLKWSSSFWDKRLLVDATLGWHHQEVSTRASDGTRAGSLEGLAGTPYVYWQRSPAHSVLEFESVADPSACGGTAEEARTRCPVQAYSTGGPARLSEADMDRFQGKLMGTLLLKAAGEHIVKAGMDMDRSGFDHVRAHGGGSMISESEDGTYFQDFHQYGYLLGPDQVQVLDSLHSVSHSTTVGAFVQDSWNVLDLVTVNVGLRYDTQTLEGNGKVGLILANQWSPRLGLIVDPTREGRSKLFVNYARYYEAVPLDLVDRSLSGEPQVRSHMDSSLCNPLEPGQLQGVCDTDAARLPFRDPLDPSRRWQTVGSGFTLVDPEIKPQSVDEFVVGGEYEVFPQTRAGLSYNRRSLNMVIEDMSRDGGLSYFVGNPGYGFAEKFTKPKRNFDAVTFFLQRNFSEGWLAQASYTWSSLRGNFEGLFRSDSGQLDPNINSDFDLISLLPNRNGPLPADRKHQIKVFGSREFNLSREVSLNLGLSYRGNSGTPYSYLGAHELYGPGEAYILPRGSAGRLPWVHRVDSRLAVSWKFTREVAAQVSLDVFNLLDLKTAVTYDQHYTYAAIRPIENGTPADLASLVDVKGRPVAVNQNFGKPLAYQAPRSARLGMRVSF

SEQ ID NO: 13321 - protein, 776 aa, Pseudomonas sp. Y2
MFCAPIQLFRGFGLFLVLLVLCSSLVGAGDLEEMTLGELLKQHPELYRDSDTASGVSEALRDAPASMVVLRQKDFRRRGYDSLDDLLFGLPGFDVIRTGGTMETVAYQRGYRTPWTQRTLLLVNGKPDNNLWNHGAQISRQYPIGAIDRVETLYGPAGAVYGPNAFLGVINIITRDASELEDGETYFEISGALGSYDTQNLDTAFGGRWGEVSFDIGFNYFNSDEAGIEDYSDWGYTDPSLLSNPAAWGAGIGAGADPATGRFSPAGDLDVDGFVEEDELVRGSPIGEYADPTEDYGFIGELRFSGTTFGAIVWETNEGYGPYYSFLDGQPNSLWTHSSRQYYIEREDWLIDEAVRVESELVYRESRVGGEEWAESFGGFVSLSDWNSFNKAWRLEQRFTFSKTDDLQFNGGWKYEFKRLNRAYILSNYWDGLGVAVGESSVQAAADVSSESPMRLSEDIDDRYAPDFNASDTDDIGIYAQMIYDRGDLRFNGSLRWDENSAYGSDYSPRGALIYHKDAETTFKLVYGEAFQEPSPKDLYGAYAGRTSNSALRPEKVYTTEFVAILQHERFQHDFSVYHSEFQNAIATGQNVGGRDVVGFEYKNSFRVENPISGSAAISGNLFYTYTRSVSDQQYENATGTWVDQRAAQGDVAPHKVNLNLNIPIGKKLNANFSGLWVGERKLFSENPLRADSNSERSLDRKAEAYSLVDLNLLYSFGDYSVSFKVENLFEEDYLVPGVESAASGDDFTVDRDGFQNSLIPQVKERKYTLRVSFDL

SEQ ID NO: 13322 - protein, 165 aa, Salmonella typhimurium
MKKIVVAVLVGLALGSIGVANAAGYKNTVSIGYAYTDLSGWLSGNANGANIKYNWEDLDSGFGAMGSVTYTSADVNNYGYKVGDADYTSLLVGPSYRFNDYLNAYVMIGAANRHIKDNWGNSDNKTAFAYGAGIQLNPVENIAVNASYEHTSFSTDADSDVKAGT

SEQ ID NO: 13323 - protein, 928 aa, Shewanella sp. SCRC-2738
MSMFKPSILTLALAAAGITSFAATAAEEKQLKNDDVEVIEVKGFRGSIVESINTKRFSPEVVESISAEDIGKLPDSSIAESIARLPGLTAQRLDGRASRVSVRGFSENESATTFNGREQVSIGDNRGVEFDLYPSEIMSGVTVYKTPSASIEAEGIAGVIDMQTVKPLSKGERVIMFNGQLEQTGFGKLNPDGDDQGYRGTVSYIDQFADDTIGVAFALNTMSSPNQEKRWNSWGYPEFTTEDGQSYSILGGAKPYVRSSTLERDSAMLVLEAAPTDKLNMTFDALYIDFSDEQILRGIEIPFAWGQGSISSDSTTVDAETGFITSAVTEGQRVVVRNDHQERKAELTQFGFNAKYDINDSWSTEFDISRSEVERQLWSIESYSGTGRGDANGVADNIGYMLDGGNTGAQFSHELDYSDYNLIQLGGPLSWGGSKALNDKYGLTDTPFQNTAQDGFINAPEVNDELTTLKLAATKILDNEYVNAVKFGMSYRDREKSKLSEGYFLTLKDFSLSNPGMVSVPEQYRLGSASLDFIGMGDMIAYDTRALINDGYYDLLQESLTDQKHKTQSWTVQEKVTAFFVQADINAEIGSIPVTGNVGVRYVKTEQSSQGSAANTVDGLVVVTPTDVSHDYSHVLPSINLSFAIDEEQTLRFGAAKTISRALLNDMNASINASYGQQPDDNGNFWSISGGNPKLEPKEATGFDISYENYFNAEGYFSAAVFYKDINQWIFDGTYAVDMSGVANPATGEIPATSSGTGNGKVNGGGGDLWGYELSLALPFNVFHSSLDGFGLIASHTGIEQDVEDQNGNEYELVGLSDQIDSLTVYYERNGFQARTSMRKRSDFKGNVNGLGLAATQVDIKGETIWDAQLGFDFGEAGVDSLDGLNVTFQVQNITEEPFTTLSGDNALQVRDYQDYGRTFLLGFSYKL

SEQ ID NO: 13324 - protein, 301 aa, Helicobacter pylori
EVKLSGDARMGVMYNGDDWNFSSRSRVLFTMSGTTDSGLEFGASFKAHESVGAETGEDGTVFLSGAFGKIEMGDALGASEALFGDLYEVGYTDLDDRGGNDIPYLTGDERLTAEDNPVLLYTYSAGAFSVAASMSDGKVGETSEDDAQEMAVAAAYTFGNYTVGLGYEKIDSPDTALMADMEQLELAAIAKFGATNVKAYYADGELDRDFARAVFDLTPVAAAATAVDHKAYGLSVDSTFGATTVGGYVQVLDIDTIDDVTYYGLGASYDLGGGASIVGGIADNDLPNSDMVADLGVKFKF

SEQ ID NO: 13325 - protein, 143 aa, Helicobacter pylori
EVLYQFAPKYEKPTNVWANAIGGASLNSGGNTSLYGTSAGLDAYLNENVEAIVGGFGSYGYSSFNNQSNSLNSGANNANFGVYSRIFANRHEFDFEAQGAVGSDQSSLNFKSALLRDLNQSYNYLRYGAATSASYGYDFAFFR

SEQ ID NO: 13326 - protein, 1294 aa, Helicobacter pylori
MELQQTHRKINRPLVSLALVGLLVSITPQKSHAAFFTTVIIPAIVGGIASGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTTSQSGAKSDKNESAKNDKQESSQNNSNTQVINPPNSGQKTEIQPTQVIDGPFAGAKDTMVNINRINTNADGTIKVGGYTASLTTNAANLDIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYDNVSLGTNSISNANLIEQFNERLALYNNNNRMDTCVVRNTDDVKACGMAIGNQAMVNNPDNYKYLIGKAWKNIGISKTANGSKISVRYLGNATPADPTDLPKNAENSTEKPLNNALLARSAFSTQPNATPNLVAINKHNFGAIESVFELANRSKDIDTLYAKSGAQGRDLLQTLLIDSHNAGYARTMIDATSANEITKQLNEANSALNNIASLEHKTNGLQTLSLSNAMILNSRLVNLSRRHTNNIDSFAQRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNALSLNTFKVNAARNPLNTHARVMMGGELKLAKEVFLNLGFIYLHNLISNAGYFASNLGMRYSF

SEQ ID NO: 13327 - protein, 1290 aa, Helicobacter pylori
MEIQQTHRKINRPLVSLALVGALVSITPQQSHAAFFTTVIIPAIVGGIATGTAVGTVSGLLSWGLKQAEEANKTPDKPDKVWRIQAGKGFNEFPNKEYDLYRSLLSSKIDGGWDWGNAARHYWVKGGQQNKLEVDMKDAVGTYKLSGLRNFTGGDLDVNMQKATLRLGQFNGNSFTSYKDSADRTTRVNFNAKNISIDNFLEINNRVGSGAGRKASSTVLTLQASEGITSGKNAEISLYDGATLNLASNSVKLMGNVLMGRLQYVGAYLAPSYSTINTSKVVGEVNFNHLTVGDRNAAQAGIIASKKTYIGTLDLWQSAGLNIIAPPEGGYKDKPNNTNSQSVGKSDKNESAKNDKQDSNTQVINPPNSGQKTEIQPTQVIDGPFAGAKDTVVNINRINTNADGTIRVGGYTASLTTNAAHLHIGKGGVNLSNQASGRSLLVENLTGNITVDGPLRVNNQVGGYALAGSSANFEFKAGTDTKNGTATFNNDISLRRFVNLKVDAHTANFKGIDTGNGGFNTLDFSGVTGKVNINKLITASTNVAVKNFNINELIVKTNGVSVGEYTHFSEDIGSQSRINTVRLETGTRSIYSGGVKFKGGEKLVINDFYYAPWNYFDARNIKNVEITNKLAFGPQGSPWGTSKLMFNNLTLGPNAVMDYSQFSNVTIQGNFINNQGTINYLVRGGKVATLNVGNAAAMMFNNDIDSATGFYKPLIKINSAQDLIKNTEHVLLKAKIIGYGNVSTGTNGISNVNLEEQFKERLALYNNNNRMDTCVVRNTDDIKACGMAIGNQSMVNNPDNYKYLIGKAWRNIGISKTANGSKISVYYLGNSTPTENGGNTTNLPTNTTNNARSANYALVKNAPFAHSATPNLVAINQHDFGTIESVFELANRSKDIDTLYTHSGAQGRDLLQTLLIDSHDAGYARQMIDNTSTGEITKQLNAATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLQDLNQSYNYLAYSAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 13328 - protein, 1287 aa, Helicobacter pylori
MEIQQTHRKINRPLVSLALVGALVSITPQQSHAAFFTTVIIPAIVGGIATGTAVGTVSGLLGWGLKQAEEANKTPDKPDKVWRIQAGKGFNEFPNKEYDLYKSLLSSKIDGGWDWGNAATHYWIKGGQWNKLEVDMKDAVGTYKLSGLRNFTGGDLDVNMQKATLRLGQFNGNSFTSYKDSADRTTRVDFNAKNILIDNFLEINNRVGSGAGRKASSTVLTLQASEGITSSKNAEISLYDGATLNLASNSVKLNGNVWMGRLQYVGAYLAPSYSTINTSKVTGEVNFNHLTVGDHNAAQAGIIASNKTHIGTLDLWQSAGLNIIAPPEGGYKDKPNNTPSQSGAKNDKQESSQNNSNTQVINPPNSTQKTEVQPTQVIDGPFAGGKDTVVNIDRINTKADGTIKVGGFKASLTTNAAHLNIGKGGVNLSNQASGRTLLVENLTGNITVDGPLRVNNQVGGYALAGSSANFEFKAGVDTKNGTATFNNDISLGRFVNLKVDAHTANFKGIDTGNGGFNTLDFSGVTNKVNINKLITASTNVAVKNFNINELIVKTNGVSVGEYTHFSEDIGSQSRINTVRLETGTRSIFSGGVKFKSGEKLVIDEFYYSPWNYFDARNIKNVEITRKFASSTPENPWGTSKLMFNNLTLGQNAVMDYSQFSNLTIQGDFINNQGTINYLVRGGKVATLNVGNAAAMMFNNDIDSATGFYKPLIKINSAQDLIKNTEHVLLKAKIIGYGNVSTGTNGISNVNLEEQFKERLALYNNNNRMDTCVVRNTDDIKACGMAIGNQSMVNNPDNYKYLIGKAWKNIGISKTANGSKISVYYLGNSTPTENGGNTTNLPTNTTNNARFASYALIKNAPFAHSATPNLVAINQHDFGTIESVFELANRSKDIDTLYANSGAQGRDLLQTLLIDSHDAGYARTMIDATSANEITKQLNTATTTLNNIASLEHKTSSLQTLSLSNAMILNSRLVNLSRRHTNNIDSFAKRLQALKDQRFASLESAAEVLYQFAPKYEKPTNVWANAIGGASLNNGGNASLYGTSAGVDAYLNGQVEAIVGGFGSYGYSSFNNQANSLNSGANNTNFGVYSRIFANQHEFDFEAQGALGSDQSSLNFKSALLRDLNQSYNYLAYSAATRASYGYDFAFFRNALVLKPSVGVSYNHLGSTNFKSNSTNKVALSNGSSSQHLFNASANVEARYYYGDTSYFYMNAGVLQEFANFGSSNAVSLNTFKVNATRNPLNTHARVMMGGELKLAKEVFLNLGVVYLHNLISNIGHFASNLGMRYSF

SEQ ID NO: 13329 - protein, 387 aa, Neisseria meningitidis
MRKKLTALVLSALPLAAVADVSLYGEIKAGVEGRNYQLQLTEAQSANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRH

SEQ ID NO: 13330 - protein, 387 aa, Neisseria meningitidis
MRKKLTALVLSALPLAAVADVSLYGEIKAGVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQWLTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHK

SEQ ID NO: 13331 - protein, 395 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGERLNAVWQLEQHVSVAGGGATQWGNRQSFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 13332 - protein, 214 aa, Neisseria meningitidis
DFSGFSGSVQFVPIQNSKSAYTPAYYTKDKNDKLTLVPAVVGKPGSDVYYAGLNYKNGGFAGNYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 13333 - protein, 192 aa, Neisseria meningitidis
EFSGFSGSVQFVPAQNSKSAYKPAYYTKDTNNNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKR

SEQ ID NO: 13334 - protein, 132 aa, Neisseria meningitidis
EFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVS

SEQ ID NO: 13335 - protein, 214 aa, Neisseria meningitidis
DFSGFSGSVQFVPIQNSKSAYTPAYYTKDKNDNLTLVPAVVGKPGSDVYYAGLNYKNGGFAGNYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDFIERGKKGENTSYDQIIAGVDYDFSKRTSAIVSGAWLKRNTGIGDYTQINAA

SEQ ID NO: 13336 - protein, 178 aa, Neisseria meningitidis
ISEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTQEIKLYAGARYFGSYGANFGKTAKDDGVI

SEQ ID NO: 13337 - protein, 217 aa, Neisseria meningitidis
EFSGFSGSVQFVPAQNSKSAYKPAYWTTVNTGSATTTTTTFVPAVVGKPGSDVYYAGLNYKNGGFAGNYAFKYARHANVGRDAFELFLLGSGSDQTKGTDPLKNHQVHRLTGGYEEGGLNLALAAQLDLSENGDKTKNSTTEIAATASYRFGNAVPRISYAHGFDFIYRGKKGENTSYDQIIAGVDYDFSKRTSAIVSGAWLKRNTGIGNYTQINAA

SEQ ID NO: 13338 - protein, 104 aa, Neisseria meningitidis
DFRLAIKSGTPRARHHIKNTISTGDTKANGGQLGVSVPLGAGSILASYAYTKTSGAADVKRNTWAIGYDYALSKRTDLYAADFRDKVTSLSTADTLGVGMRAKF

SEQ ID NO: 13339 - protein, 515 aa, Shigella flexneri
IGSHDYQRLAADLNGEVNQQVQVRLNIAQEDYGSFRHGVEGKRTLLAPSLNWDINDDVSWLIQYEQHSHNRVPDRGIPAVNGSPAEVPASSVYSDTSRDFIDDDVATTRSRITWAFHPEWQLRQQLSYTKLDSQFDNTYVARVSGDQVTRQRFQQDLQANNLISNTETEGTFNTGPIAHRILIGLEQGWQERSPKLYRNANSIPSGNLYQPESLPTYNGPMSVFSDATHKVRSYGIYVQDQLQWGDWIVLAGLRHDDFTVTTHRHDTNKEETISSNSLSPRLGVVWTPVQEHALYASYSQTYSPVGGGVIGITPGDKHNHLDPEHSRLYETGVKSDWLEGRISTTLSVYRLEMYNRRMRDPNDQERIILTGLQRTDGIELSSRALLTDEFSLRGGIGLQDAKYVEADASEQGKRPTNVSRLNGELLVAYQSASDGWFGETGFVAVGDRYADRTNTTKLPGYARFDARLGYQWQAWRTQLSVENLLDKDYYLSATSSTQIQPGAPREFYLTASYQF

SEQ ID NO: 13340 - protein, 191 aa, Helicobacter pylori
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 13341 - protein, 238 aa, Neisseria meningitidis
ASEDGSRSPYYVQADLAYAAERITHDYPKASGANNTSTVSDYFRNIRAHSIHPRVSVGYDFGDWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRLGLGVIAGVGFDITPKLTLDTGYRYHNWGRLENTRFKTHEVSLGMRYHF

SEQ ID NO: 13342 - protein, 791 aa, Helicobacter pylori
MFLRSYPKLRYALCLPLLTETCYSEERTLNKVTTQAKRIFTYNNEFKVTSKELDQRQSNEVKDLFRTNPDVNVGGGSVMGQKIYVRGIEDRLLRVTVDGAAQNGNIYHHQGNTVIDPGMLKSVEVTKGAANASAGPGAIAGVIKMETKGAADFIPRGKNYAASGAVSFYTNFGDRETFRSAYKSAHFDIIAYYTHQNIFYYRSGATAMKNLFNPTQADKEPGTPSEQNNALIKMNGYLSDRDTLTFSWNMTRDNATRPLRSNAIGLAYPCEAPFSPDGAQGCPNVLDSFTRYMYHSINSANNFSLQYKREAGNSFGDPRLDFTLYTSIRNAQFDPLFDPNGVYAKFPTSQATAWEKENYPCVEGGYCTPSFSDVDKPSSQPRNLFLNNTGLNLKVAHVIDEATDSLFEYGFNYQNLSVFDARIPKSELYRPNQVYTDDKGQKQIACSLVDNNPNDPTLCQRGKANGNIYGGYVQANYSPHKIITFGAGVRWDAYTLYDKDWNHRYTQGFSPSAALVLSPIEPLSLKITYSQVTRGVMPGDGVYMRQNDLRYAKNIKPEVGSNAEFNIDYSSQYFSGRAAAFYQALDNFISQYAQSLIVTNLNQAIRIYGYEVGGTFRYKGVSLNVGISRTWPTTRGYLMADSYELAASTGNVFIIKLDYTIPKTGINLAWLSRFVTGLDYCGFDIYLPDYGTAEKPKTPTDLAKCGSQLGLVHMHKPGYGVSNFYINWSPKTKSRWKGLLLSAVFNNVFNKFYVDQTSPYVMSPDMPGTDAVKRAIAEPGFNARFEVAYKW

SEQ ID NO: 13343 - protein, 706 aa, Helicobacter pylori
MKKTLLLSLSLSFLLHAEDDGFYTSVGYQIGEAAQMVTNTKGIQELSDNYEKLNNLLNNYSTLNTLIKLSADPSAINDARDNLGSSSRNLIDVKTNSPAYQAVLLALNAAVGLWQVTSYAFTGCGPGSNESANGGIQTFNNVPGQNTTTITCNSYYEPGKDSTISTANYAIINKAYQIIQKALTANRANGDGVPVLSNTTTKLDFTIQGDKRTGATPNEKLIYSWSHGKAISTSWNRGTLTQTSESINTENNAQELLKQASIIITTLNEACPNFQNGGRGYWQGISGNGTMCGMFKNEISAIQGMIANAQEAVAQSKIVSENAQNQNNLDTGKPFNPYTDASFAQSMLKNAQAQAEILNQAEQVVKNFEKIPKNFVSDSLGVCYEVQGGERRGTNPGQVTSNTWGAGCAYVEQTITNLTNSITHFGTQEQQIQQAENIADTLVNFKSRYSELGNTYNSITTALSSIPNAQSLQNAVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKDSDHAAQHGIELGLKIPTINTNYYSFMGAELKYRRLYSVYLNYVFAY

SEQ ID NO: 13344 - protein, 351 aa, Aggregatibacter actinomycetemcomitans
MKRSYTDLEANNVVIVQAKDFNEDILKANNNAGALLLKFASDYISTSVQGKDPLEAGTVLDITDDKYSGGLVDYKLSVQNCGGNKCLVINGGATAAAKNKLVQLQVDIDTIDKLLKNEFDSSQDEEWKQAKEALEKQKTELQTMLEEAEKNGGKIDDEKYIDLVNKNSNLNLSANDKASILALRSITEQLGSIGADLASREGVKLALQIKKDTDNTGKSVSNLNSASSAVNTTMNISNDVSIGSRVAMLNNPFGTYASKMNGLKFAALDSDMRPSYVNEYTNSVWANAFGGANIIDGDSGAMHGATIGVDKQANDDVLWGVYFTYANAKIKDNNLEQKSDNFQLGMYLLSI

SEQ ID NO: 13345 - protein, 785 aa, Pseudomonas putida
MNLVAQTKTETAMDANRRASRRGSLRTMTAAVLLSSTSQACLAQSATPGSTITLEPVVVEAPRQPVRSVVRQRSPAPRSAATVMPAATPSLALLADVVRQRFEILPGGVALVSRQDMANRGNPTLANSLSGVPGLIVQNFLGSNDQPRIQMRGSAQQNPAERGVLVLSNGLPINRADGSYIIGFANAQQAESIEVYRGYMANRLGATVLSGAINFVSPTGSSQPGTQIGVSGGSFGQINSSGQVGGKKDNVDAFIQFDTSRRDGYRGYNSSERVSVNGNVGVALSENVKTRFFMGYTDLGFDVPGPVNKTTLYANPKQVNPGPTVVGGVAVNPGPNAVRDKPRREASQFMVGNRTTAVFDAHLFDVAMGYIYTDDTFRFPISSGVRTTQGGDFTGVARYAYNPAAALLPLFETTAQYTVGSADRGYYLNQSGQTGAQFGANRLNAQTLSLYTGANIPVWHQLVVSPSISYAYATRDNDDVYGSARRPTIAYNPANPTVLLPNGSVATQSTSYSRNYSGWSPSLALSYRPDAVQTFFIAGSHSFEPPTHDDLIATINGTPNSSPGRPTPGNPSLAAAAFATPNLSAQTANTVEGGWRGRADRFSWDVVTYYSWVDNELLTLRDVTGALLGAVNADRTTHFGVELGAGMKFTDRLSGRIAYTYQDFRFVDDPSRGNNRLGGVVPHLIYAQLQLQATDAWMVQGAVRWSPAEVAVDNMNTLFADPYAVVDLRSEYQIDKTFRVFGEITNLFDKTYAATTLVVDQATASQAAFLPADGRGFYAGIKAKF

SEQ ID NO: 13346 - protein, 348 aa, Neisseria gonorrhoeae
MKKSLIALTLAALPVAATADVTLYGVIKAGVQTYRSVEHREGKVVGVVTSSEISDFGSKIGFKGQEDLGNGLKAIWQLEQGASVAGTNSGWGNKQSFIGLKGGFGTIRAGSLNSPLKNTGSKVNAWESGKFTGNVLEISGMAEREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADYDHTYDQVVVGAEYDFSKRTSALVSAGWLQEGKGADKIVSTASAVVLRHKF

SEQ ID NO: 13347 - protein, 326 aa, Neisseria gonorrhoeae
MKKSLIALALAALPVAAMADVTLYGTIKVGVETSRSVDHTGRANRVKTATEIADLGSKIGFKGQEDLGNGLKAIWQLEQKAYVSGTNEGWDNRQSFIGLKGGFGKVRVGRLNSVLKDTGGFNPWEGKSDYLSLSNIAEPEARHISVRYDSPEFAGFSGSVQYELNDNSNKYNSESYHAGFNYKNSGFFVQYAGAYKRHHYATEKHQIHRLVGGYDHDALYASVAVQQQDAKLALIDDNSHNSQTEVAATVAYRFGNLTPRVSYAHGFKGLVDHADLSNDYDQVVVGAEYDFSKRTSALVSAGWLQEGKGAEKFVSTAGVVGLRHKF

SEQ ID NO: 13348 - protein, 387 aa, Neisseria gonorrhoeae
MKKSLIALAALGAFAGAAQAQSSVTLYGVVDANIEYVNNVGVVPVATNGFNRGPAHSVTRMDPGGLSGSRWGLRGTEDLGGGLKALFVLESGFSSDTGGLQQSGRLFGRQSFVGLQSDRIGQFTFGRQYVSMFDALANFSPTAYATQYEPVVLQQGPNYREDNTIKYTGKFGPITAGAHWSFGTGVALPATVGVATPIGGNGEVPGAFRRDTGYGAAVTYLAGPFGATVGYDQWNPTIGTGNGTVKKASAAASYSYGPAKIMGGYRWGQQKNAADVLIQRDDFYWIGANYQVTPAVGLTLEYNYDNIKSLFGDTHVANPWQIAFIATYSFSKRTDVYLSTAYAKNAGLTMESLATTYATSLSLGQSYALANGQSSMFGAAIGIRHKF

SEQ ID NO: 13349 - protein, 326 aa, Neisseria gonorrhoeae
MKKSLIALALAALPVAAMADVTLYGTIKVGVETSRSVDHTGRANHVKTATEIADLGSKIGFKGQEDLGNGLKAIWQLEQKAYVSGTNEGWGNRQSFIGLKGGFGKVRVGRLNSVLKDTGGFNPWEGKSDYLSLSNIAEPEARHISVRYDSPEFAGFSGSVQYELNDNSNKYNSESYHAGFNYKNSGFFVQYAGAYKRHHYATEKHQVHRLVGGYDHDALYASVAVQQQDAKLALIDDNSHNSQTEVAATVAYRFGNVTPRVSYAHGFKGLVYHADLSNDYDQVVVGAEYDFSKRTSALVSAGWLQEGKGAEKFVSTAGVVGLRHKF

SEQ ID NO: 13350 - protein, 348 aa, Neisseria gonorrhoeae
MKKSLIALTLAALPVAATADVTLYGAIKAGVQTYRSVEHREGKVVGVGTGSEISDFGSKIGFKGQEDLGNGLKAVWQLEQGASVAGANSGWGNKQSFVGLKGGFGTIRAGSLNSPLKNTDANVGAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEYDFSKRTSALVSAGWLQEGKGADKIVSTASAVVLRHKF

SEQ ID NO: 13351 - protein, 326 aa, Neisseria gonorrhoeae
MKKSLIALALAALPVAAMADVTLYGTIKVGVETSRLVDHTGRANRVKTATEIADLGSKIGFKGQEDLGNGLKAIWQLEQKAYVSGTNEGWGNRQSFIGLKGGFGKVRVGRLNSVLKDTGGFNPWEGKSDYLSLSNIAEPEARHISVRYDSPEFAGFSGSVQYELNDNSNKYNSESYHAGFNYKNSGFFVQYAGAYKRHHYATEKHQIHRLVGGYDHDALYASVAVQQQDAKLALIDDNSHNSQTEVAATVAYRFGNLTPRVSYAHGFKGLVDHADLSNDYDQVVVGAEYDFSKRTSALVSAGWLQEGKGAEKFVSTAGVVGLRHKF

SEQ ID NO: 13352 - protein, 194 aa, Wolbachia sp. wAlbA
SYYIRLQYNGEFLPLFTKVDGITYKKDKSDYSPLKPSFIAGGGAFGYKMDDIRVDVEGVYSYLNKNDVKDVVFTPADTIANSLTAISGLVNVYYDIAIEDMPITPYVGVGVGAAYVSTPLKTAINNQNSKFGFAGQVKAGVSYDVTPEVKLYAGARYFGSFGAHFDSETTGADNKKVVTKDAYKVLYSTVGAEA

SEQ ID NO: 13353 - protein, 162 aa, Wolbachia sp. wAlbB
  misc_feature (152)..(152): Xaa can be any naturally occurring amino acid
  misc_feature (154)..(154): Xaa can be any naturally occurring amino acid
SYYVRLQYNGEVLPFKTRIDGIEYKKGAEVHDPLKASFMAGGAAFGYKMDDIRVDVEGLYSQLNKNDVSGATFTPTTVANSVAAFSGLVNVYYDIAIEDMPITPYVGVGVGAAYISNPSEADAVKDQKGFGFAYQAKAGVSYDVTPEIKLYXGXRYFGSYGA

SEQ ID NO: 13354 - protein, 199 aa, Wolbachia sp. wMel
DEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYKVLYSTVGAE

SEQ ID NO: 13355 - protein, 121 aa, Wolbachia sp. wMel
SDDPTAAGYIEYRYGKKLSFIGPVMGIMANTDGGVFGYGGFYADLKYRRLIVTPLATVGGYHQGGSKDLGGIFQFRTAITFAYQFDGDSRLGVRLSHISNAGLHDDNPGENEILLTYSLPL

SEQ ID NO: 13356 - protein, 223 aa, Wolbachia sp. wMelH
MHYKKFFSAAALATLLSLSNSAFSDPVGPISDEETSYYVRLQYNGEILPLFTKVDGIAHKSGKDNNSPLKASFIAGGGAFGCKMDDIRVDVEGPYSWLNKDADVVVDTVAESLTAISGLVNVYYDVAIEDMPITPYVGVGVGAAYISTPLATAVSSQSGKFAFAGQARAGVSYDVTPEVILYAGARYFGSYGANFDKTDKDGKGELKVIYSTVGAEAGVAFNF

SEQ ID NO: 13357 - protein, 237 aa, Wolbachia sp. wCof
MHYKKFFSAAALATLLSLSNSAFSDPVGPISDEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYKVLYSTVGAEAGVAFNF

SEQ ID NO: 13358 - protein, 230 aa, Wolbachia sp. wHa
MHYKKFFSAAALATLLSLSNSAFSDPVGPISDEETSYYVRLQYNGEILPLFTKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELKVLYSTVGAEAGVAFNF

SEQ ID NO: 13359 - protein, 182 aa, Wolbachia sp. wMa
  misc_feature (176)..(176): Xaa can be any naturally occurring amino acid
DEETSYYVRLQYNGEVLPFKTKIDGVKYKSGKDNNSPLKPSFLAGGGAFGYKMDDIRVDVEGLYSQLSKDADVVDTSPAVVESLTAFSGLVNVYYDIAIEDMPITPYVGVGVGAAYVSNPLVTEITGDKKSGFGFAYQAKAGVSYDVTPEIKLYAGARYFGSYGANFGKTAKDDGXIKVLYS

SEQ ID NO: 13360 - protein, 237 aa, Wolbachia sp.
MHYKKFFSAAALATLLSLSNSAFSDPVGPISDEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGATYISTPLEPAVNDQKSKFGFAGQVKAGVSYDVTPEVKLYAGARYFGSYGANFDGKKTDPKDSTRQVTDAGAYKVLYSTVGAEAGVAFNF

SEQ ID NO: 13361 - protein, 154 aa, Wolbachia sp. wUni
DEETSYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLF

SEQ ID NO: 13362 - protein, 158 aa, Wolbachia sp. wAus
SYYVRLQYNGEILPLFTKIDGITNVAGKEKDSPLKASFIAGGGAFGYKMDDIRVDVEGLYSQLNKDAGVAGTRVADNLTAISGLVNVYYDIAIEDMPIAPYVGVGVGAAYVSTPLKTAINNQNGKFGFAGQVKAGVSYDVTPEIKLYAGARYFGSYSA

SEQ ID NO: 13363 - protein, 196 aa, Wolbachia sp. wMors
SYYVRLQYNGEILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEA

SEQ ID NO: 13364 - protein, 185 aa, Wolbachia sp. wStri
SYYVRLQYNGEILPFYTKVDGITNATGKEKDSPLTRSFIAGGGAFGYKMDDIRVDVEGLYSQLAKDTDVVNTSETNVADSLTAFSGLVNVYYDIAIEDMPITPYVGVGVGAAYISNPLKAGVVKDQKGFGFAYQAKAGVSYDVTPEIKLFAGARYFGSYGASFDKAAKDDAGIKSVVYSTVGAEA

SEQ ID NO: 13365 - protein, 186 aa, Wolbachia sp. wVitA
SYYVRLQYNGEILPLFTKVDGITYKKGNSDYSPLKASFIAGGGAFGYKMDDIRVDVEGVYSYLNKNDVTDAKFTPGAIADSLTAISGLVNVYYDIAIEDMPITPYIGVGVGAAYISTPLATAVSSQNGKFAFAGQARAGVSYDVTPEVKLYAGARYFGSYGANFDKTDKDGKGELKVLYSTVGAEA

SEQ ID NO: 13366 - protein, 188 aa, Wolbachia sp. wPap
SYYVRLQYNGEFLPLFTKVDGATGAKKTADTATTTDLYKASFMAGGGAFGYKMDDIRVDVEGLYSQLSKDALAVAPTPAIADSLTAISGLVNVYYDIAIEDMPITPYIGVGVGAAYISTPLATAVSSQNGKFAFAGQARAGVSYDVTPEVKLYAGARYFGSYGANFDKTDKDGKGKLKVLYSTVGAEA

SEQ ID NO: 13367 - protein, 178 aa, Wolbachia sp. wCon
SYYVRLQYNGEILPLYTKVDGITYTSGQSPLKASFLAGGGAFGYKMDDIRVDVEGLYSQLAKDADVVSDNKAADSVTAFSGLVNVYYDIAIEDMPITPYVGVGVGAAYISNPSKVDAVRDQKGFGFAYQAKAGVGYDVTPEIKLYAGARYFGSYGASFNKETVSATTKEINVLYSAVG

SEQ ID NO: 13368 - protein, 182 aa, Wolbachia sp. wDei
SYYVRLQYNGEILPFYTKVDGVTNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKAAKDDTGIKNVVYSTFG

SEQ ID NO: 13369 - protein, 184 aa, Wolbachia sp. wOri
SYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCFGSYGANFGKTAKDDGGIKVLYSTVGAEA

SEQ ID NO: 13370 - protein, 988 aa, Ehrlichia chaffeensis
MENLAISFFERIKEQVTLRTIKYCILMAGFLCVCVPSLYGVENLNVTGKVVDSSGEPLIGVSIKVENKNMGTTTDINGNFTLADIPKNTVLVLTYIGMETQKVTVTQNRLNIVMRENSVQLEEVVAIGYGTVKKEELTSAVTKVGEESFNAGVTTSPINLLNGKVPGLSIRNTSGNDPNASPEIHLRGIGSIRAGSAPLIIVDGTYSTMSELQAINANDIKSFNVLKDGSSAAIYGTRGSNGVIIVETKNASKGKASIEYTSYYYTERPVRKLEMMSADEYMGYLKDKGHSTINNDYGFSTDWTDQLIRNNFSYYQGVSFSTGTENSSIRGSVGYRDSESMVINTGNKQLTGRVNFKQYFFDKKLTIEGTLNGANTQSDYTDYGAFMQAIVYHPTAPVYNQEGKFFEYAGVGPYNPVALLSQVDNRGERYTYSGNLSANLKVLPCLSVYAMMSANNDTYEGSKYISRDSRYSVLGGFEGQADMNTYFYKKRTFEAYANYSFSTDVHNLTALAGYSFNREDRTWHNASNSGFLTDIPGANNIGNGTYLEDGLASMGRGQDESKLIAFFGRINYSYKGKYLFNASVRREGSTRFGENHKWGWFPAVSAGWRILEENFFSDATPLSNLKLRVGFGITGNQDIPLYASIAKYNDLGYAYYNGKWDKVYGPVSNPNPDLKWEKNAEYNAGVDFGIWNDRLTASVDYYYRKTTDLLDWYDAQMPSNIYSTIFTNVGTLTNQGIEFAIGYDVIRNKELKWHLDGGFSYNENKLVSLANSSYRANHITYNPLSSPANGQTTYILEEGKPIGTYYGLKYRGFNSAGKWVFEDRDEDGAYSDKDYTYLGNGLPKWYFNLASTLTWKDFDFSFQLRGAAGFKVLNTKRIYYENSVSLPFNLLKSALGRPLNDAATFSDYYLEKGNYLKLDNITVGYTFDLSQLKYVSNARIYATATNLLTITGYTGVDPEVGTGLTPGFDDSGYYPRSTTLMLGLNIKF

SEQ ID NO: 13371 - protein, 280 aa, Ehrlichia chaffeensis
MNCKKFFITTALALPMSFLPGILLSEPVQDDSVSGNFYISGKYMPSASHFGVFSAKEEKNPTVALYGLKQDWNGVSASSHADADFNNKGYSFKYENNPFLGFAGAIGYSMGGPRIEFEVSYETFDVKNQGGNYKNDAHRYCALDRKASSTNATASHYVLLKNEGLLDISLMLNACYDVVSEGIPFSPYICAGVGTDLISMFEAINPKISYQGKLGLSYSINPEASVFVGGHFHKVAGNEFRDISTLKAFATPSPAATPDLATVTLSVCHFGVELGGRFNF

SEQ ID NO: 13372 - protein, 716 aa, Neisseria meningitidis
MCKLSKVTAIILFGVSSATAQMGGGSDVNSKRTDSNTTIATVRLDTVSIMANRSETDVAKYAGQVSILNQNDLVKSPSIIEDLGSIPGVQLGNDFGRQVGQYFNIRGFGYQSEARVIIEQDGIKRSASLFSNQISSFRVDNDLLKRVEVVKGASSVLHGSGAIGGIVSMQTKGVNDFINPGSDYGVTIGHRQESNHMNSNRAAIALRPVENFGFVLYGKHADFGTMKMAKDGKRTGIKYAINDERINTVFAKTEWAITDEHAIEASVFNYHENFISGWQSLYWSEPGALPTVGRLKQRDYSVIYKYTPLNNNWVNLSLQYYNARAQNHRIRSGILRRQPLLIDYVNKDDRWGLRLKNESVFATGWLEHRLVTGVDYEHRKEDAIFLYNGEPSDFGSFPNFYKDLGIYAQDVFDVGKFEFTLGGRFDKFKRGVKLPGRSTSSESRFSPKFALAYEVLDGVNLLAGYAETFRSPTPNETSPIGPLNPHYWYMSNPQLKPELAKEYELGLSIDKQNLFGDDELYFKATYYNGNIKDMIALQVKPGNPPFDPDAPNRRYGMYENVDHAKRHGIEVESKYAINNLVFSLGYDHTKIYDKATKKILTVYADKLTFGALYKYQPWGLSMGADVTHWFKPNNDEKEFVSQGVTYKNNDETFTIVNLKGKWEPRNFDSYLLNKGLKISFGINNLFNKEYIFPNGLKRTSRVGKGRNFYVDFEKTF

SEQ ID NO: 13373 - protein, 704 aa, Helicobacter pylori
MKKHILSLTLGSLLVSTLSAEDDGFYTSVGYQIGEAAQMVKNTKGIQQLSDNYEKLNNLLNNYSTLNTLIKLSADPSAINDARDNLGSSAKNLLDVKANSPAYQAVLLALNAAVGLWQVTSYAFTACGPGSNESANGGIQTFNNVPGQNTTTITCNSYYEPGNGGPISTENYAIINKAYQIIQKALTANGSNGEGIPVLSNTNTKLDFTIQGDKRTGGKPNEKLVYSWSHGKAISTSWNGGTSTPTTENINTENNAQELLKQASIIITTLNEACPNFQNGGSSYWQGISGNGTMCGMFKNEISAIQGMIANAQEAVAQSKIVSENTQNQNNLDTGKPFNPYTDAGFAQSMLKNAQAQAEILNQAEQVVKNFEKIPKNFVSDSLGVCYEVQGGERRGTNPGQVTSNTWGAGCAYVQETITNLTNSIAHFGTQEQQIQQAENIADTLVNFRSRYSELGNTYNSITTALSNIPNAQSLQNAVSKKNNPYSPQGIETNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARPKKKGSDHAAQHGIELGVKIPTINTNYYSFMGAELKYRRLYSVYLN

SEQ ID NO: 13374 - protein, 357 aa, Neisseria gonorrhoeae
MKKSLIALTLAALPVAAMADVTLYGQVKAGVEVSRTKETVNHVSTKNKTATEIADFGSRIGFKGHEHLSNNLNAIWQVEQNTSVAGTDKGWGTRESFIGLEGGFGKVRAGKLNTALKDNSDSVDPWESSDANASVLQFGKLKRVDERKVSVRYDSPVFAGFSASAQYQPRDNANPEDKHVHDVKTRHSFDLGLNYENSGFFGRYAGTFAKRKVLSDDHLELFNSNTTLGSGVYKDYQAHRLVGGYDANNVLVSVAGQYEGFKADVADAKKNERTEVAVTGGYRMGNVMPRLSYAHGFKAKENGVKQGNSQYNQVIVGADYDFSKRTSALVSAGWLKEGKGGDKTQSTAGLVGLRHKF

SEQ ID NO: 13375 - protein, 348 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGANSGWGNKQSFVGLKGGFGTIRAGSLNSPLKNTGSKVNAWESGKFTGNVLEISGMAEREHRYLSARYDSPEFAGFSGSVQYAPKDNSGSNGESYHVGLNYQNSGFFAQYAGLFQRYGEGTKKIEYDDQTYSMPSLFVEKLQVHRLVGGYDNNALYVSVAAQQQDAKLYGATGVNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 13376 - protein, 331 aa, Neisseria gonorrhoeae
MKKSLIALTLAALPVAATADVTLYGAIKAGVQTYRSVGHREGKVVSVETGSEISDFGSKIGFKGQEDLGNGLKAVWQLEQGASVAGTNSGWGNKQSFIGLKGGFGTIRVGSLNSPLKNTGANVNAWESSKFTGNVLEISGMVQREHRYLSVRYDSPEFAGFSGSVQYAPKDNSGSNGESYHVGLNYRNNGFFAQYAGLFQRYGEGTKKIEGYQYNIPSLFVEKLQVHRLVGGYDNNALYVSVAAQQQDAKLYQNQLVRDNSHNSQTEVAATAAYRFGNLTPRVSYAHGFKGSVHSADYDNTYDQVVVGAEYDFSKRTSALVSAGWLQEGKG

SEQ ID NO: 13377 - protein, 348 aa, Neisseria gonorrhoeae
MKKSLIALTLAALPVAATADVTLYGAIKAGVQTYRSVGHREGKVVSVETGSEISDFGSKIGFKGQEDLGNGLKAVWQLEQGASVAGTNTGWGNKQSFIGLKGGFGTIRVGSLNSPLKNTGANVNAWESGKYTGEFLEISKMAEREHRYLSARYDSPEFGGFSGSVQYAPKDNSGSNGESYHVGLNYRNGGFFAQYAGLFQRYGEGTKKIEYYNQFYSIPSLLVEKLQVHRLVGGYDNNALYASVAAQQQDAKLYGTWHANSHNSQTEVAATAAYRFGNLTPRVSYAHGFKGSVRSADYDNTYDQVVVGAEYDFSKRTSALVSAGWLQEGKGADKIVSTASAVVLRHKF

SEQ ID NO: 13378 - protein, 348 aa, Neisseria gonorrhoeae
MKKSLIALTLAALPVAATADVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIKYDDQDYSMPSLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 13379 - protein, 333 aa, Neisseria gonorrhoeae
MKKSLIALTLAALPVAAMADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSIPSLFVEKLQVHRLVGGYDNNALYVSVAAQQQDAKLYGAMSGNSHNSQTEVAATAAYRFGNVTPRVSYAHGFKGTVNSANHDNTYDQVVVGAEYDFSKRTSALVSAGWLQEGKGAD

SEQ ID NO: 13380 - protein, 327 aa, Neisseria gonorrhoeae
MKKSLIALTLAALPVAAMADVTLYGTIKVGVETSRSVAYHGAQANRVKTTTEIADLGSKIGFKGQEDLGNGLKAVWQLEQGASVAGTNTGWGNKQSFVGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 13381 - protein, 348 aa, Neisseria gonorrhoeae
MKKSLIALTLAALPVAATADVTLYGAIKAGVQTYRSVGHREGKVVSVETGSEISDFGSKIGFKGQEDLGNGLKAVWQLEQGASVAGTNTGWGNKQSFIGLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWHANSHNSQTEVAATAAYRFGNLTPRVSYAHGFKGSVRSADYDNTYDQVVVGAEYDFSKRTSALVSAGWLQEGKGADKIVSTASAVVLRHKF

SEQ ID NO: 13382 - protein, 348 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDGNVNAWESGKFTGNVLEISGMAKRGHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFSNVTPRVSYAHGFKGTVDSANHDNTYDQVVVGAEYDFSKRTSALVSAGWLQEGKGADKIVSTASAVVLRHKF

SEQ ID NO: 13383 - protein, 705 aa, Erwinia amylovora
MRMPFSLKRSVLLCGIALATPGISYAADTLVVTAKPEETSSTPTEGYTAKVSNGATKTDRPLITTGQSISVVTRQQMEDQGAMDVNQALNYTAGAFTNFAGAATRYDTVSLRGFHGGDVDNIFLDGLRLMSDPGSYNVLQVDPWFLDRIDVIKGPSSALYGQTVPGGLVMETSKRPQFTPEGHFRLTGGSNNTSGAAFDYTNAINDQWAFRLTGITRNSDTQYDHTREEKYAISPSLLWQPDEDTSLLLRAYLQKDPSGGYHSAVPGEGSITAHDGRKLSTGFYDGDSSLDQFKRREQIYSAQFSHRFNETWAVRSNASYSHSNVDLDQVYQIGWDKKNPDLLNRYYSGSRSSLDTFAIDNQLEADFATAEVGHKVVLGAEYHQYKNDLSDASGIASQLNALTGQAVGNNGNYTFERSQRRYYQTGVYLQDEMTWDKWHLDLSGRYDRIVSQTDNIDAGTKFRRQDDHIGGRAALLYAFDNGISPYASYSQAITPQSLPGQDGNVLKPTTSEQYEAGVKYQPVGTSDLYSVAVYDLTQKDVGNRVVVGSYYDPAGKVHSQGIELEAHNQLTPRLSTIANYTLNRVRYKDAIDGNDGHTPYVTPNSMASVWAKYQFDYGLSVGTGVRYIGKQWADNANTTRLASVTLLDASVRADLGAWNSSLKGAFVQVNANNLTGRDYVAACYGTGYCYWGAERTVMATVGYDF

SEQ ID NO: 13384 - protein, 692 aa, Neisseria meningitidis
AENNAKVVLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSPSDSNEGVSYGASVFGKEGNFDGLFSYNRNNEKDYEAGKGFRNNFNGGKTVPYSALDKRSYLAKIGTTFGDGDHRIVLSHMKDQHRGIRTVREEFTVGAKDSRINIKRQVPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSQFKIEDKEKATDEEKNKNRENEKIAKAYRLTNPTKTDAGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDIFANWKPLGKDTLNVNLSVNNVFNTFYYPHSQRWTNTLPDVGRDVRLGVNYKF

SEQ ID NO: 13385 - protein, 298 aa, Neisseria meningitidis
GVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 13386 - protein, 301 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALYASIAVQQQDAKLALPNDNSHNSQTEVAATLAYRFGNVTPRVSYAHGFKGSFDNADLSNDYDQVVVGAEYDFSKRTSALVSAGWLQEGKGENKFVSTAGGVGLRH

SEQ ID NO: 13387 - protein, 293 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRYQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVATAGG

SEQ ID NO: 13388 - protein, 106 aa, Paracoccus denitrificans
MDYKYHAYGVAYVHENEDIKLGIRTTLGVAYENELGRVVNGKNKARVVDTSADWFNIRGEKEDRKGNVKFDLNVGLDNTRVGVTANVGYDTKGENLRGGLGLRVIF

SEQ ID NO: 13389 - protein, 823 aa, Ralstonia solanacearum
MPALRTLPRFTKALVMRNTLTLHPRLSTAALTMALLAPIASQAEAQKIQFDIGAQSLPSALRQFGQQSQLQVLYSADEVQGLRSNAVRGQLSVEAALAELLRGTGASYSLQGSSVTISAQRSADSVDLGDITVTSQESAWGHVNGYVAKRSGTGTKTDTPLKEIPQTINVVTQDEIKARGSQTVTEALRYTPGITGGGFADRVKIFDEPTSRGFSPAPMYLDGLHMPYGGGSTGGALQIDPYTLERIEVLKGPASVLFGQNQPGGIVNMVSKRPTAEPIHEVVLGGGSQDRRYGAFDVAGALDEQGTYLYRITGVGRDINSEIDYAEQKRFMLAPSFTWNPNEQTSLTFYGQYQKDNDVPEAQGLPAYGTVFSTPNGRIKRSTFIGEPGLNSYDRDQFVVGYEFSHEFNDVWTFKQNTRYAYVDDQYVAPLHGYRFVPNPNTGANDQRYTTRYGVDWSQTNKVFGMDNILQAKYKTADIEHTLLIGLDYYHSNSKFLGLYSYEAASPIIDLYKPVYGKPFTFGSPYRWDRTIRQTGVYLQDQMKWNQWFLTLGGRYDWAETDSKETAGHSNAKDEKFSGRAGFGYEFSNGITPYVSYSESFQPVSGYNLDQNSKAFKPTTGKQYEAGIKYQPPGQDSFIQASVYQIDQKNVLTTNLENPNFYNQSAAMRSKGFELEGKASLTNNLGIIASFSRNDVKYTKDNDGREGRHPAGTPPMTAAVWLDYTLGGDTVLAGLGAGIGARYTRGSDGTDTADNHFTIPSYTLYDGKLSYDFEKSPLRLKGLKLQVNLENIEDKKYVSRCAGIWDCYYGQGRTITSDLTYNW

SEQ ID NO: 13390 - protein, 323 aa, Pasteurella multocida
ATVYNQDGTKVDVNGSVRLILKKEKNERGDLVDNGSRVSFKASHDLGEGLSALAYAELRFSKNEKVEVKDAQNQQVVRKYEVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTAAAKQEKEKAFMVGTELSYAGLALGVDYAQSKVTNVEGKKRALEVGLNYDINDKQKFTLDLIWAKEGPKGATTRDRSIILGAGYKLHKQVETFVEGGWGREKDTNGVTTKDNKVGVGLRVHF

SEQ ID NO: 13391 - protein, 333 aa, Pasteurella multocida
ATVYNQDGTKVDVNGSLRLILKKEKNERGDLVDNGSRVSFKASHDLGEGLSALAYTELRFSKNVPVQVKDQQGEVVREYEVEKLGNNVHVKRLYAGFAYEGLGTLTFGNQLTIGDDVGLSDYTYFNSGINNLLSSGEKAINFKSAEFNGFTFGGAYVFSADADKQALRDGRGFVVAGLYNRKMGDVGFAFEAGYSQKYVKQEVEQNPPAAQKVFKDEKEKAFMVGAELSYAGLALGVDYAQSKVTNVDGKKRALEVGLNYDLNDRAKVYTDFIWEKEGPKGDVTRNRTVAVGFGYKLHKQVETFVEAAWGREKDSDGVTTKNNVVGTGLRVHF

SEQ ID NO: 13392 - protein, 329 aa, Pasteurella multocida
ATVYNQDGTKVDVNGSVRLLLKKEKDMRGDLIDNGSRVSFKASHDLGEGLSALGYAELRFSDDVKDKDGNVVNQPIGNKVHAKRLYAGFAYEGLGTLTFGNQLTIGDDVGVSDYTYFNSGINGVLITSGQKAINFKSAEFNGFTFGGAYVFSGDANKDALRDGRGFVVAGLYNRQIGDVGFAFEAGYSQKYVKQKVEQPQPLPSGQVERFKDEKEKAFLVGAELSYAGLALGVDYAQSKVTNVDGKKRRLEVGLKYDLNDKAKVYTDFIWEKEGPKGDVERTRTVAVGFGYKLHKQVETFVEGAWGRTKDADGTTTKDNVVGTGLRVHF

SEQ ID NO: 13393 - protein, 319 aa, Pasteurella multocida
ATVYNQDGTKVDVNGSVRLILKKEKNERGDLVDNGSRVSFKASHDLGEGLSALAYTELRFSKNVTVQVKDPQGKVVREYDVEKLGNNVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTVAKQEKAFMVGTELSYAGLALGVDYAQSKVTNVEGKKRALEVGLNYDINDKAKVYTDLIWAKEGPKGATTRDRAIILGAGYKLHKQVETFVEGGWGREKDANGVTTKDNKVGVGLRVHF

SEQ ID NO: 13394 - protein, 323 aa, Pasteurella multocida
ATVYNQDGTKVDVNGSVRLLLKKENDKRGDLIDNGSRVSFKASHDLGEGLSALGYAELRFSDDVKDQDGNVVKQPIGNKVHAKRLYAGFAYEGLGTLTFGNQLTIGDDVGVSDYTYFNSGINGVLITSGQKAINFKSAEFNGFTFGGAYVFSGDANKDALRDGRGFVVAGLYNRQIGDVGFAFEAGYSQKYVKQVDDSVVPNKEWDEKEKAFLVGTELSYAGLALGVDYAQSKVTNVEGKKRALEVGLKYELNDKAKVYTDFIWAKEGPKGDTDRTRKIAVGFGYKLHKQVETFVEGAWGRTKDADGTTTKNNVIGTGLRVHF

SEQ ID NO: 13395 - protein, 313 aa, Pasteurella multocida
ATVYNQDGTKVDVNGSVRLILKKEKNERGDLVDNGSRVSFKASHDLGEGLSALAYAELRFSTKVKKTVKEGPSQVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTVAKQEKAFMVGTELSYAGLALGVDYAQSKVTNVEGKKRALEVGLNYDINDKAKVYTDLIWAKGGPKGATTRDRSIILGAGYKLHKQVETFVEGGWGREKDANGVTTKGNVVGVGLRVHF

SEQ ID NO: 13396 - protein, 323 aa, Pasteurella multocida
ATVYNQDGTKVDVNGSVRLLLKKEKDKRGDLIDNGSRVSFKASHDLGEGLSALGYAELRFSDDVKDQDGNVVKQPIGNKVHAKRLYAGFAYEGLGTLTFGNQLTIGDDVGVSDYTYFNSGINGVLITSGQKAINFKSAEFNGFTFGGAYVFSGDANKDALRDGRGFVVAGLYNRQIGDVGFAFEAGYSQKYVKQVDDSVVPNKEWDEKEKAFLVGTELSYAGLALGVDYAQSKVTNVEGKKRALEVGLKYELNDKAKVYTDFIWAKEGPKGDTDRTRKIAVGFGYKLHKQVETFVEGAWGRTKDADGTTTKNNVIGTGLRVHF

SEQ ID NO: 13397 - protein, 189 aa, Pasteurella multocida
ATMFVCNIMVKFYLLKQELTALQYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVA

SEQ ID NO: 13398 - protein, 324 aa, Pasteurella multocida
ATVYNQDGTKVDVNGSVRLILKKEKNERGDLVDNGSRVSFKASHDLGEGLSALAYAELRFSTKEKVEVKDTQNQQQVVRTYEVEKIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTAAAKQEKEKAFMVGTELSYAGLALGVDYAQSKVTNVDGKKRALEVGLNYDINDKAKVYTDLIWAKKGPKGATTRDRSIILGAGYKLHKQVETFVEGGWGREKDANGVTTKDNVVGVGLRVHF

SEQ ID NO: 13399 - protein, 237 aa, Pasteurella haemolytica
MIMKTILLGAVALLALAAPAAAADMQPRAYTKAPAYTPPQVIYNWTGFYIGGHVGGAFAGDSSFQSSDARFLGGVQGGFDYQFAPNWVVGVEAQYSWLPTNNNGVTFPLGTQVTSNTDQLGSVTGRIGYTWGPALVYAKGGYAWRNGGLGVNVAGVPQGFTATGNNKDGYTVGAGLEYMFAPSWSAKAEYQYYNFGSTTFTSGPADIVGVRGREDEHTVKVGVNYRFGWGGPSASRY

SEQ ID NO: 13400 - protein, 713 aa, Salmonella choleraesuis
MGMRLRLFKMLALANVAALPMQAWAASESADAAASPTGSGGAVLEDIVVTAQKRAQSIERVPASIQVISGGDIAAYQTSSLKAVAARMPNVVLTASPSGAVQANIRGFGTSTANSGFEQSVGLYVDGVYSPRPHSYTGAVFDIDRVEVVKGTQGTLFGKNASVGAMSLVTRKPGRAFGGYLDGSYEFRLDETRLEGAMDVPIGERFRTRIAGVYGDQSKGWVRNLANGKQEPTSTEYAGRIRAEWDATDTLTFNAKGEFSRYKRIGDPFVGVGGTVFNGIEVEDAIKNVSSNLIPGDGGQASNRRRSNVATAGFDWKLGNHTVTAITSWQKLRYDAFVDLDESAGPVDYVVNFYERFRQFTQELRIASDDSGAFSYVAGLFYLNQTLKFGTDTIFIPAPSQQLLTVDARAYSAFAQGTFKATDRLTFTAGLRYTRDEKEGRLDIAKGNQSAVTRTKANDDSFDWSFVGEYEVIDGTRLYGSVSRGHKGQGFANSVPGTALVPARPVFDGEKATNYEIGIKSRFLGGRARGNLAIYQLDVNGFQASQFDPATRLFIVQNVDARSRGVEAELQLLAAEDLQINFSGAYNDANIRATGKQLVSAPRWNMTAGFDYTPQLTDNIELQAGAQFNYVTKYPHQFDLLPGNFTPGHSNLDARIGVKLSPSDIVIAVIAKNLTNEQYADFAYGYAFDAPGTAFTQQLNRPRTIALSVHLPF

SEQ ID NO: 13401 - protein, 186 aa, Wolbachia sp. wPup1
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEISVLYSAVGAEA

SEQ ID NO: 13402 - protein, 188 aa, Wolbachia sp. wCen
SYYVRLQYNGEILPLFTKVDGITYKKDNGDYSPLKAPFIVGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 13403 - protein, 1607 aa, Pseudomonas putida
MKIKNKIIFISIVIISMSIMLLILSKYSITKLYSIDSYITKNEYTKLYYFLDKKFFYDAEYVKKQANDNKLLKKMYKGGDDRSILSKKYIALLETHESTFEQDINSQVNSVYMCPLKKNLNETPCSLPTAEIGNKKNDSEENHPTVEQIDDILQETEIEQTNDTLSKASPATNPKFATQKQQVVSILPSKHISLLKKIIKPSQHSSKNRPSSVAKAIIGIPGLPLYAVNLYGQRGDAPSGGDKKPSGTEGNNSSSDDEEKEEKNHSHYDSEINEQDKHTDKGEKSDLVGAVGGTSDNFTNLDGNKSDGSNGFEVLDLPSHNHSEPWQKLIVVDDESSHESHTENSTQKNESDNNAEPKPLKDLYELGEHYPPMFNQPKQDMSMGIIGPGDDLIRPLINFCEPQFQHYKYIHHHHHSHHQHRYHHQQQQHHHHPLHHHYKIGIPLLSPNKNKPGPLMNELPGRHLQTKNPSIDNGGNNNEQQKFDPYKRPSNNSIEDSKKENSHHSNSSKQSSLGLSWEKDFGQSSNRGKNKHLEEQNDGEHSNSSNVSIAPLMSHSSSTGQQNTSVENNQHSNGEQNPPSVGCEHRGPMSTSNHSSSCFVQLNKSGSDFNNESNQPSGPKKEIVQSINSSPESEHTPSNNSSNSSFEKYLHLCYSSVGNEASHSSGESSKNNGNTQEEHTLMPHNNSPPVSQSFYPKNDNESENEASSEYSSSEFSFEKERNFDHFSSENGNSLDGFEVVEHGPGNSAEVSPFKPTVQTGFKGTPSPTRTGLLLPPSSSDDSKSLEGSLKSGGDSNNDESSDWSSSNSFDLTSENKKIFLVQTGGHPHRPPKKNDTKQPHSEPSENPNGEDGGIQQNEPSYGENVLCFTKSSGSNHSHPSHRDHYNEHEQNPPDETEDHSAHHQSQSSLNDKSKSSSKSRSSSIGSNSGSSIILLNGSSSGDSLLEYPGPEDDEGDCLGRECKRKRNSDSNSESDYSCSFERLGNSSASWILRNHGGSHSSTKSNSSSSSSIIILEESSSEHYNNNRDSSYTDSNQGNNFNSYEEDTGHQSEDGGNKSSSSSSIQILSTSNDSIDWPNSRNNSESEYDGVNDGIAWPGSANNSGDEHNSDDGIDWPNPRNNSEPEHDDSDDGIAWPGSANNSEDEHNSDDEIDWPNPRNNSESEHDGSDDGIAWPGSANNSENGDDGSKSDSDSHPEGESNNNDTDGGNRSGNDELSDGYSNSSGSNGENSSLQYRRPVMLGAMPPARATPRRGNPSGANVRQVLSKTPKNLQATQAKRPPISSLDSYRNACKALTQAIHAIAQSSQQAMRSLALATTTGYPDTTKRFRIFGSASTKKPYPKKHQPYAVTVGVIANPFSAINLGVAYTYTQHTTKDFHISNTDALFEGSAAGKLQTNHISLITAWNPEGYGLTGFLEYAYGTGDATLIRKFAYDNLAFTAKGKTRTHTDGGTARIGYRFKVTETIAVTPYGELAAVRARWNNYSENKGKFPANISSTKELVREERLGIETRWQIVDNCQIYAWGAYISSKKKNGVGIEALLTIDDHTENMTVSKYSRKQSMGEIGAAIAIKPTEHFGISFNTSIRTKSNSKVGLDSQYIGTSIWYAF

SEQ ID NO: 13404 - protein, 759 aa, Moraxella catarrhalis
MNKFQLLPLTLAVSAAFTTTAFAAVSQPKVVLAGDTVVSDRQGAKIKTNVVTLREKDESTATDLRGLLQDEPAIGFGGGNGTSQFISIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTLDIEKDKKKRTDEQLQAELDNKYAGKGYKLGSKTPDGKKYNVVDANGKLVADLDRNNPTQRETYQKLTNLEWTGKNLGFANEVTANVYKLEHGRNSSSDKGNSYILRDVPNTINDNGDSPSNMHVVATGANINFDKEFNHGLLKGFGVDHTLLKYGINYRHQEAVPPRGIRPGFQNQEKTDAGIYLEAVNQINDFTINTGVRVDRFDFKAMDGKKVGKTDINPSFGVIYDVNPNLSVSGNLIYATRSPRFADAILSRGFRDGVVSIADNAKAEKARNTEIGFNYNNGPYTAFGSYFWQRVDNARATADAVQHPTVTTAKITYLGNQGHQTNHGYELGVGYTEGAWRARAGVAHSKPTMHNVKFKANPEYAVRTGRTWTADVAYRLPNPSVELGVRHTLVEGVDAKDTSILSGKFDDKDGAILNREGYNVSDIYANWKPYGNDKVNVNFAVNNVFNKNYRPHTQRASIDTLPGAGRDFRVGVNFTY

SEQ ID NO: 13405 - protein, 758 aa, Moraxella catarrhalis
MNKFQLLPLTLAVSAAFTTTAFAAVSQPKVVLAGDTVVSDRQGAKIKTNVVTLREKDESTATDLRGLLQDEPAIGFGGGNGTSQFISIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTLDIKKDDKTLTETELQAELDNKYAGKGYKLGSKTPDGKKYNVVDANGKLVADLDRNNPTQRETYQKLTNLEWTGKNLGFANEVTANVYKLEHGRNSSSDQGNTYITKDVPKEIIDNVDTPSNMHVVATGANINFDKEFNHSPLKGFGVDHTLLKYGINYRHQKAVPPRSLKPGVVHQEKTDAGIYLEAVNQINDFTINTGVRVDRFDFKAMDGKKVGKTDINPSFGVIYDVNPNLSVSGNLIYATRSPRFADAILSRGYRGGVISIDDNAKAEKARNTEIGFNYNNGPYTAFGSYFWQRVDNARATADITRHGTTDANGKPIKVPTLGNQGHQTNQGYELGVGYTEGACVPRAGVAHSKPTMHNVKFSGNPEYAVRTGRTWTADVAYRLPNPSVELGVRHTLVEGVDAKDTSIISGEVSKLNREGYNVSDIYANWKPYGNDKVNVNFAVNNVFNKNYRPHTQRASIDTLPGAGRDFRVGVNFTY

SEQ ID NO: 13406 - protein, 768 aa, Moraxella catarrhalis
MNKFQLLPLTLAVSAAFTTTAFAAVSQPKVVLAGDTVVSDRQGAKIKTNVVTLREKDESTATDLRGLLQDEPAIGFGGGNGTSQFVSIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTIDIEKKGKIRTEAELLAELNKDYPGQGYKLGKKINDKDNKVVGYHVVDANGRQVPNLNRNNPTQRETYQKLTNLEWTAKNLGLANEVTANVYKLEHGRNSSSDQGNTYITKDVPKEIIDNVDTPSNMHVVATGANINFDKEFNHSPLKGFGVDHTLLKYGINYRHQTAVPPRSLKPGVVHQEKTDAGIYLEAVNQINDFTINTGVRVDRFDFKAMDGKKVGKTDINPSFGVIYDVNPNLSVSGNLIYATRSPRFVDAILSRGYRGGVISIDDNAKAEKARNTEIGFIYNNGPYTAFGSYFWQRVVNARATVTDISRHGTTDANGKSIKVPALGTQGHQTNQGYELGVGYTEGAWRARAGVAYSTPSMHNVTLDGNPEYAARTGRTWTADVAYRLPNPSVELGVRHTLVEGVDAKDTSILSGKFDDKDGAILNREGSNVSDIYANWKPYGNDKVNVNFAVNNVFNKNYRPHTQRASIDTLPGAGRDFRVGVNFTY

SEQ ID NO: 13407 - protein, 915 aa, Bordetella pertussis
MAGQARGWYGAGGRHPIHFQISAGAALMLGLLDVAGAAAVTAAQRIDGGAAFLGDVAIATTKASEHGINVTGRTAEVRVTGGTIRTSGNQAQGLRVGTENAPDNTALGASVFLQNLIIETSGTGALGVSVHEPQGGGGTRLSMSGTTVRTRGDDSFALQLSGPASATLNDVALETAGQQAPAVVLWQGAQLNAQGLVVQVNGAGVSAIHAQDAGSFTLSGSDITARGLEVAGIYVQEGMQGTLTGTRVTTQGDTAPALQVEDAGTHVSMNGGALSTSGANSPAAWLLAGGSAQFRDTVLRTVGEASHGVDVAAHSEVELAHAQVRADGQGAHGLVVTRSSAMVRAGSLVESTGDGAAALLESGHLTVDGSVVHGHGAAGLEVDGESNVSLLNGARLSSDQPTAIRLIDPRSVLNLDIKDRAQLLGDIAPEAQQPDGSPEQARVRVALADGGTWAGRTDGAVHTVRLLDRGVWTVTGDSRVAEVKLEGGTLAFAPPAQPKGAFKTLVATQGISGTGTIVMNAHLPSGTADVLVAPQGFGDRQVLVVNNTDDGTESGATKVPLIEDEQGHTAFTLGNMGGRVDAGARQYELTASEAQADKARTWQLTPTNELSTTATAAVNAMAIAASQRIWQAEMDVLLRHMSGLHSIGSPGGFWARGLSQRQRLDTGYGPWQKQTVSGIELGLDRRVAGGATTAWSVGMLAGYSETRRDGGAYRAGHVHSAHVGAYVSYLNDSGSYVDGVVKYNRFRHGFDIRTTDLKRVDAKHRSHGLGALLRGGRRIDIDGGWYVEPQASVAWFHAGGSRYEASNGLRVRADGAHSWVLRAGAEAGRQMRLANGNIVEPYARLGWAQELGADNAVYTNGIRHVTRSRGGFAEARVGVGALLGKRHALYADYEYAKGARFEAPWTLQLGYRYSW

SEQ ID NO: 13408 - protein, 297 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVG

SEQ ID NO: 13409 - protein, 296 aa, Neisseria meningitidis
GVETSRSVYYEDGKAAEVTTGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHEQIDNVKIEKYQIHRLVSGYDNDALHASVAVQQQDAKLVEDNYSHNSQTEVAATLAYRFGNVTPRVSYAHGFKGSFDDADRYNTYDQVVVGAEYDFSKRTSALVSAGWLQEGKGENKFVATAGGVG

SEQ ID NO: 13410 - protein, 294 aa, Neisseria meningitidis
GVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGG

SEQ ID NO: 13411 - protein, 293 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDNVKIEKYQIHRLVSGYDNDALYASVAVQQQDAKLVEDNSHNSQTEVAATLAYRFGNVTPRVSYAHGFKGSFDDADYTNDYDQVVVGAEYDFSKRTSALVSAGWLQEGKGESKFVSTAGG

SEQ ID NO: 13412 - protein, 293 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVATAGG

SEQ ID NO: 13413 - protein, 294 aa, Neisseria meningitidis
GVETSRSVFHQNGQVTEVTTGTGIVDLGSKIGFKGQEDLGNGLKAIWQVEQKASIAGTDSGWGNRQSFIGLKGGFGKLRVGRLNSVLKDTGDINPWEGKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVATAGG

SEQ ID NO: 13414 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRVGNLNTVLKDSGDNVNAWESGSNTEDVLGLGTIGRVESREISVRYDSPVFAGFSGSVQYVPRDNANDVDKYKHMKSSRESYHAGLKYENAGFFGQYAGSFAKYADLKDNAERVAVNTANAHPVKDYQVHRVVAGYDANDLYVSVAGQYEAAKNNTGTVGKQGKKHEQTQVAATAAYRFGNVTPRVSYAHGFKAKVNGVKDANYQYDQVIVGADYDFSKRTSALVSAGWLKQGKGARKVEQTASM

SEQ ID NO: 13415 - protein, 318 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADAERVAVNTANAHPVKDYQVHRVVAGYDANDLYVSVAGQYEAAKNNEVGSTKGKKHEQTQVAATAAYRFGNVTPRVSYAHGFKAKVNGVKDANYQYDQVIVGADYDFSKRTSALVSAGWLKQGKGAGKVEQTASM

SEQ ID NO: 13416 - protein, 322 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRFGNVTPRVSYAHGFKAKVNGVKNANYQYDQVIVGADYDFSKRTSALVSAGWLKQGKGAGKVEQTASM

SEQ ID NO: 13417 - protein, 323 aa, Neisseria meningitidis
EVSRVKDAGTYKAQGGKSKTATQIADFGSKIGFKGQEDFGNGIKAIWQLEQKASIAGTNSGWGNRQSFIGLKGDFGTVRAGNLNTVLKDSGDNVNAWESGSNTEDVLGLGTIGRVESREISVRYDSPVFAGFSGSVQYVPRDNANDKDKYDHKLSSRESYHAGLKYENAGFFGQYAGSFAKYADLNTDAERVAVNTANAHSVKDYQVHRVVAGYDANDLYVSVAGQYEAAKNNTGTVGEQGKKHEQTQVAATAAYRFGNVTPRVSYAHGFKAKVNGKKAARYQYDQVIVGADYDFSKRTSALVSAGWLKEGKGVNKTEKTASM

SEQ ID NO: 13418 - protein, 321 aa, Neisseria meningitidis
EVSRVKDAATYKAQGGKSKTATQIADFGSKIGFKGQEDLGNGMKAIWQLEQKASIAGTNSGWGTRQSFIGLKGDFGTVRAGNLNTVLKDSGDNVNAWESGSNTEDVLGLGTIGRVESREISVRYDSPVFAGFSGSVQYVPRDNANDKDKYTHHDSSRESYHAGLKYENAGFFGQYAGSFAKYADSDAYAKRVAPGTGLAVKDYQVHRVVAGYDANDLYVSVAGQYEAAKNNEANPLTNGKKLEQTQVAATAAYRFGNVTPRVSYAHGFKAKVNGKKAARYQYDQVIVGADYDFSKRTSALVSAGWLKEGKGVNKTEKTASM

SEQ ID NO: 13419 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNVVGSTHVGKKHEQTQVAATAAYRFGNVTPRVSYAHGFKAKVNGVKNASYQYDQVIVGADYDFSKRTSALVSAGWLKQGKGAGKVEQTASM

SEQ ID NO: 13420 - protein, 322 aa, Neisseria meningitidis
EVSRVKDAATYKDQGGKSKTATQIADFGSKIGFKGQEDFGNGVKAIWQLEQKASIAGTNSGWGNRQSFIGLKGDFGTVRAGNLNTVLKDSGDNVNAWESSSNTEDVLGLGTIGRVETREISVRYDSPVFAGFSGSVQYVPRDNANDKDKYEHHKSSRESYHAGLKYENAGFFGQYAGSFAKYADLNDDAERVAVNTTNAHAVKDYQVHRVVAGYDANDLYVSVAGQYEAAKNNDGSANNGKKHEQTQVAATAAYRLGNVTPRVSYAHGFKAKVNGVKDASYQYDQVIVGADYDFSKRTSALVSAGWLKEGKGVNKTEKTASM

SEQ ID NO: 13421 - protein, 298 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGESKFVSTAGGVGLRH

SEQ ID NO: 13422 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGDFGTVRAGNLNTVLKDSGDNVNAWESGSNTGDVLGLGTIGRVESREISVRYDSPVFAGFSGSVQYVPRDNANDKDKYEHHKSSRESYHAGLKYENAGFFGQYAGSFAKYADLNNDAERVAVNTPNAHAVKDYQVHRVVAGYDANDLYVSVAGQYEAAKNNEVGNLNIGKKHEQTQVAATAAYRFGNVTPRVSYAHGFKAKVNGEKAARYQYDQVIVGADYDFSKRTSALVSVGWLQEGKGKNKTEKTASM

SEQ ID NO: 13423 - protein, 317 aa, Neisseria meningitidis
EVSRVKNQGVKTKTATQIADFGSKIGFKGQEDLGNGMKAIWQLEQKASIAGTNSGWGNRQSFIGLKGGFGTVRVGNLNTVLKDSGDNVNAWESGSNTENVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANALYVSVAGQYEAAKNNDTSPATNGKKHEQTQVAATAAYRFGNVTPRVSYAHGFKAKVNGVKKASYQYDQVIVGADYDFSKRTSALVSAGWLKQGKGAGKVEQTASM

SEQ ID NO: 13424 - protein, 492 aa, Aquifex aeolicus
MKRTLLILTLVLTLTLLFSQTQELPDLTVSGESSFKPFLYKRSLLFSPELNMGDSLPAFVPPGVPLQEKPKPIPAMQHRSYLQFEGNMDFGLNSFISYYPDSFILNALTYTLDMRSPISEMLSVHNNLFLGTELSSHFPLSFRFQNVSSQADDFDNTVLDFNFSHHRPDLTIGNVSFKDISAQLGYNYIYQKNLNKPYKCNYLNVYLASCLEEEILNWKTKFMVKSGDFGIQIAPVYNGDIMDISKPGIHLLVDAYTIVPSLEFLYRYPITGWGVLSLSNVPLLEGNDYLSFLEATPWISFSDAHKLKKTPLNFSAGLEYLYPQKINFSLGRLNINNNLRYEIDSPVLISTDNYRIPTLRYTDVFSNLTTVEAFFKMDKLNMHQGLELELAYLTESDYTRAPYRPLLNLDSRFAYGYGNWYFNLDILQHYFTKDHRGHNLPEAIILNLGAEYHKDNSAAYAQLANLFNRKEWVFSEQPGKGRNLYIGLKHRF

SEQ ID NO: 13425 - protein, 757 aa, Aquifex aeolicus
MGVAVQLQAQVTVTGKVIDEQQQPVPYANIVLLSLPDSTFVAGSISNEEGAFSLNVKETKDVLRISSIGYATVYRPLDNRSTDLGIICLASDTQILAEVVVKADMPVTRMRGDALVTNIQNSVLSKAGSASDVLGKVPGVIKERNSYEVLGKGTPLIYINGRQVRDDSELDQLNSEDIKSVEVVTNPGARYDATVTAVIRIQTIRRAGDGFGFDLRSSYYQSQNVDLIEQLNVNYRHNGLDIFGIFRYLKNEYIMKNDIVHTLESDSLWKYQNLLDGTVVDKSLRGEIGANYSLNDKHSLGFRYTLTSRPNTKSDVFTSNDITANNQFYDHLENQEYSSTSGKPTHQLNVYYNGTVGDLNIDFNTDYYTNTSTGKGLYHEVSQEQESRDVHTQSYIRNKLLASKLVLSYPLFGGNLSVGGEYTDTRRNDEYRNPEKYVESTISRVEEDGLSGFAEYSRQFPIGNLSLGVRYEHVTFDYYKDGVHMDEQSRMYGNWFPNLSFSRKLGSVRAQLSYTAKTQRPTYSQLSNNVTYVDRFTMQRGNPLLEPCTIHDISLVGTWRFLQLLVSYQQWRKEIIYWGDPIDNGNSMMMTYLNYHNRPTLNVSFSISPAIGFWHPNLNIGVKKQWMTIDGIEFNKPRPTIRFNNTFELPGDFLVSLDGLFMGKGNYQNLYQFKNYGTVDISVRKSFLRDALSLELRGNDLFHGSRNYWQTYFGSIIWEQTNQWDTREFSITLRYKFNTTKSKYKGTGAANDELRRL

SEQ ID NO: 13426 - protein, 263 aa, Aquifex aeolicus
MKRLALLLATTAFVTPALAADVIYEEPPAPAPMAIEPVATTATWTGLYIGGQAGVAFGNESDGATFNPGGGGPFGTGTYSEDDDNAGFIGGGHIGYDYQINDFVVGAVADINYIDAETNRSYTTGGGSTFSTSSDINYLGTVRARVGYAMDSVLLYGTGGLAYAGVDNNASAPASSGTFTNYTFEQDENDTDIGYAVGGGVDVMATNNISFGVEYLYTNLGSNDQTITGTDSTNGNTVSFTSESNNDDLDFHTIWAKASYRFN

SEQ ID NO: 13427 - protein, 292 aa, Neisseria meningitidis
GVETSRSVYYEDGKAAEVTTGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHEQIDNVKIEKYQIHRLVSGYDNDALHASVAVQQQDAKLVEDNYSHNSQTEVAATLAYRFGNVTPRVSYAHGFKGSFDDADRYNTYDQVVVGAEYDFSKRTSALVSAGWLQEGKGENKFVATA

SEQ ID NO: 13428 - protein, 296 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGESKFVSTAGGVGL

SEQ ID NO: 13429 - protein, 295 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHERVDKNVNIEKYQIHRLVSGYDNDALYASVAVQQQDAKLVEDNYSHNSQTEVAATLAYRFGNVTPRVSYAHGFKGSVDDAKRDNTYDQVVVGAEYDFSKRTSALVSAGWLQEGKGENKFVATAGG

SEQ ID NO: 13430 - protein, 294 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDIKPWDSKSDYLGVNKIAEPEARLISVRYDSPEFAGLSGSVQYALNDNAGRHNSESYHAGFNYKNGGFFVQYGGAYKRHQAVDDVKIEKYQIHRLVSGYDNDALHASVAVQQQHAKLVEDNYSHNSQTEVAATLAYRFGNVTPRVSYAHGFKGSFDDANLSNDYDQVVVGAEYDFSKRTSALVSAGWLQEGKGENKFVSTAGG

SEQ ID NO: 13431 - protein, 295 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALHASVAVQQQDAKLVKDNYSHNSQTEVAATLAYRFGNVTPRVSYAHGFKGSFDDADLSNDYDQVVVGAEYDFSKRTSALVSAGWLQEGKGENKFVSTAGG

SEQ ID NO: 13432 - protein, 766 aa, Pseudomonas aeruginosa
MSRQSTDTAVSSQRLLASAIGVAITAIAAPQAAHADEAGQKKTDKDRVLSLDAATIVGEQQDETTYNVDRSASKKYTAPLLDTPRSVTVVPKQVIKDTAAVSLQDALRTVPGITFGAGEGGNPTGDRPFIRGFDAQSDTYVDGVRDTGAQTREIFNLEQIEVSKGPNSAFGGRGSAGGSLNLVSKQAKAGNFIDGGFTYGSDQTRRYTLDLNQEFLDGNAAFRLNLLKHDANVAGRDEVDVSRWGVAPSLTFGLGSPTRVTVSHYHLESDDTPDSGIPYAKSSDRSKHNPDKPVNVDRGNFYGLTGRDFQKSRIDTSTITVEHDLTDSLTIRNTSRYGNSHQDYLWTQPDDSQGNINNGSVWRRQNNRVSTTTTAVNQTDLFGEFYLGGFKNSFSTGLEFSREDSKRDGYTVDTNTGLGSNKCNPSLIGAPSGYNCTSLENPNPHDPWNGSITRKYAPLNTVGTTKAIYAFDTIDLNEQWQVNIGARFDSFETTAKNHGVRPATKLSDKSSFWNWQAGLVWKPVPNGSIYASYATSATPPGSMLDNGDTSNAVDGFAISNNLEPEETTNYELGTKWAFFNERLELSAAIFRTDKDNTRILVANQTYDNAGQSRVDGVELSASGKLTEKWKVFAGYSYLDSELVDAGKAGRNGNVNASAASNNGNEMPNTPKNSFSLWTTYDIFPKTTIGGGAFYVDKVYGDVGNTVYVPDYWRYDAMASYKLSKNVDFQLNVQNVFDKKYFDKAYAAHYASQAAGRTILFSTNFHF

SEQ ID NO: 13433 - protein, 802 aa, Pseudomonas aeruginosa
MPRPTFRPGLLALAIALAVPAPFLHAAPAEQASVRDYRIAAGPLAGTLNRIAAQAGLVLTLDPALAEGRSAHAVQGRFDAPGALREALKGSGLELVENAGGTYSLRKVPEDTLSLQAMTVSGAEEDPLGPTSGYVAKRSMTGTKTDTPILETPRSISVATRQQMTDRAVHNLDDAVRYMPGVVASSFGSDSRSDWLKVRGFKPTQFLDGLPMAVGVYNNPKLETWNLERVALLRGPASSVYGQTPPGGMLDMVSLRPQNVASHEVKAEVGNYNHKQVSFDSTGPLDDEGRFLYRVSGVVRDSNTQVDHIDDKRYNIAPSLTWNIDDDTRLTFLGQFNRDDTGITSQFLPLRGTKYDAPFGKVSHHKNLGDPDWEYYDRTYYWLGYAFERRINDVWQFRQNLRYLRNDLSFQALTPASYYAAASDDGTLQRTSTSVDEDVSQFVVDNNFQADFDTGALRHTLLLGLDHNRTTNEYTSIFGFNVPPTNINNPIYGQPIPKPPRSDAYYDYKQKTYQTGLYVQDQIALDNWRLTLGGREDWVHTGATFYNKGDATNTSRDKKFSGNAALSYIFDNGVAPYISYAESFQPTTGADMNSTSSLKPTEGKQWEIGVKYQPVGSDSLFTAAVYDLRQENVSVSQNIGGTPVTSQTGEVKVSGIELEATSNVTDNLKMIGAYSYADTEVKKGQYAGNRLQQAPRNQASLWADYTWHEGTLNGFSVGAGARYVGSTYGDQANTYDGYAGSYTLYDAAVRYDLGQLNGSLKGVSVAVNANNLFNKDYLASCDGYYCYYGDQRSVVGSVSYKW

SEQ ID NO: 13434 - protein, 742 aa, Pseudomonas aeruginosa
MYPQFRRGHLAAAVLFASSSLLGGQALAEDERLEELDERAESVVQLGDEVVLGTAEQELKQAPGVSIITAEDIRKRPPVNDLSEIIRTMPGVNLTGNSSSGQRGNNRQIDIRGMGPENTLILVDGKPVSSRNSVRYGWRGERDTRGDSNWVPPEEVERIEVLRGPAAARYGSGAAGGVVNIITKRPTDRLRGSMTVFTNIPESSKDGATRRANFSLSGPLTEALSFRAYGSANKTDSDDTDINLGHTVNPSRTVAGREGVRNRDLSGMLSWQVTPDQVVDFEAGFSRQGNIYAGDTQNNNGTANTQGLADDGAETNRMYRENYAITHNGTWSFGTSRFVAQYDSTRNNRLEEGLAGSVEGQIGADRSFSTSKLENYRLSGELNLPLHALFEQVLTVGAEWNKETLNDPSSLKQGFVGSDSLPGTPAAGSRSPKSKAEIRALYVEDNIELRPGTMLTPGLRLDDHSDFGLNWSPSLNASQTLGEYFTVKAGIARAFKAPNLYQSNPNYLLYTRGNGCPIQTSSGGCYLVGNENLDAETSVNKELGIEFRRDGWVAGLTYFRNDYKNKIVAPLDVMGQTGTGNNILQWSNAKKAVVEGLEGNLLVPLHEDLSWSTNLTYMLQSKDKDTGNPLSVIPEYTLNSTLDWQASERLSTQLTSTIYGRQEPPKHGTSRNTPVVSRKEVGTYGIWGVSAGYTFSENLSVRGGVSNLFDKRLYRQGNSFDAGAATYNEPGRAYYVSMTTSF

SEQ ID NO: 13435 - protein, 732 aa, Pseudomonas aeruginosa
MDRRNEPSPLPTKRPLAPLMLLMAACSSPALAEDAARKDDPLELGADTVTGEQASSRVERSASAKYAVPLLDTPQTVTVVPQKVIQEQNALSLRQVLSNVSGITFNAGEGGGGSGDSINIRGFSANANMQVDGLRDSAQTSRSDLFNLEAVEVIKGPNSVFGGAGTSGGSINMVSKQPKAEAFTHLGAGLGTDRYRRLTLDTNQPLEGLGESTAFRLNLMAHHNDVAGREQIDKQRWGIAPSLTFGLDTPTRLTLSYFHQRDDNLPDYGVPALNGRKLDGVSRHDYFGWRNLDEERIDNDVATLKLEHDFSDDFQLQNLIRYSHLHRDTVISASHVNQKGLPPGRYLPAGPQAYGRDSKTRMWINQTNLTGRFDTFGLAHTLIGGFELSRETYDRTTYSYNLGKFYPANGFDLHNPPGYWNGPTDKRDSARNRTELEVKALYAFDTIALDERWDLSLGLRYDWIDGTSRSTPSGKPTVRADSSDGKLSTRAGLVFKPLENGRVYVSYGTSFNPSAEHLVTTGSGVTEATGGLAPEKNSTYELGTKWEFLGRRLELDAALFQVKKEDARERLADGSYVLAGEQRVRGLELSASGKLNEHWDLFATYTYLDSETLKSSNTQREGQALGNTPPRSLSLWSTYELPEGVTLGYGARYVSQRNVTSVDNGKLDAYWVHNMMLGYQATRDLKLQLNLDNLFDKAYVERVRQVYGNQSRSSAIEYGDGRTAILSAIYAF

SEQ ID NO: 13436 - protein, 365 aa, Haemophilus influenzae
LIVGAFAASAANAAVAYNNEGTKVELGGRLSVIAEQSSNTLDDQKQQHGALRNQGSRFHIKATHNFGDGFYAQGYLETRFVTDITKNHSDHFGDITTEYAYVTLGNKAFGEVKLGRAKTIADDITSAEDKEYGVLNNSKYIRTNGNTVGYTFKGIDGLVLGANYLLAQERHPTNYTDPVGELVPQTISNGVQVGAKYDANNIIAGIAFGRTNYKENMKISVVEPGRKEQVEGVLSTLGYHFSDLGLLVSLDSGYAKTKNHKQVKVTTAATTTNKPAYDEKRYFVSPGFQYELMEDTNVYGNFKYERTSSGEGKKTHEQAVLFGVDHKLHKQVLTYIEGAYARTKTNNTGNPEKTEKGKSVGVGLR

SEQ ID NO: 13437 - protein, 368 aa, Haemophilus influenzae
LIVGAFAASAANAAVVYNNEGTKVELGGRLSVIAEQSSNTLDDQKQQHGALRNQGSRFHIKATHNFGDGFYAQGYLETRFVTDITKHYSDHFGDITTKYAYVTLGNKAFGEVKLGRAKTIADGITSAEDKEYGVLNNSEYIHTNGNTVGYTFKGIDGLVLGANYLLAQERHPTTHTDPVGELVSQTISNGVQVGAKYDANNIIAGIAFGRTNYKANMRISFGAPGRKEQVEGVLSTLGYHFSDLGLLVSLDSGYAKTKNHKQVKDYNTAYRDNKPAYDEKRYFVSPGFQYELMEDTNVYGNFKYERTSSDEGKKTHEQAVLFGVDHKLHKQVLTYIEGAYARTKTNNTGKPEKTEKGKSVGVGLRVYF

SEQ ID NO: 13438 - protein, 364 aa, Haemophilus influenzae
LIVGAFAASAANAAVVYNNEGTNVELGGRLSVIAEQSSNTVDVQKQQHGALRNQESRFHIKATHNFGDGFYAQGYLETRLVTEGTQDNADHFGDITTKYAYVTLGNKAFGEVKLGRAETIADGITSAEDKEYGVLNNSKYVHTNGNTVGYTFKGIDGLVLGANYLLAQQRFHNGQGVALNKGGEVYPQAISNGVQVGAKYDANNIIAGIAYGRTNYRENTTGNLHMISDRKEQVEGVLSTLGYHFSDLGLLVSLDSGYAKTKNHTITTTTAGPQKTKPAYDEKRYFVSPGFQYELMEDTNVYGNFKYERTSSDEGEKTHEQAVLFGVDHKLHKQVLTYIEGAYARTKTNDKGKPEKTEKEKSVG

SEQ ID NO: 13439 - protein, 364 aa, Haemophilus influenzae
LIVGAFAASAANAAVVYNNEGTNVELGGRLSVIAEQSSNTIDVQKQQHGALRNQGSHFHIKATHNFGDGFYAQGYLETRLVTEGTQDNADHFGDITTKYAYVTLGNKAFGEVKLGRAKTIADGITSAEDKEYGVLNNSKYVRTNGNTVGYTFKGIDGLVLGANYLLAQQRFHNNQGVALNKGGEVYPQAISNGVQVGAKYDANNIIAGIAYGRTNYRENTTDVLRIISGRKEQVEGVLSTLGYHFSDLGLLVSLDSGYAKTKNHTTTITTTNLKQTKPAYDEKRYFVSPGFQYELMEDTNVYGNFKYERTSSDEGKKTHEQAVLFGVDHKLHKQVLTYIEGAYARTKTNDKDKAEKTEKEKSVG

SEQ ID NO: 13440 - protein, 360 aa, Haemophilus influenzae
LIVGAFAASAANAAVVYNNEGTNVELGGRLSVIAEQSSNTVDDQKQQHGALRNQGSRFHIKATHNFGDGFYAQGYLETRLVTEGTQDNADHFGDITTKYAYVTLGNKAFGEVKLGRAKTIADGITSAEDKEYGVLNNSKYVRTNGNTVGYTFKGIDGLVLGANYLLAQQRLHSNQGVIINKGGEVYPQAISNGVQVGAKYDANNIIAGIAYGRTNYRENTTGNLRMIPGRKEQVEGVLSTLGYHFSDLGLLVSLDSGYAKTKNHTITGQKETKPAYDEKRYFVSPGFQYELMEDTNVYGNFKYERTSSDEGKKTHEQAVLFGVDHKLHKQVLTYIEGAYARTKTNDKDKAEKTEKEKSVG

SEQ ID NO: 13441 - protein, 362 aa, Haemophilus influenzae
LIVGAFAASAANAAVVYNNEGTNVELGGRLSVIAEQSSNTVDVQKQQHGALRNQESRFHIKATHNFGDGFYAQGYLETRLVTEGTQDNADHFGDITTKYAYVTLGNKAFGEVKLGRAETIADGITSAEDKEYGVLNNSKYVHTNGNTVGYTFKGIDGLVLGANYLLAQQRFHNGQGVTLNKGGEVYPQAISNGVQVGAKYDANNIIAGIAYGRTNYRENTTGNLHMISDRKEQVEGVLSTLGYHFSDLGLLVSLDSGYAKTKNHTITTTGQQKTKPACDEKRYFVSPGFQYELMEDTNVYGNFKYERTSSDEGEKTHEQAVLFGVDHKLHKQVLTYIEGRYARTKTNDKGKPEKTEKEKSVG

SEQ ID NO: 13442 - protein, 361 aa, Haemophilus influenzae
LIVGAFAASAANAAVVYNNEGTKVELGGRLSVIAEQSSNTLDDQKQQHGALRNQGSRFHIKATHNFGDGFYAQGYLETRLVTNPNGFTHEDRDGFGDITTKYAYVTLGNKALGEVKLGRAKTIADGITSAEDKEYGVLNNSKYVPTNGNTAGYTFKGIDGLVLGANYLLAQKYDNTGGNDGEVQKQSISNGVQVGAKYDANNIVAAIAFGRTNYKEDNSPSASKRKEQLKGVLSTLGYRFSDLGLLVSLDSGYAKTKNHKQYKAAAAPAYDEKRYFVSPGFQYELMEDTNVYGNFKYERNSSDQGKKTHDQAVLFGVDHKLHKQVLTYIEGAYARPKTNGKGQTGKPEKTEKEKSVGVGLR

SEQ ID NO: 13443 - protein, 364 aa, Haemophilus influenzae
LIVGAFAASAANAAVVYNNEGTKVELGGRLSVIAEQSSNTLDDQKQQHGALRNQGSRFHIKATHNFGDGFYAQGYLETRFVTDITKHYSDHFGDITTKYAYVTLGNKAFGEVKLGRAKTIADGITSAEDKEYGVLNNSEYIHTNGNTVGYTFKGIDGLVLGANYLLAQERHPTKHTDPVGELVSQTISNGVQVGAKYDANNIIAGIAFGRTNYKANMRISFGAPGRKEQVEGVLSTLGYHFSDLGLLVSLDSGYAKTKNHKQVKDYNTAHRDNKPAYDEKRYFVSPGFQYELMEDTNVYGNFKYERTSSDEGKKTHEQAVLFGVDHKLHKQVLTYIEGAYARTKTNNTGKPEKTEKEKSVGVGF

SEQ ID NO: 13444 - protein, 368 aa, Haemophilus influenzae
LIVGAFAASAANAAVVYNNEGTKVELGGRLSVIAEQSSNTLDDQKQQHGALRNQGSRFHIKATHNFGDGFYAQGYLETRFVTDITKHYSDHFGDITTKYAYVTLGNKAFGEVKLGRAKTIADGITSAEDKEYGVLNNSEYIHTNGNTVGYTFKGIDGLVLGANYLLAQERHPTKHTDPAGELVSQTISNGVQVGAKYDANNIIAGIAFGRTNYKANMRISFGAPGRKEQVEGVLSTLGYHFSDLGLLVSLDSGYAKTKNHKQVKDYNTAHHDNKPAYDEKRYFVSPGFQYELMEDTNVYGNFKYERTSSDEGKKTHEQAVLFGVDHKLHKQVLTYIEGAYARTKTNNTGKPEKTEKGKSVGVGLRVYF

SEQ ID NO: 13445 - protein, 365 aa, Haemophilus influenzae
LIVGAFAASAANAAVVYNNEGTKVELGGRLSVIAEQSSNTLDDQKQQHGALRNQGSRFHIKATHNFGDGFYAQGYLETRFVTDITKHYSDHFGDITTKYAYVTLGNKAFGEVKLGRAKTIADGITSAEDKEYGVLNNSEYIHTNGNTVGYTFKGIDGLVLGANYLLAQERHPTKHTDPAGELVSQTISNGVQVGAKYDANNIIAGIAFGRTNYKANMRISFGAPGRKEQVEGVLSTLGYHFSDLGLLVSLDSGYAKTKNHKQVKGYNTTHRDNKPAYDEKRYFVSPGFQYELMEDTNVYGNFKYERTSSDEGKKTHEQAVLFGVDHKLHKQVLTYIEGAYARTKTNNTGKPEKTEKEKSVGVGFG

SEQ ID NO: 13446 - protein, 360 aa, Haemophilus influenzae
LIVGAFAASAANAAVIYNNEGTNVELGGRLSVIAEQSSNTLDDQEQQHGALRNQDSRFHINATHNFGDGFYVQGYLETRFVTDITKDAADHFGDITTKYAYVTLGNKAFGEVQLGRAKTIADGITSAEDKEYGVLNNSKYVPTNGNTVGYTFKGIDGLVLGAHYLLAQGRNPTNLTDPAGEVSPQSISNGVQVGAKYDANNIIAAIAFGRTNYKERLRQNAVDPRRTQQVEGVLSTLGYHFSDLGVLVSLDSGYAKTKNHKEPAGNNRNPAYDEKRYFVSPGFQYELMEDTNVYGNFKYERTSVNQGQNTREQAVLFGVDHKLHKQVLTYIEGAYARTKTNDKGKTEKTEKGKSVGVGLR

SEQ ID NO: 13447 - protein, 363 aa, Haemophilus influenzae
LIVGAFAASAANAAVVYNNEGTNVELGGRLSVIAEQSSNTVDVQKQQHGALRNQESRFHIKATHNFGDGFYAQGYLETRLVTEGTQDNADHFGDITTKYAYVTLGNKAFGEVKLGRAKTIADGITSAEDKEYGVLNNSKYVHTNGNTVGYTFKGIDGLVLGANYLLAQQRFHNGQGVALNKGGEVYPQAISNGVQVGAKYDANNIIAGIAYGRTNYRENTTGNLHMISDRKEQVEGVLSTLGYHFSDLGLLVSLDSGYAKTKNHTITTTAGQPKTKPAYDEKRYFVSPGFQYELMEDTNVYGNFKYERTSSDEGEKTHEQAVLFGVDHKLHKQVLTYIEGAYARTKTNDKGKAEKTEKEKSVG

SEQ ID NO: 13448 - protein, 238 aa, Haemophilus influenzae
LISGSSFAYSGNNDASDVSGVMNGSFYVSGSYSPSFPSISSFDISESDRGGSYVKGYNKNLSTLNVSDPISFTQNDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGG

SEQ ID NO: 13449 - protein, 764 aa, Pseudomonas aeruginosa
MPLSPPFALRPCLALLLLSPSLALAGNAVPLTPTTITATRTEQAVDSVPSTVSVQTREQLDRQNVNNIKELVRYEPGVSVGGAGQRAGITGYNIRGIDGNRILTQIDGVELPNDFFSGPYAQTHRNYVDPDIVKRVEILRGPASALYGSNAIGGAVSYFTLDPSDIIKDGKDVGARLKAGYESASHSWLTSATVAGRADDFDGLLHYGYRQGHETESNGGHGGTGLSRSEANPEDADSYSLLGKLGWNYAEGSRFGLVFEKYKSDVDTDQKSAYGGPYDKGKPAIPPSMLPGGMYQWRKGNDTLTRERYGLEHHFLLDSQVADRIQWSLNYQLAKTDQATREFYYPITRKVLRTRDTTYKERLWVFDSQLDKSFAIGETEHLLSYGINLKHQKVTGMRSGTGTNLDTGADSPRDALERSSDFPDPTVKTYALFAQDSISWNDWTFTPGLRYDYTRMEPHITDEFLRTMKQSQNTAVDESDKKWHRVSPKFGVTYDFAQHYTWYGQYAQGFRTPTAKALYGRFENLQAGYHIEPNPNLKPEKSQSFETGLRGKFDEGSFGVAVFYNKYRDFIDEDALNTDSTGGNGQTFQSNNIERAVIKGVELKGRLELGAFGAPQGLYTQGSVAYAYGRNKDNGEPINSVNPLTGVFGLGYDEADGNYGGLLSWTLVKRKDRVDDSTFHTPDGTASQFKTPGFGVLDLSAYYRLSKDLTLNAGLYNLTDKKYWLWDDVRGYDSVGEASALAPANIDRLSQPGRNFAVNLVWDI

SEQ ID NO: 13450 - protein, 702 aa, Stenotrophomonas maltophilia
MDRFPRTARRAALVPLLLAGPALAQTDSGTIALSEITVAGNGPPAGSLTVPSVAQQREAVNATVGSVAFIDAKDFQDRYANTLRDVLKDTPGVYVQERYGQELRLSVRGSGVARGFHLRGIELLQDGIPVNLADGSGDFYQINPLSLRSLEVYKGGNALAFGATTLGGAVNAVTPTAHTAFAPNILRIDGGSFNTIRENFQFSRVSGPADFLINGTITNADGYRQHETQRTQNFNANLGYQLAPGVETRFYIGAYLTDQKLPGSLTLFNALNNPRMANPTAISGNQSRQVETERIANRTSFVLDIGKLDIDTWAIHKSLYHPIFQIIDQDGWTYGISPHWAGTFDVGGFRNDLLLGLRAFAGQNAALQFINIAGRRGAQTLNSLQSASNYEAYGENRFWLLPELALMTGAKLFSSNRTYSNKGGFTGANRFPSFANETYEGINPKIGLLWQPLPDIQVFGDVTRSRDVPDFTDLVQSSNTTTGVFVPLRAQRAWTYEAGTRGRIDRLSWDVTLYRSEIHDELINFSVNPGLGIPAATFNAPRTHHQGVEAAVSRDIVRDLTGVGDTLSITQIWTHNDFRFVRDPVFGNNRIAGIPDDVLRTVLRYDHPGGFYVAPSLDWVPRGAFADQANTLRVPGYALINLQAGIDLRNGVSVFLDARNLTDARSISDIAVVTDARTIPGGPAAFYPGTGRSVFAGMRAAF

SEQ ID NO: 13451 - protein, 654 aa, Ralstonia eutropha
MPRAMLSCRYTLQLALCFCLPLGLVNQALATGLGTFTSKVPVVIEQEEKDLTLDPDTEEIKAIAAKEFFLSQGQVPTPPLQPLPSEDDIQVPPTSPPLELGPESSPPSAEEAVDTCGYRPSAPTNITPIPLLQGSVDGTPLRVNLLGMTVFSPKELLALPALQPWQTDPPSGTAPLIIDTNLTAAEFEVLYQGIVEGITQLYINQGYITSQAIAKPIEPVKNGEFLEQPIQVVEGQVESIQVRGRGRLRPAYICDRVARGVHSPINVGQLEESLRLLQINPMLEKVQASLLPTGKVGLSNLSVTVEEAFPFSANLSFDNYSPISLGSERIGLSLDYKNLTGLGDRLSGSYYVSTTGGLDILDFNYQVPLNPTDGTLNLRFVPTWTRITQSPFDVFDITGSNPLYEISYRQPLWTSLTDEFALSFGFRYQDGRTLGLNRPDLTNFSRTSVFQFGQDYTLRDPNGLWFFRSQMNLGTGLFDATTNPDPLPSGKFFSWLGQAQRLQRLDDNNLLIVQADLQLTPDSLLPDYLFIIGGGQSLRGYRQNARSADNGVRLSVENRITLARDGDNKSVFELAPFVDFGAVWNSAGNPTQLPPNSVLVGPGLGLIWRDILGMTGLSFRFDYGIPVIKLDNLTGNWQNDGLYFQLNYRPPFGK

SEQ ID NO: 13452 - protein, 912 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGAVPGGAVPGGFGPGGFGPVLDGWYGVDVSGSSVELAQSIVEAPELGAAIRVGRGARVTVSGGSLFAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVRTNGIAHRTELRGTRAELGLGMAAALGRGHSLYASYEYSKGPKLAMPWTFHAGYRYSW

SEQ ID NO: 13453 - protein, 915 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGFGPGGFGPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 13454 - protein, 152 aa, Campylobacter jejuni
YNGEVLPFKTKIDGITHKSGKDNNSPLKASFLAGGGAFGYKMDDIRVDVEGLYSQLSKDADVVDTSSAVPAVVESLTAFSGLVNVYYDIAIEDMPITPYVGVGVGAAYVSNPLVTEVTGDKKSGFGFAYQAKAGVSYDVTPEIKLYAGARYF

SEQ ID NO: 13455 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDKDKYTHKQSSRESYHAGLKYENAGFFGQYAGSFAKYADLKDNAERVAVNTANAHPVKDYQVHRVVAGYDANDLYVSVAGQYEAAKNNTGTVGKQGKKHEQTQVAATAAYRFGNVTPRVSYAHGFKAKVNGVKDANYQYDQVIVGADYDFSKRTSALVSAGWLKQGKGAGKVEQTASM

SEQ ID NO: 13456 - protein, 417 aa, Pseudomonas putida
MSGKTTTMNRTHFLSAAWLATVALPMPALADFIGDSHARLELRNHYINRDFRQSNAPQAKAEEWGQGFTAKLESGFTEGPVGFGVDALGQLGIKLDSSRDRRNTGLLPFGPNSHEPVDDYSELGLTGKVRVSKSTLRLGTLQPILPVVVYNDTRLLASSFQGGLLTSQDLDGLTFNAGRLTKANLRDSSGRDDIGYGAASSDHLDFGGGSYAITPQTTVSYYYAKLQDIYRQQFVGLIDTRPLAEGVSLRSDLRYFDSRNDGAERAGNIDNRNFNAMFTLGVRAHKFTATWQQMSGDSAFPFVNGGDPFTVNLVTYNTFTRAGLDSWQVRYDYDFVAMGIPGLSFMTRYTDGRHAETATVTNGRERERDTDITYVIQSGPFKDVSLRWRNVTFRSGNGLTNAVDENRLIIGYTLALW

SEQ ID NO: 13457 - protein, 377 aa, Escherichia coli
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADVGATYYFNKNMSTYVDYKINLLDEDDSFYAANGISTDDIVALGLVYQF

SEQ ID NO: 13458 - protein, 187 aa, Ralstonia sp. U2
MMIIRKYFLIIALLLMPWLAIPSVSAADKGWFNTFTDNVAETWRQPEHYDLYVPAITWHARFAYDKEKTDRYNERPWGVGFGQSRWDDKGNWHGLYMMAFKDSFNKWEPIGGYGWEKTWRPLEDDNFRLGLGFTAGVTARDNWNYIPIPVLLPLASIGYGPATFQMTYIPGSYNNGNVYFAWMRFQF

SEQ ID NO: 13459 - protein, 1070 aa, Moraxella catarrhalis
MNQSKKSKKSKQVLKLSALSLGLLNITQVALANTTADKAEATDKTNLVVVLDETVVTAKKNARKANEVTGLGKVVKTAETINKEQVLNIRDLTRYDPGIAVVEQGRGASSGYSIRGMDKNRVAVLVDGINQAQHYALQGPVAGKNYAAGGAINEIEYENVRSVEISKGANSSEYGSGALSGSVAFVTKTADDIIKDGKDWGVQTKTAYASKNNAWVNSVAAAGKAGSFSGLIIYTDRRGQEYKAHDDAYQGSQSFDRAVATTDPNNPKFLIANECANGNYEACAAGGQTKLQAKPTNVRDKVNVKDYTGPNRLIPNPLTQDSKSLLLRPGYQLNDKHYVGGVYEITKQNYAMQDKTVPAYLTVHDIEKSRLSNHGQANGYYQGNNLGERIRDAIGANSGYGINYAHGVFYDEKHQKDRLGLEYVYDSKGENKWFDDVRVSYDKQDITLRSQLTNTHCSTYPHIDKNCTPDVNKPFSVKEVDNNAYKEQHNLIKAVFNKKMALGNTHHHINLQVGYDKFNSSLSREDYRLATHQSYQKLDYTPPSNPLPDKFKPILGSNNRPICLDAYGYGHDHPQACNAKNSTYQNFAIKKGIEQYNQTNTDKIDYQAVIDQYDKQNPNSTLKPFEKIKQSLGQEKYDEIDRLGFNAYKDLRNEWAGWTNDNSQQNANKGTDNIYQPNQATVVKDDKCKYSETNSYADCSTTRHISGDNYFIALKDNMTINKYVDLGLGARYDRIKHKSDVPLVDNSASNQLSWNFGVVVKPTNWLDIAYRSSQGFRMPSFSEMYGERFGVTIGKGTQHGCKGLYYICQQTVHQTKLKPEKSFNQEIGATLHNHLGSLEVSYFKNRYTDLIVGKSEEIRTLTQGDNAGKQRGKGDLGFHNGQDADLTGINILGRLDLNAVNSRLPYGLYSTLAYNKVDVKGKTLNPTLAGTNILFDAIQPSRYVVGLGYDAPSQKWGANAIFTHSDAKNPSELLADKNLGNGNIQTKQATKAKSTPWQTLDLSGYVNIKDNFTLRAGVYNVFNTYYTTWEALRQTAEGAVNQHTGLSQDKHYGRYAAPGRNYQLALEMKF

SEQ ID NO: 13460 - protein, 774 aa, Moraxella catarrhalis
MNQRYLYVLVAGALTCLQPIKAERVNENVNDTIKTYNIGEVIVTSSTKETNDLRTLPGAVSILSPQAIATRQIDALKDISAFVPNLYMPDYGSKMTSAIYIRGIGARSSGQSIGLYVDNVPYLDKSAFDFELNDIQRIEVLRGPQGTLYGRNAMGGIVNIYTLSPFDYQGTKVTMSMGNYGAAKAKVSQYSKIGENIGISLNGYYDRNDGFFINEYNGTKADKEESAGGRFKLEGYITDHLKAQYTFNYDYVTQKAFPYGQYDPQTGAVQPIRINDPSSYWRRTLNNSLYLEWKTDRFILSSTTAYQYLKDDMKMDQDYTEQSVFTLHQKQKQYAWSEELAIKSNTKSNYQWSFGAYGFYNSLNTDGPVIFKKDGLTGILQKAFDDILANNPKAPKLTVQGDELNQIYFPGNFDTPTYGFAAFHQSTYNNLFVEGLSITAGIRLDYEKANLDYHSAVDSMKIGVEMGPMKMTLPVTTTMDGKISQDFLQVLPKVSLRYQCTPETFTYVSVAKGYKTGGYNVQMFGDLVQAQAKYDLMSKFAPDKAEQPGEVKDIASYKPEHSWNYEAGIRSELVRGRLSAELTFFYMDIRDLQLTSFAENGSGRMITNGGKANSYGVELSLRSRITDGLTADLNYGFTRATFRDYIFTDKDENSQIVKTDCKDNFIPYTPRHTVSLGLQYTKLLHRKMIDQFIASAQFTGAGKIFWTEKNDISQPFYGLVNAKVGVRKGIVNLNLWSRNITNTDYQAFYFESFNQSFIQKGKPFQIGGEITVTF

SEQ ID NO: 13461 - protein, 692 aa, Moraxella catarrhalis
MSKSFRLGLMAGATFCLLSSAAHGANSAADADQRAIVDSVIVTARANPEDPPVVAAARRRLSETPGGVSVISQESYIDRQTLALDDMLRDAPGVYAQRKWGGDIRISIRGSGIGNANHNRGLLIAQDGVPLNEADGFGDSQVADPLNTRYVEVYRGGNALRFGGALLGGAINMVTPTGKDAGFDNQVRVDGGSYGLLREHVAIARQSGDGAGDWDVYAAATNQTGQGWRSQSQQNIQFGSLNIGRSFGEGREVRFIVNGSNINQEIPGSLTLDQFNRNPRQTALGNANGDQGRNQRGVRGSLGTTWRLGDNLVFQGAVYAVWKDLDHPIFQVIDQQSRNYGAFGRFDWEGQIGGKRADAFFGAWYRTGDMDSNFYANVRGARGAPMSRTLQNAKAMDVFGEGRLFVTDRLAVVAGATWGQAERDYTSFAVPGVASTFNLKADKTYNWVSPRIGLLWQGEAGDQLFANLTRSVEPPNFSSMTPTNTGFTPVRAQKAWTGEFGARGHKGPFTYDVTLYRADLKDEMLQYAVSSSIPASTFNADKTVHQGIEAALDWTVAPHWRLRQTWTLSDFRFKDDVQFGDNRLPIVPRTFYRSEVRYDDPRGWFVAPSVEWSASDQWIDYATTKKAPGYAILNLNAGWKVSDQVSLFLDARNLADKAYVSNTQAAVTWTPTTATLWPGDGRSVFGGVTVDF

SEQ ID NO: 13462 - protein, 1000 aa, Moraxella catarrhalis
MSKSITKTQTPSVHTMTTHRLNLAIKAALFGVAVLPLSVWAQENTQTDANSDAKDTKTPVVYLDAITVTAAPSAPVSRFDTDVTGLGKTVKTADTLAKEQVQGIRDLVRYETGVSVVEQGRGGSSGFAIHGVDKNRVGITVDGIAQIQSYKDESTKRAGAGSGAMNEIEIENIAAVAINKGGNALEAGSGALGGSVAFHTKDVSDVLKSGKNLGAQSKTTYNSKNDHFSQTLAAAGKTERVEAMVQYTYRKGKENKAHSDLNGINQSLYRLGAWQQKYDLRKPNELFAGTSYITESCLASDDPKSCVQYPYVYTKARPDGIGNRNFSELSDAEKAQYLASTHPHEVVSAKDYTGIYRLLPDPMDYRSDSYLARLNIKITPNLVSKLLLEDTKQTYNIRDMRHCSYHGARLGNDGKPANGGSIVLCDDYQEYLNANDASQALFRPGANDAPIPKLAYARSSVFNQEHGKTRYGLSFEFKPDTPWFKQAKLNLHQQNIQIINHDIKKSCSQYPKVDLNCGISEIGHYEYQNNYRYKEGRASLTGKLDFNFDLLGQHDLTVLAGADKVKSQFRANNPRRTIIDTTQGDAIIDESTLTAQEQAKFKQSGAAWIVKNRLGRLEEKDACGNANECERAPIHGSNQYVGINNLYTPNDYVDLSFGGRLDKQRIHSTDSNIISKTYTNKSYNFGAAVHLTPDFSLLYKTAKGFRTPSFYELYNYNSTAAQHKNDPDVSFPKRAVDVKPETSNTNEYGFRYQHPWGDVEMSMFKSRYKDMLDKAIPNLTKAQQEYCKAHLDSNECVGNPPTPKTSDEVFANLYNATIKGVSVKGKLDLHAMTSKLPDGLEMTLGYGHTKLGKFDYIAPKDADGWYQARPAFWDAITPARYVVGLNYDHPSQVWGIGTTLTHSKQKDENELSALRIRNGKRETQTLTHTIPKAYTLLDMTGYYSPTESITARLGINNVLNTRYTTWEAARQLPSEAASSTQSTRYIAPGRSYFASLEMKF

SEQ ID NO: 13463 - protein, 712 aa, Vibrio vulnificus
MYNRTFLSASILFALATPVQAQDAGLFDEVVVSATRTNQTMDAVAASVTVISDKDLESKMAKDLNDVFEYTPGVTINSTQRQGVQSINIRGMEGKRVKILVDGASQPGVFDGGPYSFINSSAVTVDPDMLKSVEIVKGAASSLHGSDAIGGVVAFETKDPADFLKNGKEFGGQAKLSYSSEDKSFSEHVAVAKRFNNVEALVAYSRRDGKELQNFSKAPYDDYSVESQDYVKNDLLIKLQSQLSDDHRLEFLGEVIYNQNDSDIASSSYKNFNSEDTTKQNRLGLKHIWLVDTTITDSITSRLTWTDKEENGLTNRFKEASAGVPPRVPPNGDNQQKKDYQYAENKIELETQFDKGLETHYLVYGLSYKTSRISNTNREFNSDPNTPDKIYVYTPDAKEMSFGLFLQDEISVLNDKLVLTPGVRYDYFSTDPSDTVDESFIKFSDSAFTGRLGATYKVAQEGTLFTQISQGFRAPSFNELYYTYDNPGHGYTNRPNPNLESEKSLSYELGYRHNTIASTSEIALYYSDYTDFIEQTSTRGGGLTEYTYVNISEATIKGIEVSNTLDLNRIANLPLGMTTRFVAAYTVGEDGEGNPLNSVNPWNAVGAANYDAPNNLWGTSIKVNYTAKKSNSDINLDGNNGGTANQVELPSSTVIDLTAYFKPTQDVTVRAGIMNLTNEKYYLWNDIRGEKELSRDLTQAERNYNISVKYEF

SEQ ID NO: 13464 - protein, 283 aa, Ehrlichia chaffeensis
MNYKKIFVRSALISLVSILPYQSFADPVTSNDTGINDSKEGFYISVKYNPSISHFRKFSAEETPINGNTAITKKVFGLKKDGDIAQHGDFTRTDPALEFQNNLISGFSGSIGYAMDGPRIELEAAYQKFDAKNPDSNDTNSGDYYKYFGLSRDDAMADKKYVVLKNEGITFMSLMVNTCYDITAEGVPFIPYACAGIGADLINVFKDFNLKFSYQGKIGISYPITPEVSAFIGGYYHGVIGNNFNKIPVITPVVLEGAPQTTSALVTIDTGYFGGEVGIRFTF

SEQ ID NO: 13465 - protein, 973 aa, Sphingomonas aromaticivorans
MADGFMKHSFKQALRASACALSSMTLMASAAAVFPLSAAAQAQEAGQISGKLTNAGTGTPLAGAKILLVETGATTASRNGGRFEFRNVPAGAYTLEVSYIGLSDTTAAVSVAEGQTAEIDVAMSDLMLLDSVVVIGQRASQASGLNQQRVADNLSNVVSADQAGRFPDTNAAEALQRVPGVAINREEKGGEGRYISIRGLDSGLNNFKINGINVAQTDTETRRVPLDVVQADALSKIVVNKTLLPDMDGDGIGGSVELETGSAFDLKDRLIRFNLEGNQNDFADKLGGKVSATYGDTFGADDRFGVLVSAIYNKRHTMGYNNLQDEDYIPYFEQDEGEPVDLSGGNMLIPWWFGLGNFDNERENIGGSIALDYRLDENTSLYLKGSYNRLEDIELSSGFFIIADDDELYQDGVYNPEGGTVYRVRSEYEESVFSNSTLTVGGSTSHNQFVFDYSLGYALGIFEEPNDYEVGFEFELSGPVLYDYSDPFFPQPILSDDDQAAIRDPSNFVLGGNDIDLDDSRDEKYIGQFDVTYEPGISWLSYVKSGFKLQRSERSLFEANVLEAEGDLLLSGAIFEGGLLDTSDIGSPYGSILRLNPSSVKNWREIAEQLVADGVLENAYAGDPLDADSYEATEDIYAGYLMAKAVQGNFEFLGGARVEYLDFTSNGYELIESEDGESVLPRTSKSNNTQFLPRFQVNYRPSDKMVIRGAAYTSLARPEFLFLNAATEIEIEDSNTISAFVGNPDLKPAYAWNFDLGAEYYLNNIGLVSGGVFYKSIDDFIFIDAAPEGETSIPELNARFPGYNIDVETVFNGNRAEVYGAEFAYMNQFTNLPGALGGLGVYGNFTLQETSADTGLEGREDVPFFNAPDYVGTVALTYQKYGIEGNLAYTFRGESLEELGPYLIDKYQQSYETLDGQLRYALNKKTSIYVNAIDILDDGLDPVVNKTLGKEGRYPEDVTFNGRTVTFGVTLEF

SEQ ID NO: 13466 - protein, 726 aa, Sphingomonas aromaticivorans
MKKYGCYFVALMGATALTPQMALAQDITSESDESHATDTGLGDIIVTATRREARLQTVPVAVTAVTGDALASADVSTVRSLTQVVPGFIGSRNMGVFQPVVRGVGSTGISVGDEPNIATYVDGVYQPESAANWIDLVEVERVEVLRGPQGTTFGRNATGGLINVITPDPSFDFRGKASLRVGRMRRDAGDYDARLYFTGPMSDKVAADFAALFRKNDGYIDDLVRGGTLGNQRVIDLRSKLLFKPTDNFKVVLTGEYFNQESTTNSPQPLDGNTAGRNWPGVIVPTDAWQASLTEVPLLNLTRWSFALHTRLDLGSVMLETTSGFLNLRWQQTTDGDASNIKLSNFPAVFESESGSQEIKLSSANPGRFQWLVGGYFYQFGGGAPVLQPWSTTNPASPLAGPSLTPKLDGRSFAGFAEGTYEVQPKLFLTLGGRYTTETRWFSQSNNGVLLVDDVSKTFNKFNYKVGVRYEVTDKTNVYATYSTAFKSGVYNMAATGGTPVNPENIKAAEFGIKSDPLDWLRTNLAVYYYDYKDLQLQSKAPTGPGYILQNAANAEIYGGEFETTISPVRDLRLRAAVAYTHARYKDFPNAQGFTPIVSGNGDFAGNVAAPFDASGKVMTRAPEWSGNIGFDWGHDVGNGRVTLAGNLLWSSRVYYDFANRFSQRPYTLSNLSINWQPESEAFKVGLWVTNLTNEKVFQTIRPGTLGTDGFYEQPRKIGMTIETKF

SEQ ID NO: 13467 - protein, 832 aa, Sphingomonas aromaticivorans
MPNRLMYFRKAFLRASASAMVGYIGLVPISAHAQDAAASEPQAEEQQTGGLEEITVTARKRAENLQETPVAITAMTGGMLEERQVTNVAEVAKFAPNVNISPVANISGSSASITAFIRGVGQTDFNITVDPGVGVYVDGVYVARSVGALLDMADVSSVQVLRGPQGTLFGKNTIGGAIVVNSVEPQNDFDMKLEAATGRFNRADFKGMINVPLSDTLAMRAVASYETRDGYQKRLFDGGRQGNKDSFGGRIAFKWEPTDKLTVNLSGDINIRREEMAASTLVNLFESPNLLQVVDLNGRTVVFPSSTYAWNKLQGGAGFCGADGQLAPVNDPRCATTQWITGDIDSTWSGAKNQSDFDLWGTNLTLDYDFGDINLKSISSYRDQKATIQFDFDGTPHPYLNLTNNIDLWQASQEFQLTGSVLNDRVKFVLGGYYLKEKGQDKNNLLFGFADFFSGGKIDNDSYAAYLQATIKVTDRLSITPGIRYTDETKRFDPSFQTINVDYTAPLGQAGIIPYPQGVFIAFSQCVTGQPVPLLVTDPASPLFGFPLPGGCAPAATNPGGNHTMPAVQVAAKAKEWTPAISADYKITDDILVYASYSKGFKNGGFTQRIFPAEQVAPSFRPEFVESYELGLKTELLDRRLRLNLAAFMSNYDDIQVVVSEGIAPRARNAGSGRIKGFEVEGEAAPTDWLRLTFGVGYLDAYYRSIDPLAFPVNLNSKFAFVPEWTGSASFNADVYEGDMGKLTLRGDWSYQSETFKDAVNSPQLRQPGYSVFGASASFTEKSEHFTVTAGVTNLTDERYIQGGYVDPFVAGTALATYSRPREWFLKLAYKY

SEQ ID NO: 13468 - protein, 317 aa, Vibrio cholerae
MKKTLLALAVLAAAGSVNAAEILKSDAGTVDFYGQLRTELKFLEDKDPTIGSGSSRAGVDANYTVNDSLALQGKVEFALKDSGDMYVRNHILGVKTNFGKFSFGKQWTTSDDVYGADYSYFFGGTGLRYGTLSDALHDSQVKYVYEADSFWVKAGYGFPEDNAKQELAELYVGATFGDLAVHAGGGQNRDKAFKVGSNTVGTTTTDIKADVTNSYFEVTGEYTIGDALIGVTYYNAELDVENNPLVIDEDAISVAGTYKVADKTKLYAGYEYVMQEANTGADEDGTLVYLGVEYKFASWARVYAEYGYGDGTTLGYT

SEQ ID NO: 13469 - protein, 734 aa, Bordetella pertussis
MCDGLRASLARDVRVQHPAAPRCADDQAENTMSTNRRAVLYSAIAWVMAASAQLPAQAQPTDAETDAQVHTLQAVTIKAERKPEQAQAEQALQTVAGNTALVDNEQVERGRAASAEDVLAFQPGVFAQSTSGNAAAKISIRGSGLNTFYGGYVLGTKFLFDGLPITGPGGTQEDLLSIAGVNYTEVLYGANAFQYAATSLGGAINFVTHTGQTSPGTYLRVEAGSYGYRKQQISNGGAAGNFDWYVSLLHNSRDGYQDLTDTNGRELVANLGYRFGPRLDTRLLLRYREEELINGGTLTLAQINSGSRANPAPYGRKKGGTTLVGSKTTYVFDDDARLELGVDLNNYPLYNSWRYSTTPNLWRSTDINTSVRYLRSGDILFGRNLDTSVTWSDTRLAFGDARTHDRDSWRLLKEVRYTGSRDTVLALGGELQLDASSWLSAGVSLINIDRDVRVVQSTTANTSVYPQRYALDTWYAAPRLGLRYRLTPDLQAFANVSRSIDPPVTWQISGGGVATPFARPLVPQKATTAEAGVRGSHGILDGSLTIYRSWINDELLTVVTQQATASTDAVVANANAGPTVHQGIEAALSTRVWDGDDGSGLSLRQAYTLNDFHYRRDAAFAQNALPGLPRQVYQAELQYAHGSGFYAHLNVRAASSYYVDFANTLRAPGYGLLGAKLGYGLPSGRWSAWVDLRNLANKHYATATSTAYDLQGRDSNVFYVGDGFSVFAGASLRF

SEQ ID NO: 13470 - protein, 642 aa, Bordetella pertussis
MHIYGNMNRATPCRGAVRALALALLGAGMWTLSPPSAWALKLPSLLTDDELKLVLPTGMSLEDFKRSLQESAPSALATPPSSSPPVAKPGPGSVAEAPSGSGHKDNPSPPVVGVGPGMAESSGGHNPGVGGGTHENGLPGIGKVGGSAPGPDTSTGSGPDAGMASGAGSTSPGASGAMPPSEGERPDSGMSDSGRGGESSAGGLNPDGAGKPPREEGEPGSKSPADGGQDGPPPPRDGGDADPQPPRDDGNGEQQPPKGGGDEGQRPPPAAGNGGNGGNGNAQLPERGDDAGPKPPEGEGGDEGPQPPQGGGEQDAPEVPPVAPAPPAGNGVYDPGTHTLTTPASAAVSLASSSHGVWQAEMNALSKRMGELRLTPVAGGVWGRAFGRRQDVDNRVSREFRQTISGFELGADTALPVADGRWHVGAVAGYTNGRIKFDRGGTGDDDSVHVGAYATYIEDGGFYMDGIVRVSRIRHAFKVDDAKGRRVRGQYRGNGVGASLELGKRFTWPGAWYVEPQLEVAAFHAQGADYTASNGLRIKDDGTNSMLGRLGLHVGRQFDLGDGRVVQPYMKLSWVQEFDGKGTVRTNDIRHKVRLDGGRTELAVGVASQLGKHGSLFGSYEYAKGSRQTMPWTFHVGYRYAW

SEQ ID NO: 13471 - protein, 204 aa, Delftia acidovorans
MKRTLLAVAAVCALSSGAAFAQQAEGPWMVRVRAVNLDSANKDSTGLGLSINNKWMPELDVSYFFTPNIAAELVLTYPQKHDLRANGLGQIGSLKHLPPTLLAQYHFTNFGAFKPYVGAGVNYTRFSSVSFDPAVQAALNPSIKKNSFGGALQIGFDYALDKNWSLNFDVKKVFIETDVSSAGTKVGTFKVNPVLVGVGLGYRF

SEQ ID NO: 13472 - protein, 731 aa, Haemophilus sp.
MKKTAILIAFLSSNAFADDLAPLSIFGGQAESEIAGSATYIGDDELKKSGYIDTERIMGRVPGVFSQTEDGLGLRTNIGMRGANPNRTTKINVTEDGILQGPAVYSNSSMYFYPDSGDAEGIEVLKGATAIGNGPRTTSGAINYISRSVPTEGTKGYFNQTFGDEGYLRNHAYYGAAMGNLSFVVESHKTAYDGHKEIDAGTGAGNDDNTGFRKNSDLFKIRYTMPSSYMELSSQNTSETSHASYIGLTRADFAANENRRYSISSKDKMDNDYHRYIFTYGMDLSPTSSLTAKIYKAKYSRNWKKVGEMTVDDDGSAGGDTSTVKMSAIDWTTNCAADSTTELRACNIVTNATAMITGESIKRSLGHRDYGMYGYDMRYNTIMGAHDITIGFRSHRDYRDRHDSGISETYTLGSNNTMVMTASDYVGTGGNDDFASAESFSIIDRISHGNFVTTLGLRYEDVEYWESTDGTAGTPRENSETMIAASTVYNMGSGKSVFAGYSQGYMPTGVSSALPEESDNYEVGYRSISANSHMEIIGFYTDYENLNETCNASAGCTVGSNDQKSTGEAHAQGIEFLYRVNNLFAAPQMKGAASTGSSVRYPMILAVTLQEAEHDVTTDSNFQSGARIKYTPETIYYLSLGMETNTMDMNISAKYNDDVKNTGSLTAVSTESAWIFDLRSGMNLDGMGMQGARAFLNVDNLFDKSYIASAHNYGVRPNKPQTVMAGISSDF

SEQ ID NO: 13473 - protein, 694 aa, Enterobacter agglomerans
MNARTHRTLNRGIGVVTLSTLLASPSALARENPPAEDEPAALEALVVTGEKRERSLKDTASSVSLTSARDIDRKQTGNASVAEVINGSPNVVYTDSVGAPIIRGQDTQGPNNGQNVFWGGTVPRATINLDGHYLNYNEMFFGATSVWDVDSIEVFRGPQTTSQGANAIAGAIIVNTKDPTFSPEAAYQAEIGSYHSRRSSIAVSGPLAQDFAGRLAVDYAGRDTFIDYDNPKFQDSGTDQDFRALNARAKLLWLPSGIPGLESKFTFSHNDSNRPTQEAATRPFDKLDHRSTTMPSWEQDTNTSILDVAYDLDNGIRLFNQAQYSLSSVHRTTGAGGEGDADIRQKNASNESRVSFGEQEDRISGMGGVYYARTRTDETLHLRGLSAFDDTKKNLGVFGELNYRLSDRWTLTTGLRYQEDRIERSGNSVLAPRPLDYQKTFSAFLPKVSLAFAATPDWTVGGLVSRGYNPGGVSLNLTTRNWAYFKEETIWNYELFTRASLLDGRLVLNGNLFFMDFKDAQYNIPVVVSPGVAQSYTINAEKAHAYGMELDLDYRLRDDLRLKASAGVLRTRIDEMSGNTGYEHNEFARSPGYTLSFGPSWDVTERLNLNAQVRYLDGYYSDTANTKAYSIKAYTLTDARASYRFNDQVQLYGYVKNVFDDRSPTYMQENRGIGGIEASMTQPRTLGIGIKGTF

SEQ ID NO: 13474 - protein, 747 aa, Salmonella paratyphi A
MARLKTAQPNSSLRKIAVVVATAVSGMSVYAQAAVQPKEETITVTAAPAAQESAWGPAATIAARQSATATKTDTPIQKVPQPISVVTAEEMALHQPKSVKEALSYTPGVAVGTRGASNTYDYLIIRGFAADGQSQNNYLNGLKMQGNFYNDAVIDPYMLERAEVMRGPVSVLYGKSSPGGLLNMVSKRPTTEPLKEIQFKMGTDSLFQTGFDFSDALDEEGVYSYRLTGLARSANAQQDRAEEQRYAIAPAFTWRPDDKTNFTFLSYFQNEPETGYYGWLPKEGTVEPLPNGKRLPTDFNEGAKNNTYSRNEKMVGYSFDHEFNDIFTVRQNLRYAENKVSQNSVYGYGVCSDPANGYSKQCAALAPADKGHYLARKYVVDDEKLQNFSVDTQLQSKFATGEVDHTLLTGVDFMRMRNDINAWFGYDDSVPLLDLYNPVYTDFDFASRDPATSGPYQILNKQKQTGLYVQDQAQWDKVLVTLGGRYDWADQESLNRTTGITSKRDDKQFTWRGGVNYLFDNGITPYFSYSESFEPASQTGENGKIFAPSKGKQYEAGVKYVPNDRPIVITGAVYQLTKTNNLMADPAGSFFSVEGGEIRARGVELEAKAALSASINVVGSYTYTDAEYTTDTTYKGNTPAQVPKHMASLWGDYTFFDGPLSGLTLGTGGRFTGSSYGDPANSFKVGSYTVVDALVRYDLARVGMAGSNVALHVNNLFDREYVASCFQTYGCFWGAERQVVATATFRF

SEQ ID NO: 13475 - protein, 729 aa, Salmonella typhimurium
MARLKTAQPNSSLRKIAVVVATAVSGMSVYAQAAVQPKEETITVTAAPAAQESAWGPAPTIAAKRSATTTKTDTPIEKTPQSVSVVTNEEMQMHQFQSVKEALGYTPGVTVSSRGASNTYDFVIIRGFSSVGLSQNNYLDGLKLQGNFYNDAVIDPYMLERVELMRGPTSVLYGKSNPGGIISMVSKRPTTEPLKEIQFKMGTDNLFQTGFDFSDSLDDNGEFSYRLTGLARSTNEQQKSSESQRYAIAPSFTWRPDEKTNFTFLSYFQNEPETGYYGWLPKEGTVEPLPNGKRLPTDFNEGASNNTYSRNEKMVGYSFEHGFNDTFTVRQNLRFVEMKTAQKSVYGTGIAADGHTLNRGTIVDNERLQNFSVDTQLESKFATGDIDHTLLTGVDFMRMRNDINATFGSAPSIDLYNNYHPEYFAFGGAEPYQMNESKQTGLYVQDQAEWNKWVFTLGGRYDWSKQATTVRQNSTTPTEGYIERNDHQFTWRGGVNYVFDNGISPYFSYSQSFEPSAFDLWSTPRVSYKPSKGEQYEAGVKYVPKDMPVVVTGAVYQLTKTNNLTADPTNPLAQVPAGEIRARGVELEAKAALTANINMTASYTYTDAEYTKDTNLKGNTPEQVPEHMASLWGDYTFNEGPLSGLTLGTGGRFIGSSYGDPANSFKVGSAAVMDAVVKYDLARFGMAGSSIAVNVNNLLDREYVASCFQTYGCFWGAERQVVATATFRF

SEQ ID NO: 13476 - protein, 1133 aa, Synechococcus sp.
MKNKYLCNFQKLLRAFLIFAMFATSSQIAAAQLNVALSNARLGTMIKQIKAQSKYQFFYDDNLASIPVHAVNLKNASLETVLDKALEGKGVSYRIEDGVVYLSKKETRTAVAQVAQQATHKVTGTVTDTTGEPLIGVSIQEVGTSNGAITDIDGNYTLNVSTPSAKLRFSYIGYEAVDIDVNGQAAINVTMKDDSQLLQEVVVTALGIKREKKMLGYAVQELKSDELNKTGDPSVTSALQGKVAGLQMNTSATGLGGSTKITIRGNSSLSDNNQPLWIVDGVPFSDNNNSDASFYGGVDRGGAALDINPDDIESISVLKGPNAAALYGSRAGNGVILVTTKKGSKKTGFGVRYNGNFTWSSVAETLEQQTRYGQGQIGANGGAEYTTSASGSWGPVLDGSQQKAWNGETYAYSKYGNKLEDYFDTGFSQNHNVSVSNGTETSHYRASVGISDSKGVFPNEKLNRVNIDLNAGTELNKWMSMDGKISLSRTKATDRPEYGNYGAINQLMGIPHNVRLDDLKQYSTENRVHSNWYGPTAGIRNPYYVLNQRHNSDERWRAFGYYGAKINFTDWLHLSAKYAFDYYRTRVENTNGGDGISGESFPSQIKDDKMDRGEENFFESNAEFVLMGDRQLTDNFRLGFTAGANFMYQKFENLTAGVGNMHTKGLWMFNASNLLRTAANVERERAMNSVFGSVQMSWKEYLSLDITARNDWSSTLPKAHNSFFYPSANLSFVISDFMKSIDKPLPSWVTFAKLRLSAAQVGKDTEPYQLINTYGYKFDNGILVPDKSNVKMNDNLKPEIATSYEAGLDMKFFNNRLGFDFTYYYSKTKNQIMKVPAAAPWSGGQWVNAGLITNQGVELMLYSTIVDTKDFTFDLNVNIAHNVSKVKELAPDANVNYLFFNGDNNFPVNVGARAGEKLGEIYAQKLYKRDDSGNIIIGENGLPQTINDEKERVNNPIGNIQPDLTMSVSPTFTYKGITLSAMFDMKFGGDILSYSEMVAAGNGLAKRTENRGEKDNYMMVFPGVTESGQPNTTKITASQYYGALLAEDFLYDASFIKLKELSIGYNFPTKLLKKTPIQSLSVSFVARNLCYLLKHTPGTSPEGGYDTTMFSQAIDYAALPYTRTFGLSVSLGF

SEQ ID NO: 13477 - protein, 531 aa, Synechococcus sp.
MKRLFSALLLAPAIAGVAAGAANANGLSTEQLQKIDAVTPNGITSGQITSITELSDVKPTDWAYQALQSLVERYGCIVGYPDRTYRGSRPLSRYEFAAGLNACLDKVIEFAASKEDLDTLKRLTEEFQAELATLRGRVDSLEARVKELEATRFSTTTKLQGEVIFSLDAVANTAGNERNQDGAVSFGNRVSLNLNTSFTGKDLLLTRLRARNIETIQQRLSPGFNPSGSRLDYDGTGSPGVPNSANTFFLDKLLYRFPVGDVSFTVGTAGVQPQDYGLSDATFFSGPANTKAFKYVGAGVYADTRDADTAGVGFNWKASKNFSFQAGYINRNSADVSTVNSGGVFGFTPTGTGTNSWDVNAQVKYQTDNNKFRVALAYALRNGRYATDFGTTNAFQPFGATNYNSNNLALSLGWAISDAVTLSAGYGIGFVNEQGTNQNATVQNYAIGLTFPNLFADGNEFGVAAGQQPWVSSASNRSSEDTGSFGVETYYKFQVTDNISITPGIYVFNNTNGQQNGGTTYVPFLKTVFRF

SEQ ID NO: 13478 - protein, 1291 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNNFPNKEYDLYKSLLSSKIDGGWDWGNAARHYWVKDGQWNKLEVDMKDAVGTYNLSGLINFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNISRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTSKLMFNNLTLGPNAVMDYSQFSNVTISGNFVNNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPTDNGGNTTNLPTNTTNNARFARYALIKNAPFAQASATPNLVAINKHDFGTIESVFELANRSKDIDTLYAHSGTQGRDLLQTLLIDSHNAGYARTMIDATSANEITKQLNTANSALNNIASLEHKTSGLQTLSLSNAMILNSRLVNLSRRHTNNIDSFAQRLQALKDQKFASLESAAEVLYQFAPKYEKPTNVWANAIGGASLNSGGNTSLYGTSAGVDAYLNEKVEAIVGGFGSYGYSSFNNQANSLNSGANNANFGVYSRIFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 13479 - protein, 943 aa, Neisseria meningitidis
MNKKHGFQLTLTALAVAAAFPSYAANPETAAPDAAQTQSLKEVTVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSWGIQAKTAYGSKNRQFMKSLGAGFSKDGWEGLLIRTERQGRETHPHGDIADGVAYGINRLDAFRQTYGIKKPSEGGEYFLAEGESELKPVAKVAGNGNYLNNQLNRWVKERIEQNQPLSAEEEAMVREAQARHENLSAQAYTGGGRILPDPMDYRSGSWLAKLGYRFGGRHYVGGVFEDTKQRYDIRDMTEKQYYGTDEAKKFRDKSGVYDGDDFRDGLYFVPNIEEWKGDQKLIRGIGLKYSRTKFIDEHHRRRRMGLLYRYENEKYSDNWADKAVLSFDKQGVATDNNTLKLNCAVYPAVDKSCRASADKPYSYDSSDRFHYREQHNVLNASFEKSLKNKWTKHHLTLGFGYDASNAISRPEQLSHNAARISEYSDYTDKGDKYLLGKPEVVEGSVCGYIETLRSRKCVPRKINGSNIHISLNDRFSIGKYFDFSLGGRYDRKNFTTSEELVRSGRYVDRSWNSGIVFKPNRHFSLSYRASSGFRTPSFQELFGIDIYHDYPKGWQRPALKSEKAANREIGLQWKGDFGFLEISSFRNRYTDMIAVADHKTKLPNQAGQLTEIDIRDYYNAQNMSLQGVNILGKIDWNGVYGKLPEGLYTTLAYNRIKPKSVSNRPGLSLRSYALDAVQPSRYVLGFGYDQPEGKWGANIMLTYSKGKNPDELAYLAGDQKRYSTKRASSSWSTADVSAYLNLKKRLTLRAAIYNIGNYRYVTWESLRQTAESTANRHGGDSNYGRYAAPGRNFSLALEMKF

SEQ ID NO: 13480 - protein, 383 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPEFSGFSGSVQFVPAQNSKSAYTPAYFVQQTPQSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 13481 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDKDKYTHKQSSRDSYHAVLKYENAGFFGQYAGSFAKYADLNKDAERVAVNTPNAHAVKDYQVHRVVAGYDANDLYVSVAGQHEAAKNNMVGSTDIGKKHEQTQVAATAAYRFGNVTPRVSYAHGFKAKVNGKKAARYQYDQVIVGVDYDFSKRTSALVSAGWLQEGKDKNKTEKTASM

SEQ ID NO: 13482 - protein, 322 aa, Neisseria meningitidis
EVSRVKDAGTYKAQGGKSKTATQIADFGSKIGFKGQEDLGNGMKAIWQLEQKASIVGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRFGNVTPRVSYAHGFKAKVNGVKDANYQYDQVIVGADYDFSKRTSALVSAGWLKQGKGAGKVEQTASM

SEQ ID NO: 13483 - protein, 317 aa, Neisseria meningitidis
EVSRVKNQGVKTKTATQIADFGSKIGFKGQEDLGNGMKAIWQLEQKASIAGTNSGWGNRQSFIGLKGGFGTVRVGNLNTVLKDSGDNVNAWESGSNTGDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANDLYVSVAGQYEAAKNNDTSPATNGKKHEQTQVAATAAYRFGNVTPRVSYAHGFKAKVNGVKKASYQYDQVIVGADYDFSKRTSALVSAGWLKQGKGAGKVEQTASM

SEQ ID NO: 13484 - protein, 200 aa, Helicobacter pylori
SVENELTSFEFGAKVDQDDYSLFATLFYVETDDVNSESTNANGGARVRGYESTGLEVEASTKIGEIDLRGSMTWTDAEIVSSNDASIIGNTPRRQADFVWSLSPSYQFGEHFVGATLIGTTDSYGQDNNAYTMDGYTYINLFADFALAEGLKLQMSVNNVTDQIGITEDEGQIHTVDGNDYIRARSIAGRTAELALKYSF

SEQ ID NO: 13485 - protein, 406 aa, Helicobacter pylori
SVFELANRSDDIDTLYANSGAQGRDLLQTLLIDSHNAGYARTMIDATNANEITKQLNEANSALNNIASLEHKTSGLQTLSLSNAMILNSRLVNLSRRHTNNIDSFAQRLQALKDQKFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGALGSDQSSLNFKSALLRDLNQSYNYLAYGATTRASYGYDFVFFRNALVLKPSVGVSYNHLGSTNFESNSTHKTALKNGASSQHLFNASANVEARYYYGDTSYFYMNAGVLQEFANFGSSNAVSLNTFKVNTARNPLNTHARVMMGGELQLAKEVFLNLGFIYLHNLISNAGHFASNLGMRYSF

SEQ ID NO: 13486 - protein, 193 aa, Helicobacter pylori
FEILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYITTPLEPAVNDQKSKFGFAGQVKAGVSYDVTPEVKLYAGARYFGSYGANFDGKKADPKDSTRQVTDAGAYKVLYSTVGAEAGVAFNF

SEQ ID NO: 13487 - protein, 406 aa, Helicobacter pylori
SVFELANRSEDIDTLYAHSGAQGRDLLQTLLIDSHNAGYARTMIDATSANEITKQLNTATDALNNIASLEHKTSGLQTLSLSNAMILNSRLVNLSRRHTNNIDSFAQRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANQHEFDFEAQGALGSDQSSLNFKSALLRDLNQSYNYLAYSAATRASYGYDFVFFRNALVLKPSVGVSYNHLGSTNFESNSTHKAALKNGASNQHLFNASANVEARYYYGDTSYFYMNAGVLQEFANFGSSNALSLNTFKVNAARNPLNTHARVMMGGELKLAKEVFLNLGFIYLHNLISNASHFASNLGMRYSF

SEQ ID NO: 13488 - protein, 656 aa, Escherichia coli
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFEGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIAYTF

SEQ ID NO: 13489 - protein, 672 aa, Escherichia coli
MIVSAAPQVVSELDTPAAVSVVDGEEMRLATSRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 13490 - protein, 664 aa, Salmonella typhimurium
MAHTTAHKSSILLTGLLCSTALTVFSATKGHAEDDGVLSLDPIIVKQRDADGDAADRATAVYVADAEIERAAMGDLKDLFAGIASVSVGGAIPVAQKIYVNGIDMLKLAVQVDGVSQNNRVFHHASANAFDPGLMKSVRVDPGVAPADAGPGALAGRVVMETIDAEDILTEGQAIGGKTRLSYGENGDTFGTSLTLAGQSNGFEILLYGKRMTGDDYTDGAGNTVGGTRSDLTAGLLKLAYETDTGHRFEFSGQQMQDTALRNRRANFGTASFNPLDTVYDTKRTVYSLRYEDVNGGGNWDPSATIGFSENEIGSRRTAETSVGVTRTYSATFQNRFHLSESDTITAGIDFQDQKSSASGDYWGANRPSETSQTIGVFAQARLQPSDRLKVSAGLRYDWNAFTGQDFGQSGRPYEQDSSGLSGNLSIVYDVNDALSLRAGYSNVFGGIGIEDNFLFFRDWDYSALKPRRASNVVVGADWQSGNWTLGAEAFQTKIDDTRDVAGPTVTSYDFESRGYNLGATYGWDSGFARLTFTDSETRVNGAATSSYYVLDSGAPIGQVLALEVQQELPQWDLVVGGHIDAAFDYDQQLNEADATTQLEGYEVLNLFAEYRPAAYDNVTIRAEINNVFDRQYADRATYGGDYPGFATLKEPGRSVSLVANVSF

SEQ ID NO: 13491 - protein, 315 aa, Klebsiella pneumoniae
MMKRNILAVVIPALLVAGAANAAEIYNKNGNKLDFYGKMVGEHVWTTNGDTSSDDTTYARIGLKGETQINDQLIGYGQWEYNMDASNVEGSQTTKTRLAFAGLKAGEYGSFDYGRNYGAIYDVEAATDMLVEWGGDGWNYTDNYMTGRTNGVATYRNSDFFGLVDGLSFALQYQGKNDHDRAIRKQNGDGFSTAATYAFDNGIALSAGYSSSNRSVDQKADGNGDKAEAWATSAKYDANNIYAAVMYSQTYNMTPEEDNHFAGKTQNFEAVVQYQFDFGLRPSIGYVQTKGKDLQSRAGFSGGDADLVKYIEVGT

SEQ ID NO: 13492 - protein, 383 aa, Klebsiella pneumoniae
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLVFAGLKFGDYGSFDYGRNYGVLYDVEGWTDMLPEFGGDSYTYADNYMTGRANGVATYRNTDFFGLVDGLNFALQYQGKNESQSADDVNIGTNNRNNGDDIRYDNGDGFGISTTYDIGMGFSAGAAYTTSDRTNEQVNAGGTIAGGDKADAWTAGLKYDANNIYLATMYSETRNMTPYGKTDAGYAGGVANKTQNFEVTAQYQFDFGLRPAVSFLMSKGKDLTYNNVNGDDKDLVKYADVGATYYFNKNFSTYVDYKINLLDDDDQFYKDAGISTDDIVALGMVYQF

SEQ ID NO: 13493 - protein, 985 aa, Pseudomonas tolaasii
MITDSPRFKPFTAGSLLLLSVAAHGQYLEAGKPGDPASWRSTEFQSDWGLDRMKANEAYAAGITGSGVKIGALDSGFDPNHPEASKDRYHAVTASGTYVDGSPFNTTGALNPNNDSHGTHVTGTMGAARDGVGMHGVAYNAQIYVGNTNANDSFLFGPTPDPQYFKAVYSALVDSGVRAINNSWGSQPKDVSYQTLGDLHAAYAQHYNQNTWLDAAADVAKAGVINVFSAGNSGYANASVRSALPYFQPGLEGHWLAVSGLDKANNQKYNQCGIAKYWCISTPGALINSTIPEGGYGVKSGTSMSAPHATGALALVMERYPYLNNEQALQVLLTTATQLNGAVTDAPTTQVGWGVPDLGRAMHGPGQLLGPMTVTLAAGQGDVWSNAISDKALIQRQAEDRAETLAWQQTLRDKGWENGVGAGASQQDQTDYAVGTARAAAAAQRIYEGSLTKSGAGSLILTGDNTYRGPTTVNGGRLAVNGSLTSAVTVNDSGTLGGSGRIAALQVNNGGTVAPGNSVGTLQVAGDVNLAAGSTYAVELTPTRSDQIVATGKATLGGGTVTLALENSPTLLSQQQAESLVGRQYTILQAAGGIQGQFGAVLPNYLFLGGTLDYAANGVQLAIARSDASFASVGATRNQRSVAAAAEQLGAGNPVYESILRSDSLATAQQGFQQLSGEIYPAIGTMLINDSRQVRDAVGERLRHTPVAGESNVWVKALGSWGKTDSRSETAGYTSSLGGMLAGVDGALDDQTRVGLVAGYSDSSLNMGSGTHSSASIDSYHLGAYAGHELGNWRLSVGGAYSWHRGDVKRDLQYGEVSGKQKARLDARSAQVFTEAAYRLNVPAVALEPFANLAYVHLDNERFHEKGDAAALARGSDSRDAVLSTLGLRASKTLALNDRQQLDVSGSLGWQHSLSAVESEEHLAFVAGGPSFAVQSSPLMRDAALVGVQASLALSKSTRVNLDYTGQLAGREKIQGVGLSLNWQF

SEQ ID NO: 13494 - protein, 351 aa, Neisseria meningitidis
GVEGRNYQLQLTEQPSRTQGQTSNQVKVTKAKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPDFSGFSGSVQFVPAQNSKSAYKPAYVDEKKMVHAAVVGKPGSDVYYAGLNYKNGGFAGNYAFKYAKHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAA

SEQ ID NO: 13495 - protein, 351 aa, Neisseria meningitidis
GVEGRNIQLQLTEPLPNIQPQVTKRKSRIRTKISDFGLFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRPTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 13496 - protein, 358 aa, Neisseria meningitidis
GTSQFAMASAQDYSKGFVEDSTFSINTRALYFSRDFRNNPSGPGSKSRAEETGLGFNALYESGFTQGTIGVGVDVIGLMGVKLDSGKGRAGTGLFPTGSDGRSQDDYSKGGGAVKFRISNTVLKVGDQYTTAPVFASDDSRLLPELPQGISITSNEIKGLKLEGGHFTSSVAQNQTYHDSLGLTKTDFVGGVYAFTPEVTGSLYYAKTEDYFRKYYSNLNWTHALSNDQSFALDFNIYDTKSDGAGLQRAEKDGVTKLDNRAFSLQGAYTIGAHTFTLAAQKVTGDGDYGYGVDGGGTVFLANSIARSDFNAEGEKSYQARYDINMATFGIPGLSFMTRYVTGSGANTGTTSNGKEWN

SEQ ID NO: 13497 - protein, 389 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 13498 - protein, 388 aa, Neisseria meningitidis
MRKKLTALVLSALPLAAVADVSLYGEIKAGVEGNNIQLQLTEPPSKGQTGNKVTKGKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRSTLVPAVVGKPGSDVYYAGLNYKNGGFAGNYAFKYAKHANVGRDAFELFLIGSATSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 13499 - protein, 243 aa, Neisseria gonorrhoeae
LAAKLSYPIADDLDIYTRLGGMIWRADSKANYGRTGERLSNHDTGVSPLAAVGVEYALTKNWATRLDYQFVSNIGDAGTVGARPDNTMLSLGVSYRFGQDDVVAPAPAPAPAPVVETKLFTLKSDVLFNSAKSSLKPEGQQALDQLYTQLSSMDPKDGSVVVLGYTDPVGKDAANQKLSEARARSVVDYLVSKGIPADKISARGMGEADQVTDSCGYKNGRATKAQIECLAPNRRVEIEVKGI

SEQ ID NO: 13500 - protein, 920 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGFGPGGFGPGGFGPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 13501 - protein, 388 aa, Neisseria meningitidis
MRKKLTALVLSALPLAAVADVSLYGEIKAGVEGNNIQLQLTEPPSKGQTGNKVTKGKSRIRTKINDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATYTVDSSGVFTPVPAVVGKPGSDVYYAGLNYKNGGFAGNYAFKYAKHANVGRDAFNLFLLGRIGEDDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAASVGLRHKF

SEQ ID NO: 13502 - protein, 1112 aa, Myxococcus xanthus
MHLLLVPCFFRQAHRGPSYIKHRNALQLATASLVVSSALTDPACAQDIVVNNGQTAVFVASRTLNSVTNNGGVVSVAAAGVTLNTNFVQQGGTTRIAAGGTLSDSDGVVAVSGGELQNNGGGTISSAVSISGGTLTASGGTFGGNVTISGAGTLNLDSSAIVGTTTMTGGNIDVNNGSTLQTDLVQSGGTTTIKSGGTLTDSGGTTLSGGVIENSGTITNAVALTGGTLTNTTGGTVNGLTTVQSGTLNASGGTFVGGVTAQGGTVNITTSQTLDLTNNGSVININTGVNLTDDLVNNSGTLNIAGTLTGNLTNSATVYVAGTITGNVINNSSLIFNRSDAPTYGGAISGTGSLTKSGAGTLTLTGSSTHTGGTVISAGTLQIGDGGTSGNIGGDISNSAALVFNRADALTYGGAISGTGSLTKSGAGTLTLTGSSTHTGGTVISAGTLQIGDGGTSGSIVGDISNSAALVFNRSDALTYGGAISGTGSLTKSGAGTLTLTGSSTHTGGTVISAGTLQIGDGGTSGSIGGDITNNADLIFNRSDALTYGSVISGSGSLTKSGAGTLTLTEVNTHTGGTTVSAGKLVVNGSIGAITLNGGTLGGSGTVGGFTARSGSKIAPGNSIGTLNVAGNAMFDSGSAYEVEVDSAGNADRIVATGGVNIDSDATVNILAENGTDDGSGFAPSTTYTIITAGTAVTGKFGTVTDNFAFLDAALGYDDPKAVTLTLTRNASSFASVGKTANQRAVANAVSSGATGNRVFDAVVGLSADGARAAFDSLSGEIHASLPSLFLNDSARLRDTVTSRIHDAFAGFSEVPEIAFNGPVGPRGPGLGTGSGFNLTTWGSAYGAYGKLDGDGNAATLSRSTGGALVGLEATAWPQARFGLLAGLGQSQASVSARASSADANSYTLGAYGGVRLSDLGLTFGAAYCWHDVTSERAVAAGGLKDTLTADYWSRTAQVFGEASYALETPWLQVSPFAGLALLHQQTDAFQEQGSAALALTGDGSSQLLGSSTLGLRMSKTLATTDSVSVALTGAFGWRHAIGDLTPDQRMALSGLDPFTVQGVPLDRDTALVEAGLALTITDRTTLGLSYQGAFGENASDQGANARVNIRF

SEQ ID NO: 13503 - protein, 213 aa, Brucella canis
MRTLKSLVIVSAALLPFSATAFAADAIQEQPPVPAPVEVAPQYSWAGGYTGLYLGYGWNKAKTSTVGSIKPDDWKAGAFAGWNFQKDQIVYGVEGDAGYSWAKKSKDGLEVKQGFEGSLRARVGYDLNPVMPYLTAGIAGSQIKLNNGLDDESKFRVGWTAGAGLEAKLTDNILGRVEYRYTQYGNKNYDLAGTTVRNKLDTQDIRVGIGYKF

SEQ ID NO: 13504 - protein, 213 aa, Brucella melitensis
MRTLKSLVIVSAALLPFSATAFAADAIQEQPPVPAPVEVAPQYSWAGGYTGLYLGYGWNKAKTSTVGSIKPDDWKAGAFAGWNFQQDQIVYGVEGDAGYSWAKKSKDGLEVKQGFEGSLRARVGYDLNPVMPYLTAGIAGSQIKLNNGLDDESKFRVGWTAGAGLEAKLTDNILGRVEYRYTQYGNKNYDLAGTNVRNKLDTQDIRVGIGYKF

SEQ ID NO: 13505 - protein, 213 aa, Brucella neotomae
MRTLKSLVIVSAALLPFSATAFAADAIQEQPPVPAPVEVAPQYSWAGGYTGLYLGYGWNKAKTSTVGSIKPDDWKAGAFAGWNFQQDQIVYGVEGDAGYSWAKKSKDGLEVKQGFEGSLGARVGYDLNPVMPYLTAGIAGSQIKLNNGLDDESKFRVGWTAGAGLEAKLTDNILGRVEYRYTQYGNKNYDLAGTTVRNKLDTQDIRVGIGYKF

SEQ ID NO: 13506 - protein, 213 aa, Brucella ovis
MRTLKSLVIVSAALLPFSATAFAADAIQEQPPVPAPVEVAPQYSWAGGYTGLYLGYGWNKAKTSTVGSIKPDDWKAGAFAGWNFQQDQIVYGVEGDAGYSWAKKSKDGLEVKQGFEGSLRARVGYDLNPVMPYLTAGIAGSQIKLNNGLDDESKFRVGWTAGAGLEAKLTDNILGRVEYRYTQYGNKNYDLAGTTVRNKLDTQDIRVGIGYKF

SEQ ID NO: 13507 - protein, 367 aa, Brucella ovis
MNIKSLLLGSAAALVAASGAQAADAIVAPEPEAVEYVRVCDAYGAGYFYIPGTETCLRISGYVRYDVKGGDDVYTGSDRKGWDKGARFALMFNTNSETELGTLGTYTQLRFNYTSNNSRHDGQYGDFSDDRDVADGGVSTGTDLQFAYITLGGFKVGIDESEFHTFTGYLGDVINDDVVAAGSYRTGKIAYTFTGGNGFSAVIALEQGGEDVDNDYTIDGYMPHVVGGLKYAGGWGSIAGVVAYDSVIEEWATKVRGDVNITDRFSVWLQGAYSSAATPNQNYGQWGGDWAVWGGAKFIATEKATFNLQAAHDDWGKTAVTANVAYQLVPGFTITPEVSYTKFGGEWKDTVAEDNAWGGIVRFQRSF

SEQ ID NO: 13508 - protein, 351 aa, Delftia acidovorans
MKKSLIALAVLAASGAAMAQSSVTLFGIVDTNVAYVNKDAAGDSRYGLGTSGASTSRLGLRGTEDLGGGLKAGFWLEGEIFGDDGNASGFNFKRRSTVSLSGNFGEVRLGRDLVPTFQKLTSYDLFSATGIGQFMGFRNWAAGQGADDNGIRANNLISYYTPNFGGFNAGFGYAFDEKQTIGTADSVGRYIGGYVAYDNGPLSASLGLAQQKTAVGGLATDRDEITLGASYNFGVAKLTGLLQQTKFKRDIGGDIKTNSYMLGASAPVGGVGEVKLQYALYDQKAIDSKAHQITLGYVHNLSKRTALYGNLAFLKNKDLSTLGLQAKGVYAGGVQAGESQTGVQVGIRHAF

SEQ ID NO: 13509 - protein, 967 aa, Pasteurella multocida
MAKTATKAILNLTKVIQVIALWCMLSTGVQAQTVIISGKVIDKLSKAAIPGAGVSLKGTSIATVTDRDGKFSLKPTGQAPYQVQVSYIGYGSSLQQIIGGMREMIFELEQTAILGQEVVISASRTPERILESPVSIERMGAQGVKELPAPSFYDALVNMKGVEVSTQSLTFKSVNTRGFNSNGNYRFNQYTDGMDNQAPGLNFSVGNIVGVNELDLDNVELLPGASSALYGAGGMNGTMLITSKNPFDHQGVSFQYKNGINHVNDNNSGTQPYRQMDLRLAKAWNDKLAVKATFSFLQAQDWQADNYTNFDRASQTGKSGDRSSDPNYDGINVYGDEVSQNMRNVAQAVVNAGTSAFVQQALGLPSAPTAAQIQAFKSNPAGLNALNGFLGTDARFRPFVFGLATPGLLPDQNVSRTGYDENYLVDYNTESLKASGAIHYKFSPTIESTLQANWGSGTSVYTGADRYSLRNFSIGQYKLELKGRDFMLKGYTTQERSGDSYISSILGSYINEKSKSSTAWFPEYVGNYIGARAGGLADAQAHAMARTSANQGRLEPGTPVFENAKYEIMNTTIAGTDFSKGIYGARFNDKTNMYHYEGMYNLTNALNNVVELQLGSSYRLYQLRSAGTIFNDLNQDINIREYGAFAQLGKRVLKDKLKLTVSGRYDKSKNFDGRFTPRATAVMTVAPNNNIRFSYQTGYRNPTTQDQYIDLSVGGGSQRLIGGLTESLQAYNLYENRPFTEDSYRAYLSSVANGTANPALLQNYNFDAGGVRPETVQAYELGYKGLLGEKFLLDVYGYYNQYKNFIAITNVYQNREGNFIKFGAPVNARGEVTAYGGALGLDYLLAAFTLTGNISYNQIGDLPSDYVNDFNTPKVRYNLGIGNKELIKNVGFNVAYRWQDRFYWRSSFASGEVPAFSTFDAQVNLKIPSVNSMIKIGGTNILNKYYVTSYGNPAIGALYYVSYAFNP

SEQ ID NO: 13510 - protein, 355 aa, Haemophilus influenzae
MKKTAIALVVAGLAAASVAQAAPQENTFYAGVKAGQASFHDGLRALARENKVGYHRNSFTYGVFGGYQILNQNNLGLAVELGYDDFGRAKGREKGKTVAKHTNHGAHLSLKGSYEVLEGLDVYGKAGVALVRSDYKLYNKNSSNSTLKNLGEHHRARASGLFAVGAEYAVLPELAVRLEYQWLTRVGKYRPQDKPNSALNYNPWIGSINAGISYRFGQGAAPVVAAPEMVSKTFSLNSDVTFAFGKANLKPQAQATLDSIYGEMSQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 13511 - protein, 361 aa, Haemophilus influenzae
MKKTAIALVVAGLAAASVAQAAPQENTFYAGVKAGQASFHDGINNNGAIKKDLLGGLASYGYRRNTFTYGVFGGYQILNQDNFGLAAELGYDNFGRAKLRLEGKPKAKHTNHGAHLSLKGSYEVLDGLDVYGKAGVALVRSDYKFYDDANGTRDHKKGRHTARASGLFAVGAEYAVLPELAVRLEYQWLTRVGKYRPQDKPNTAINYNPWIGSINAGISYRFGQGAAPVVAAPEVVSKTFSLNSDVTFAFGKANLKPQAQATLDSIYGEMSQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 13512 - protein, 358 aa, Haemophilus influenzae
MKKTAIALVVAGLAAASVAQAAPQENTFYAGVKAGQGSFHDGINNNGAIKEDLTLGYGYRRNTFTYGVFGGYQILNQDNFGLAAELGYDNFGRVKFRAEGKTKAKHTNHGAHLSLKGSYEVLDGLDVYGKAGVALVRSDYKFYEDANGTRDHKKGRHTARASGLFAVGAEYAVLPELAVRLEYQWLTRVGKYRPQDKPNTAINYNPWIGSINAGISYRFGQGAAPVVAAPEVVSKTFSLNSDVTFAFGKANLKPQAQATLDSIYGEMSQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 13513 - protein, 386 aa, Bordetella pertussis
MKKTLLAAALCGVFTMSAHAENSVALYGLLDTGLVYTNNQLGHSNWQLASGTTQNTVFGLKGTEDLGADLHAIFKLEQGFLMNNGAQAFGGSAFGSQAWVGLQSDPYGTLTFGRQFDVMNDAVGPLTAGFNTWGGSIAAHPFDNDNLAANSVVVNNSVKYASPAYHGVTFESMYSFSNKAGNFANNRSYGFSLAYAQGPLNLAAGYLQFNNAGNGSGAVTTGDTSANFVAERQRAWSLGGNYTFGAATVGLVWSHTQIDNVSGVFSFGTGTYLGAAGDGTGTLSGSLRLDNYEVNAKYALTPALSLSGAYTFTHGAYNGSSPAWNSAMLQTDYALSKRTDFYLEGVYQNAHGAPADSVLSHAMLNTLSPSSTSTQVAVTVGMRHAF

SEQ ID NO: 13514 - protein, 385 aa, Neisseria meningitidis serogroup C
MRKKLTALVLSALPLAAVADVSLYGEIKAGVEGRNIQAQLTEQPQVTNGVQGNQVKVTKAKSRIRTKISDFGSFIGFKGSEDLGEGLKAVWQLEQDVSVAGGGASQWGNRESFIGLAGEFGTLRAGRVANQFDDASQAINPWDSNNDVASQLGIFKRHDDMPVSVRYDSPEFSGFSGSVQFVPAQNSKSAYKPAYYTKDTNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 13515 - protein, 389 aa, Neisseria meningitidis serogroup C
MRKKLTALVLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNNNTDVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 13516 - protein, 756 aa, Buchnera aphidicola
MKKRAITTAIAIAAGSLGMTMASSLVAAQNNGLEEIVVTARKRTESLQDVGLAVSAMSETEIKRTFARDLLDLSSVSPNLIIDDTGQGPGGVAAIFIRGIGAADVEKNFDPAVGVVVDGIFMGANAGSLLRSIDLASIEVLRGPQGTLFGRNTIGGLINVTHTQPTGEWGGKFRVGFEDYDTHYVDGILNFGVTDSLAAKVSLAKRDQGEGYYDNITTGENGRGAIDYQSYGINLLWDASEDLEFEFTYQNEETDQDTPELINTGQERHLLCNTYNYCSPSESQPISGDRLKTANLGLKSSGPSANRDNPFLVTSALDAVPIALAATFDTELYGLEARWSINESYNLDYLYGHWESDEEAITNWDGTPELLYGTSRPGSYDQDSHELRLTYDASGNLSFVGGLYYWENSYIAESNSWVGFPVPGSILDIYQFTEQDTKSSAIFFEGDYRVTDALTLTVGGRYTEDEKKSRQEGNVETISGDFTSNPEEDWSEFTPRVGARFAVNDDVMAFFTYSKGYRSGGFNGRVNSVIEAREAYDPETVDNYELGLKSEWFENRLRLNANMFYMEYNDKQEELQLPSVGGTGQKTVVTNASSATIQGVEVDVQAYITQNLSLRGNIGYLDTQYDGFGYEALDGSTVDLSDLEFRRAPDFTGSLDATYEWDTAGGNAWVRAAYHFIGEHYTNVTNSPELENDAQHLVDASVNYAMNNGLQFSLFGRNLTDEDGYSHGYDVAGLWSYAATRAPRTFGIEVQYSFGE

SEQ ID NO: 13517 - protein, 1237 aa, Buchnera aphidicola
MKKPVVKQRLLHRIMKITLFQFVLALVFSSFAVANNVNGQKKLDTKVTIIVENLTLDNALSKIEKSAHVKFSYNSRLPQLSRKVSIEANQETLSSILSRILVPFNITFSEVSNQIILQKTAADPFASADNHDSLFEVLTAGPIIKGKVTDQTGSPLPGATVMAKGTKVAVLTDFDGNFSIEMPANADKLVISYVGMETKEIGITNVTPTVVLTEAGQNLKEVVVTTGYEKTSKRTFTGAISKISGSELKVEGVVDVSRMIEGKAAGVTVQNVTGTFGTAPKITVRGSSSIFGDTKPLWVIDGVVQEDIINVTFADLASGNSATLLSSSVAGLNSNDIQSIEVLKDASATSIYGSRSLNGVVVVTTKQGRRDSPLKVSYSVENTVRTVPSYSQYDILNSQESMSVFQEMRQKGYLDLSSSYTGRFGGVYNILAREINNYNTSNGQYGVKNDQPYINEFLKKYELVNTDWFSVLFRPSITQNHSLSFSGGGKNNTFYASLGYYTDPGWTIADNVKQLSSNLKGTFFINDKLNITLSTLGSIRNQQAPGAYESKQDVVFGKTTRDFDINPFNYVLSTSRTLRPYDDKGNLEYYQNNWAPMNIVNELANNTLDIKVNDIRFQVDLDYKINKNLTYNLTGSARYANTSREHRIYEGSNVVGAYNAGVGNNVNSQIQKDNVFLYQNPNDLTAPKVSVLPSGGFLRKFTNDMTSYNIRNSVTYRNIFKDKHEVEGFFGTELRSVDRNNDNFTAVGIQYNKGLTPFIDPRIIEKIVNGGDSYYDFGEERERTVGFFGKVGYTYDRRYTASLTGRYDGSNRQGDTGSSRWLPTYTVSGKWNVAEESFMKNNETINTLALRASYGLTATAGPATNSLAIYKSFITDRFNLSDRENAIRIEDLQNKDLTWEKQYETNIGVDLGMFNNRVSLAADVYRRKAFDLIDYVITSGVGGESIKQGNNADMETKGIELGLTTQNIVTDNFKWSTTLNFSVFNQEITKLANRPSAFDLVDSNGGNTVGHPRNSIYSYQFTGLNNQGLPTFNLQEGAENNITGADFQDTKDVTKYLKYEGSIEPNKSIGLANTFTYKNWSLYVFVVGSGGNKVRLNPVYSNKYTDLTVFTKEYANRWINPGDENVTNVPVIADRLLNRNYGERDLEIAYNTYNFSDVRIADGDFVRLKNVTLSWEFPKDYKKKLGLSTFTLKGSAVNPWLIYSDKRLHGQDPEFRNTGGVAFPITSQYTFTLNVSF

SEQ ID NO: 13518 - protein, 244 aa, Citrobacter freundii
LTAKLGYPITDDLDIYTRLGGMVWRADAKAQVPGTGASFKDHDTGVSPVFAGGVEWAMTRDIATRLEYQWVNNIGDAKTLGTRQDNGMLSVGVSYRFGQQEDVAPVVAPAPAPAPQVSTKHFTLKSDVLFNFNKATLKPEGQQALDQMYSQLSNLDPKDGSVVVLGFTDRIGSDAYNQGLSEKRAQSVVDYLISKGIPSNKISARGMGESNPVTGNTCDNVKARPALIDCLAPDRRVEIEVKGV

SEQ ID NO: 13519 - protein, 347 aa, Enterobacter aerogenes
MKKTAIAIAVALAGFATVAQAAPKDNTWYAGGKLGWSQFHDTGFIPNDGPTHESQLGAGAFGGYQVNPYVGFEMGYDWLGRMPYKGDTVNGAFKAQGVQLTAKLGYPVTDDLDVYTRLGGMVWRADSSSNIAGDDHDTGVSPVFAGGVEWAMTRDIATRLEYQWVNNIGDAQTVGARPDNGMLSVGVSYRFGQQEDAAPVVAPAPAPAPEVQTKHFTLKSDVLFNFNKATLKPEGQQALDQLYSQLSNLDPKDGSVVVLGFTDRIGSDAYNQGLSEKRAQSVVDYLISKGIPSNKISARGMGESNPVTGNTCDNVKARAALIDCLGPDRRVEIEVKGVKDVVTQPQA

SEQ ID NO: 13520 - protein, 238 aa, Escherichia blattae
LTAKLGYPVTDDLDVYTRLGGMVWRADTSNSIAGDDHDTGVSPVFAGGVEWAMTRDIATRLEYQWVNNIGDGATVGVRPDNGMLSVGVSYRFGQQEDAPVVAPAPAPAPEVQTKHFTLKSDVLFNFNKATLKPEGQQALDQLYTQLSNLDPKDGSVVVLGFTDRIGSDAYNQGLSEKRAQSVVDYLVSKGIPANKISPRGMGESNPVTGSTCDNVKPRAALIDCLAPDRRVEIEVKGI

SEQ ID NO: 13521 - protein, 351 aa, Escherichia fergusonii
MKKTAIAIAVALAGFATVAQAAPKDNTWYTGAKLGWSQYHDTGFIDNNGPTHENQLGAGAFGGYQVNPYVGFEMGYDWLGRMPYKGSVENGAYKAQGVQLTAKLGYPITDDLDIYTRLGGMVWRADTKAHNNVTGESEKNHDTGVSPVFAGGVEWAITPEIATRLEYQWTNNIGDANTIGTRPDNGLLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 13522 - protein, 243 aa, Escherichia fergusonii
LTAKLGYPITDDLDIYTRLGGMVWRADTKAHNNVTGESEKNHDTGVSPVFAGGVEWAITPEIATRLEYQWTNNIGDANTIGTRPDNGLLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGI

SEQ ID NO: 13523 - protein, 244 aa, Escherichia hermannii
LTAKLGYPITDDVDIYTRLGGMVWRADAKSQVGGTGASFKDHDTGVSPVFAGGVEWAMTRDIATRLEYQWVNNIGDAKTLGTRQDNGMLSVGVSYRFGQQEDVAPVVAPAPAPAPQVSTKHFTLKSDVLFNFNKATLKPEGQQALDQMYSQLSNLDPKDGSVVVLGFTDRIGSDAYNQGLSEKRAQSVVDYLISKGIPSNKISARGMGESNPVTGNTCDNVKARPALIDCLAPDRRVEIEVKGV

SEQ ID NO: 13524 - protein, 358 aa, Klebsiella pneumoniae
MKAIARRASRTSVKLIAAAACVAAAAPVHAQSSVSLYGQVDEWIGATKFPGSDRAWNVSGGGMSTSYWGLHGAEDLGNGYKAIFTLESFFRAQNGQYGRFTGDTFFARNAYVGVSSPYGTVTAGRLTTHLFLSTILFNPFYDSYTFSPMVYHVFLGLGTFPTYPSDQGAVGDSGWDNAVSYTSPAFGGLNFGAMYAFGNQAGDNGSKKWSAQFNYANGPFAATAVYQYVNFNNGPRDLGALVAGMKSQGIAQVGATYDLKYVKLFGQYMYTKNDQVAGSWHVNTAQGGVSVPIGVGSAMASYAYSRDAGGLDQTRQTWAIGYDYPLSKRTDVYAAYMNDHISGLSNGNTFGAGIRAKF

SEQ ID NO: 13525 - protein, 327 aa, Neisseria gonorrhoeae
MKKSLIALTLAALPVAAMADVTLYGTIKAGVETSRSVAHHGAQADRVKTATEIADLGSKIGFKGQEDLGNGLKAIWQLEQKAYVSGTDTGWGNRQSFIGLKGGFGKVRVGRLNNILKDTGGFNPWEGKSYYSGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWRDDNSHNSQTEVATTVAYRFGNVTPRVSYAHGFKGSVYDADHDNTYDQVVVGAEYDFSKRTSALVSAGWLQKGKGAEKFVATVGGVGLRHKF

SEQ ID NO: 13526 - protein, 396 aa, Neisseria meningitidis serogroup A
MRKKLTALVLSALPLAAVADVSLYGEIKAGVEGRNYQLQLTEAQAANGGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDFSEFSGFSGSVQFVPAQNSKSAYKPAYWTTVNTGSATTTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 13527 - protein, 303 aa, Neisseria meningitidis serogroup B
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKGTNNDLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKT

SEQ ID NO: 13528 - protein, 2106 aa, Rickettsia conorii
  misc_feature (1054)..(1054): Xaa can be any naturally occurring amino acid
  misc_feature (1091)..(1091): Xaa can be any naturally occurring amino acid
  misc_feature (1178)..(1178): Xaa can be any naturally occurring amino acid
  misc_feature (1187)..(1187): Xaa can be any naturally occurring amino acid
  misc_feature (1310)..(1310): Xaa can be any naturally occurring amino acid
  misc_feature (1370)..(1370): Xaa can be any naturally occurring amino acid
MANISPKLFQKAIHKSLKAALFTTSTAAIMLSSSGAWGVAAGVISVNDAAFSNRAVANNWNEITAGGAANGNHADGPQDNEAFTYGGNHTITADEAGRIITAINVAGTTPVALNSTQNTSVGSIVTGGNLLPVTIADGKSLTLTGTKAVAADHGFDAAADNYTGLGAIALGGATAGLTIQSATPALINLAGAIDGDNNDHGEITVNTRTSFTGVIGGTKTLHAVTFNNGNAGGVSTAGAISATTVMIGEDAGNVASVVQTGLITGAVNFAADGALTANNGIAGAVTTANNNTGTLTVGAGDVTGAIGVNGGNILKQVLFNGASNVATIDATNVTINNAAANVTAAGAITAAVNFAADGALTANNGIAGAVTTANNNTGTLTVGAGDVTGAIGVNGGNILKQVLFNGASNVATIDATNVTINNAAANVTAAGAITAAVNFAADGALTANNGIAGAVTTANNNTGTLTVGAGDVTGAIGVNGGNILKQVLFNGASNVATIDATTVTINNVAANVTAAGAITAAVNFAADGALTANNGIAGAVTTANNNTGTLTVGAGDVTGAIGVNGGNILKQVLFNGASNVATIDATNVTINNAAANVTAAGAITAAVNFAADGALTANNGIVGAVTTANNNTGTLTVGAGDVTGAIGVNGGNILKQVLFNGASNVATIDATTVTINNVAANVTAAGAITAAVNFAADGALTANNGIVGAVTTANNNTGTLTVGAGDVTGAIGVNGGNILKQVLFNGASNVATIDATNVTINNAAANVTAAGAITAAVNFAADGALTANNGIAGAVTTANNNTGTLTVGAGDVTGAIGVNGGNILKQVLFNGASNVATIDATNVTINNAAANVTAAGAITAAVNFAADGALTANNGIVGAVTTANNNTGTLTVGAGDVTGAIGVNGGNILKQVLFNGASNVATIDATTVTINNVAANVTAAGAITAAVNFAADGALTANNGITGAVTAAGGNGTLTTAGVGVTGAVGTNAASLKVLNAKVDNGAADLVFTSDIYARTVNFDDIAGGGAVGTIQVGGNLIATNVNFGGNAQGGTLXLNGPVGKSYTLSGTIANGNNATININTLGLVTABNAXIGTVAQINIQDNKTFAINVKNADIEILNAQAIDFKGANSKLFLVNNSATDDRVVTIKNDLPAFATGGGMLLLFGTANLITLQGDGAXKAIGTAGNXLASLNVLGKVAFNNIDTTNVLAFNIINTTQFVDVGGITNQISVINIGAANASLGLPAAAGSYTIDANGGNVGILANGQTINFAHEDAELVLQNSAAGNSTITLNAALDPGAPNKGKLAVDSGXAGGRVILASVRNATYGTAVNKLKLLEFRGNGTFQIDTDIFANNLELPVPAAITYNKDINXNLSFGAATALTQNGNINGNVDFNNQAAVITLGANKNITGSVTSSNGVNGTTIATGASTINGHITNIAMLKVGAGAVSITQGGNTSITEIQGNGTALLTLPANFNLTGSINKTGGQALKLNFTNGGSVRGVVGTAANSVGDITTTGTTNFASSVNAKGAATLCGTTSFADTFTNTGAVTLAKASITNFAKNVTATSFAANNATINFGNSLAFNSNITGSGTTLTLGASQVTYTGTGSFTDTLTLNTTFDGAAKSDGHILIKSGSTLDLSGVSTLALVVTATNFDINNISPNTKYTVISAETAGGLKPTPAGNVKVTVNNDNRFVNFTFDESTLTLFAEDIAEEVIEEDFKPGGPLANIPNAANVKKSLELMEQAPIGSDACLAFDNWGKLNPIQAADAVTHLMQDVVKPSDTIAAINNQVILSNISSSLINLNARMDAIQPAAVAAGDEDRDAKFGAWISPFVGNAMQKMRNNISGYKSDTTGGTIGFDGLVSDDLALGLAYTRADTDIKLKNNKTGDKNKVESNIYSLYGLYNVPYENLCFKAIASYSDNKIRSKSRRIIATALDIVGNQTASGKYKSESYTGQLMAGYTYMMPENISLTPLAGLRYSAIKDKGYKETGTTNQNLTVKGKNYSTFDGLLGAKVSSNINVGEVVLTPEFYAMVDYAFKNKVPAIDARLQGMTSPFPTNSFKQSKTSFDIGVGITAKHQMMEYGINYDTNIGSKYFAQQGSVKVRVNF

SEQ ID NO: 13529 - protein, 2249 aa, Rickettsia rickettsii
MANISPKLFKKAIQQGLKAALFTTSTAAIMLSSSGALGVATGVIATNNNAAFSNNVGNNNWNEITAAGVANGTPAGGPQNNWAFTYGGDYTVTADAADRIIKAINVAGTTPVGLNITQNTVVGSIITKGNLLPVTLNAGKSLTLNGNNAVAANHGFDAPADNYTGLGNIALGGANAALIIQSAAPSKITLAGNIDGGGIITVKTDAAINGTIGNTNALATVNVGAGTATLGGAVIKATTTKLTNAASVLTLTNANAVLTGAIDNTTGGDNVGVLNLNGALSQVTGDIGNTNSLATISVGAGTATLGGAVIKATTTKLTDAASAVKFTNPVVVTGAIDNTGNANNGIVTFTGNSTVTGNVGNTNALATVNVGAGLLQVQGGVVKANTINLTDNASAVTFTNPVVVTGAIDNTGNANNGIVTFTGNSTVTGDIGNTNALATVNVGAGTATLGGAVIKATTTKLTNAASVLTLTNANAVLTGAIDNTTGGDNVGVLNLNGALSQVTGNIGNTNSLATISVGAGTATLGGAVIKATTTKLTDAASAVKFTNPVVVTGAIDNTGNANNGIVTFTGNSTVTGDIGNTNSLATISVGAGTATLGGAVIKATTTKLTNAASVLTLTNANAVLTGAIDNTTGGDNVGVLNLNGALSQVTGDIGNTNALATVNVGAGTATLGGAVIKATTTKLTNAVSAVKFTNPVVVTGAIDNTGNANNGIVTFTGNSTVTGDIGNTNALATVNVGAGTATLGGAVIKATTTKLTNAASVLTLTNANAVLTGAIDNTTGGDNVGVLNLNGALSQVTGDIGNTNSLATISVGAGTATLGGAVIKATTTKLTNAASVLTLTNANAVLTGAIDNTTGGDNVGVLNLNGALSQVTGDIGNTNSLATISVGAGTATLGGAVIKATTTKLTNAASVLTLTNANAVLTGAIDNTTGGDNVGVLNLNGALSQVTGDIGNTNSLATISVGAGTATLGGAVIKATTTKLTDAASAVKFTNPVVVTGAIDNTGNANNGIVTFTGNSTVTGNVGNTNALATVNVGAGLLQVQGGVVKANTINLTDNASAVTFTNPVVVTGAIDNTGNANNGIVTFTGNSTVTGNVGNTNALATVNVGAGLLQVQGGVVKANTINLTDNASAVTFTNPVVVTGAIDNTGNANNGIVTFTGNSTVTGDIGNTNALATVNVGAGITLQAGGSLAANNIDFGARSTLEFNGPLDGGGKAIPYYFKGAIANGNNAILNVNTKLLTASHLTIGTVAEINIGAGNLFTIDASVGDVTILNAQNINFRARDSVLVLSNLTGVGVNNILLAADLVAPGADEGTVVFNGGVNGLNIGSNVAGTARNIGDGGGNKFNTLLIYNAVTITDDVNLEGIQNVLINNNADFTSSTAFNAGAIQINDATYTIDANNGNLNIPAGNIQFAHADAQLVLQNSSGNDRTITLGANIDPDNDDEGIVILNSVTAGKKLTIAGGKTFGGAHKLQTILFKGAGDCSTAGTTFNTTNIVLDITGQLELGATTANVVLFNDAVQLTQTGNIGGFLDFNAKNGMVTLNNNVNVAGAVQNTGGTNNGTLIVLGASNLNRVNGIAMLKVGAGNVTIAKGGKVKIGEIQGTGTNTLTLPAHFNLTGSINKTGGQALKLNFMNGGSVSGVVGTAANSVGDITTAGATSFASSVNAKGTATLGGTTSFANTFTNTGAVTLAKGSITSFAKNVTATSFVANSATINFSNSLAFNSNITGGGTTLTLGANQVTYTGTGSFTDTLTLNTTFDGAAKSGGNILIKSGSTLDLSGVSTLALVVTATNFDMNNISPDTKYTVISAETAGGLKPTSKENVKITINNDNRFVDFTFDASTLTLFAEDIAADVIDGDFAPGGPLANIPNAANIKKSLELMEDAPNGSDARQAFNNFGLMTPLQEADATTHLIQDVVKPSDTIAAVNNQVVASNISSNITALNARMDKVQSGNKGPVSSGDEDMDAKFGAWISPFVGNATQKMCNSISGYKSDTTGGTIGFDGFVSDDLALGLAYTRADTDIKLKNNKTGDKNKVESNIYSLYGLYNVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYRINYDTNIGSKYFAQQGSVKVRVNF

SEQ ID NO: 13530 - protein, 350 aa, Salmonella typhi
MKKTAIAIAVALAGFATVAQAAPKDNTWYAGAKLGWSQYHDTGFIHNDGPTHENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 13531 - protein, 231 aa, Serratia marcescens
MKKTAIALAVALAGFATVAQAAPKDDTWYTGGKLGWSQYHDTGFYGNGFDNRIGNGPTRDDQLGAGAFVGYQANQYLGFELGYDWLGRMAYKGSVNNGSFKAQGISLAAKLSYPLTDDLDIYTRLGGMVWRADSKGAYDNGNAGRVSDHDTGVSPLAAVGLEYAWTKNWATRLDYQWVNNIGDAGTVGTRPDNSMLSVGVSYRFGQDEVAAPAPAPAPTPAPVAQTKRFTT

SEQ ID NO: 13532 - protein, 346 aa, Serratia odorifera
LAAGAANAAEIYNKDGNKLDLYGKVDARHSFSDNNKQDGDKSYVRFGFKGETQITDQLTGYGQWEYNIQANNAEDSGAQDGNATRLGFAGLKFAEFGSFDYGRNYGVIYDVNAWTDMLPVFGGDSISNSDNFMTGRSTGLATYRNNNFFGMVDGLNFALQYQGKNDRSEVKEANGDGFGIGSTYDLGNGINFGAGFSSSNRTLDQKYGSTAEGDKAQAWNVGAKYDANNVYLAVMYAETQNLTPYGFYDFTIANKTRDIEITAQYQFDFGLRPSLGYVQSKGKDLNNVDANHDLVKYVSVGTYYYFNKNMSTYVDYKINLLDKDLFTEVNRIMTDDVVAVGLVYQF

SEQ ID NO: 13533 - protein, 350 aa, Shigella dysenteriae
MKKTAIAITVALAGFATVAQAAPKDNTWYTGAKLGWSQYHDTGFIDNNGPTHENQLGAGAFGGYQVNPYVGFEMGYDWLGRMPYKGSVENGAYKAQGVQLTAKLGYPITDDLDIYTRLGGMVWRADTKANVPGGASFKDHDTGVSPVFAGGVEYAITPEIATRLEYQWTNNIGDAHTIGTRPDNGLLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 13534 - protein, 348 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASDAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 13535 - protein, 331 aa, Neisseria meningitidis serogroup B
MKKSLIALTLAALPVAAMADVTLYGTIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAASVGLRHKF

SEQ ID NO: 13536 - protein, 348 aa, Neisseria gonorrhoeae
MKKSLIALTLAALPVAAMADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSIPTLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 13537 - protein, 317 aa, Neisseria meningitidis serogroup B
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLVEENYSHNSQTEVAATLAYRFGNVTPRVSYAHGFKGSFDATNYNNDYDQVVVGAEYDFSKRTSALVSAGWLQEGKGESK

SEQ ID NO: 13538 - protein, 317 aa, Neisseria meningitidis serogroup B
MKKSLIALTLAALPVAAMADVTLYGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENK

SEQ ID NO: 13539 - protein, 331 aa, Neisseria meningitidis serogroup B
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLVEENYSHNSQTEVAATLAYRFGNVTPRVSYAHGFKGSFDATNYNNDYDQVVVGAEYDFSKRTSALVSAGWLQEGKGESKFVSTAGGVGLRHKF

SEQ ID NO: 13540 - protein, 337 aa, Neisseria lactamica
MKKSLIALTLAALPVAAMADVTLYGTIKAGVETYRTVKHTDGKVTEVKTGSEIADFGSKIGFKGQEDFGNGLKAIWQLEQNASIAGTDSGWGNKQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGQPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 13541 - protein, 337 aa, Neisseria meningitidis serogroup A
MKKSLIALTLAALPVAAMADVTLYGTIKAGVETYRTVKHTEGKVTEVKTGSEIADFGSKIGFKGQEDLGNGLKAIWQLEQSASIAGTDKGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 13542 - protein, 348 aa, Neisseria sicca
MKKSLIALTLAALPVAAMADVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISRMAQREHRYLSVRYDSPEFAGFSGSVQYAPKDNSGSNGESYHVGLNYRNGGFFAQYAGLFQRYGEGTKKIEYDNQFYSVPGLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGADKIVSTASAVVLRHKF

SEQ ID NO: 13543 - protein, 1654 aa, Rickettsia conorii
MAQKPNFLKKLISAGLVTASTATIVASFAGSAMGAAIQQNRTTNANATTVDGAGFDQTAVPANVAVPLNAVITANVHKGINLNTPAGSFNGLFLNTANNLAVTVSEDTTLGFITHVVNNANFFNLTLNAGKTLTITGQGITNVQAAATKNAQNVVVQVNNGAAIENNDLQGVGTIDFGAAASTLVFNLANPTTQKAPLILGDNAVIVNGANGTLNVTNGFIKVSSKSFATVNAINIGDGQGIIFNTDANNANALNLQAGGTTINFNGTDGTGRLVLVSKNAAATDFNVTGSLGGNLKGIIEFNTVAVDGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPNTMTLKGNFTGDASNPGNTAGVITFDANGTLASASADANVAVTNNITAIEASGAGVVQLSGTHAAELRLGNAGSVFKLADGTVINGKVNQTALVAGALAAGTITLDGSATITGDIGNAGGAAALQGITLANDATKTLTLGGANIIGANGGTIDFQANGGTIKFTSTQDNIVVHFDLDIITDQTGVVDASSLTNAQTLTMNGKIGTIGANNKTLGQFNIGSSKTALSDGDVAINELVIGNNGAVQFAHNTYLITRITNAAGQGKIIFNPVVNNNTTLAAGTNLGSATNPLAEINFGSKGVNVDTVLNVGEGVNLYATNITTTDANVGSFIFNAGGTNIVSGTVGGQQGNKFNTVALDNGTTVKFLGNATFNGNTTIAANSTLQIGGNYTADFVASADGTGIVEFVNTDPITVTLNKQAAPVNALKQITVSGPGNVVINEIGNAGNYHGAVTDTIAFENSSLGTVVFLPRGIPFNDAGNIIPLTIKSTVGNKTATGFDVPSVIVLGVDSVIADGQVIGDQNNIVGLGLGSDNDIIVNATTLYAGIGTINNNQGTVTLSGGIPNTPGTVYGLGTGIGASKFKQVTFTTDYNNLGNIIATNATINDGVTVTTGGIAGIGFDGKITLGSVNGNGNVRFVDGILSNSTSMIGTTKANNGTVTYLGNAFVGNIGDSDTPVASVRFTGSDGGAGLQGNIYSQVIDFGTYNLGILNSNVILGGGTTAINGKINLLTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANAANFVGAIVTDTSAAITNAQLDVAKGIQDQLGNRLGALRYLGTPETAEMAGPEAGAIPAAVAAGDEAVDNVAYGIWAKPFYTDAHQSKQGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTLKVRVNF

SEQ ID NO: 13544 - protein, 1654 aa, Rickettsia japonica
MAQKPNFLKKLISAGLVTASTATIVASFAGSAMGAAIQQNRTTNGAATTVDGAGFDQTAAPANVGVALNAVITANANNGINFNTPAGSFNGLLLNTANNLAVTVSEDTTLGFITNVVHNAHSFNLTLNAGKTLTITGQGVTNAQAAATKNAQNVVVQFNNGAAIDNNDLKGVGRIDFGAPASTLVFNLANPTTQKAPLILGDNAVIANGVNGTLNVTNGFIQVSNKSFATVKAINIADGQGIIFNTDANNANTLNLQAGGTTINFTGTDGTGRLVLLSKHAAATNFNITGSLGGNLKGVIEFNTVAVDGQLTANAGAANAVIGTNNGAGRAAGFVVSVDNGKVATIDGQVYAKDMVIQSANATGQVNFRHIVDVGADGTTAFKTAASKVTITQDSNFGNTDFGNLAAQIKVPNAITLTGNFTGDASNPGNTAGVITFDANGTLESASADANVAVTNNITAIEASGAGVVQLSGTHAAELRLGNAGSIFKLADGTVINGKVNQTALVGGALAAGTITLDGSATITGDIGNAGGAAALQRITLANDAKKTLTLGGANIIGAGGGTIDLQANGGTIKLTSTQNNIVVDFDLAIATDQTGVVDASSLTNAQTLTINGKIGTIGANNKTLGQFNIGSSKTVLSNGNVAINELVIGNDGAVQFAHDTYLITRTTNAAGQGKIIFNPVVNNGTTLAAGTNLGSATNPLAEINFGSKGVNVDTVLNVGEGVNLYATNITTTDANVGSFVFNAGGTNIVSGTVGGQQGNKFNTVALENGTTVKFLGNATFNGNTTIAANSTLQIGGNYTADCVASADGTGIVEFVNTGPITVTLNKQAAPVNALKQITVSGPGNVVINEIGNAGNHHGAVTDTIAFENSSLGAVVFLPRGIPFNDAGNTMPLTIKSTVGNKTAKGFDVPSVVVLGVDSVIADGQVIGDQNNIVGLGLGSDNGIIVNATTLYAGISTLNNNQGTVTLSGGVPNTPGTVYGLGTGIGASKFKQVTFTTDYNNLGNIIATNATINDGVTVTTGGIAGIGFDGKITLGSVNGNGNVRFADGILSNSTSMIGTTKANNGTVTYLGNAFVGNIGDSDTPVASVRFTGSDSGAGLQGNIYSQVIDFGTYNLGIVNSNIILGGGTTAINGKIDLVTNTLTFASGTSTWGNNTSIETTLTLANGNIGHIVILEGAQVNTTTTGTTTIKVQDNANANFSGTQTYTLIQGGARFNGTLGSPNFAVTGSNRFVNYSLIRAANQDYVITRTNNAENVVTNDIANSPFGGAPGVDQNVTTFVNATNTAAYNNLLLAKNSANSANFVGAIVTDTSAAITNVQLDLAKDIQAQLGNRLGALRYLGTPETAEMAGPEAGAISAAVAAGDEAIDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCINQPDRTTKTSYNLGLSASIRSDAKMEYGIGYDAQISSKYTAHQGTLKVRVNF

SEQ ID NO: 13545 - protein, 1643 aa, Rickettsia prowazekii
MAQKPNFLKKIISAGLVTASTATIVAGFSGVAMGAAMQYNRTTNAAATTFDGIGFDQAAGANIPVAPNSVITANANNPITFNTPNGHLNSLFLDTANDLAVTINEDTTLGFITNIAQQAKFFNFTVAAGKILNITGQGITVQEASNTINAQNALTKVHGGAAINANDLSGLGSITFAAAPSVLEFNLINPTTQEAPLTLGANSKIVNGGNGILNITNGFIQVSDNTFAGIKTINIDDCQGLMFNSTPDAANTLNLQVGGNTINFNGIDGTGKLVLVSKNGAATEFNVTGTLGGNLKGIIELNTAAVAGKLISQGGAANAVIGTDNGAGRAAGFIVSVDNGNAATISGQVYAKNMVIQSANAGGQVTFEHIVDVGLGGTTNFKTADSKVIITENSNFGSTNFGNLDTQIVVPDTKILKGNFIGDVKNNGNTAGVITFNANGALVSASTDPNIAVTNINAIEAEGAGVVELSGIHIAELRLGNGGSIFKLADGTVINGPVNQNALMNNNALAAGSIQLDGSAIITGDIGNGGVNAALQHITLANDASKILALDGANIIGANVGGAIHFQANGGTIKLTNTQNNIVVNFDLDITTDKTGVVDASSLTNNQTLTINGSIGTVVANTKTLAQLNIGSSKTILNAGDVAINELVIENNGSVQLNHNTYLITKTINAANQGQIIVAADPLNTNTTLADGTNLGSAENPLSTIHFATKAANADSILNVGKGVNLYANNITTNDANVGSLHFRSGGTSIVSGTVGGQQGHKLNNLILDNGTTVKFLGDTTFNGGTKIEGKSILQISNNYTTDHVESADNTGTLEFVNTDPITVTLNKQGAYFGVLKQVIISGPGNIVFNEIGNVGIVHGIAANSISFENASLGTSLFLPSGTPLDVLTIKSTVGNGTVDNFNAPIVVVSGIDSMINNGQIIGDKKNIIALSLGSDNSITVNANTLYSGIRTTKNNQGTVTLSGGMPNNPGTIYGLGLENGSPKLKQVTFTTDYNNLGSIIANNVTINDDVTLTTGGIAGTDFDAKITLGSVNGNANVRFVDSTFSDPRSMIVATQANKGTVTYLGNALVSNIGSLDTPVASVRFTGNDSGAGLQGNIYSQNIDFGTYNLTILNSNVILGGGTTAINGEIDLLTNNLIFANGTSTWGDNTSISTTLNVSSGNIGQVVIAEDAQVNATTTGTTTIKIQDNANANFSGTQAYTLIQGGARFNGTLGAPNFAVTGSNIFVKYELIRDSNQDYVLTRTNDVLNVVTTAVGNSAIANAPGVSQNISRCLESTNTAAYNNMLLAKDPSDVATFVGAIATDTSAAVTTVNLNDTQKTQDLLSNRLGTLRYLSNAETSDVAGSATGAVSSGDEAEVSYGVWAKPFYNIAEQDKKGGIAGYKAKTTGVVVGLDTLASDNLMIGAAIGITKTDIKHQDYKKGDKTDINGLSFSLYGSQQLVKNFFAQGNAIFTLNKVKSKSQRYFFESNGKMSKQIAAGNYDNMTFGGNLIFGYDYNAMPNVLVTPMAGLSYLKSSNENYKETGTTVANKRINSKFSDRVDLIVGAKVAGSTVNITDIVIYPEIHSFVVHKVNGKLSNSQSMLDGQTAPFISQPDRTAKTSYNIGLSANIKSDAKMEYGIGYDFNSASKYTAHQGTLKVRVNF

SEQ ID NO: 13546 - protein, 1643 aa, Rickettsia typhi
MAQKPNFLKKIISAGLVTASTATIVAGFSGVAMGAAMQYNRTTNAAATTFDGIGFDQAAGANIPVAPNSVITANANNPITFNTPNGHLNSLFLDTANDLAVTINEDTTLGFITNIAQQAKFFNFTVAAGKILNITGQGITVQEASNTINAQNALTKVHGGAAINANDLSGLGSITFAAAPSVLEFNLINPTTQEAPLTLGANSKIVNGGNGTLNITNGFIQVSDNTFAGIKTINIDDCQGLMFNSTPDAANTLNLQVGGNTINFNGIDGTGKLVLVSKNGAATEFNVTGTLGGNLKGIIELNTAAVAGKLISQGGAANAVIGTDNGAGRAAGFIVSVDNGNAATISGQVYAKNMVIQSANAGGQVTFEHIVDVGLGGTTNFKTADSKVIITENSNFGSTNFGNLDTQIVVPDTKILKGNFIGDVKNNGNTAGVITFNANGALVSASTDPNIAVTNINAIEAEGAGVVELSGIHIAELRLGNGGSIFKLADGTVINGPVNQNALMNNNALAAGSIQLDGSAIITGDIGNGGVNAALQHITLANDASKILALDGANIIGANVGGAIHFQANGGTIKLTNTQNNIVVNFDLDITTDKTGVVDASSLTNNQTLTINGSIGTVVANTKTLAQLNIGSSKTILNAGDVAINELVIENNGSVQLNHNTYLITKTINAANQGQIIVAADPLNTNTTLADGTNLGSAENPLSTIHFATKAANADSILNVGKGVNLYANNITTNDANVGSLHFRSGGTSIVSGTVGGQQGHKLNNLILDNGTTVKFLGDTTFNGGTKIEGKSILQISNNYTTDHVESADNTGTLEFVNTDPITVTLNKQGAYFGVLKQVIISGPGNIVFNEIGNVGIVHGIAANSISFENASLGTSLFLPSGTPLDVLTIKSTVGNGTVDNFNAPIVVVSGIDSMINNGQIIGDKKNIIALSLGSDNSITVNANTLYSGIRTTKNNQGTVTLSGGMPNNPGTIYGLGLENGSPKLKQVTFTTDYNNLGSIIANNVTINDYVTLTTGGIAGTDFDAKITLGSVNGNANVRFVDSTFSDPRSMIVATQANKGTVTYLGNALVSNIGSLDTPVASVRFTGNDSGAGLQGNIYSQNIDFGTYNLTILNSNVILGGGTTAINGEIDLLTNNLIFANGTSTWGDNTSISTTLNVSSGNIGQVVIAEDAQVNATTTGTTTIKIQDNANANFSGTQAYTLIQGGARFNGTLGAPNFAVTGSNIFVKYELIRDSNQDYVLTRTNDVLNVVTTAVGNSAIANAPGVSQNISRCLESTNTAAYNNMLLAKDPSDVATFVGAIATDTSAAVTTVNLNDTQKTQDLLSNRLGTLRYLSNAETSDVAGSATGAVSSGDEAEVSYGVWAKPFYNIAEQDKKGGIAGYKAKTTGVVVGLDTLASDNLMIGAAIGITKTDIKHQDYKKGDKTDINGLSFSLYGSQQLVKNFFAQGNAIFTLNKVKSKSQRYFFESNGKMSKQIAAGNYDNMTFGGNLIFGYDYNAMPNVLVTPMAGLSYLKSSNENYKETGTTVANKRINSKFSDRVDLIVGAKVAGSTVNITDIVIYPEIHSFVVHKVNGKLSNSQSMLDGQTAPFISQPDRTAKTSYNIGLSANIKSDAKMEYGIGYDFNSASKYTAHQGTLKVRVNF

SEQ ID NO: 13547 - protein, 375 aa, Escherichia coli O6
MKVKVLSLLVPALLVAGAANAAEVYNKDGNKLDLYGKVDGLHYFSDDKSVDGDQTYMRLGFKGETQVTDQLTGYGQWEYQIQGNAPESENNSWTRVAFAGLKFQDIGSFDYGRNYGVVYDVTSWTDVLPEFGGDTYGSDNFMQQRGNGFATYRNTDFFGLVDGLNFAVQYQGQNGSVSGENDPDFTGHGITNNGRKALRQNGDGVGGSITYDYEGFGVGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 13548 - protein, 364 aa, Gluconacetobacter diazotrophicus
MRLRSALLATSLLAATPLAAKATTITGPYVDIGGGYNLTQTQHGHFADTEDGPGREKLGHRHGWTGFGAVGWGFGNGLRAEVEGDYNWSEIYSKTRGDKGSDRSYGGFVNVLYDIDLKRLFNIDVPVTPFVGVGAGYLWQNAHDVTVGNSPGRSMSGTKGGFAYQGIVGAAYDIPGIPGLQMTTEYRMIGQPSSFTMGNYTASGPYDSGHASFDHRFNHQFIVGVRYAFNSAPPPPPPAPAVVPPAPTAARTYLVFFDWDGAALTGRSREIVAEAAQASTHVQTTRIEVNGYTDNTSAHPGPRGEKYNLGLSMRRADSVKAELIRDGVPANAIDVHGYGEAHPLVPTGPDTREPQNRRVEIILH

SEQ ID NO: 13549 - protein, 361 aa, Klebsiella pneumoniae
MKVKVLSLLVPALLVAGAANAAEIYNKDGNKLDLYGKIDGLHYFSDDKDVDGDQTYMRLGVKGETQINDQLTGYGQWEYNVQANNTESSSDQAWTRLAFAGLKFGDAGSFDYGRNYGVVYDVTSWTDVLPEFGGDTYGSDNFLQSRANGVATYRNSDFFGLVDGLNFALQYQGKNGSVSGEGALSPTNNGRGALKQNGDGFGTSVTYDIFDGISAGFAYANSKRTDDQNQLLLGEGDHAETYTGGLKYDANNIYLATQYTQTYNATRAGSLGFANKAQNFEVAAQYQFDFGLRPSVAYLQSKGKDLNGYGDQDILKYVDVGATYYFNKNMSTYVDYKINLLDDNSFTRSAGISTDDRGQLG

SEQ ID NO: 13550 - protein, 725 aa, Neisseria gonorrhoeae
MQPAFRLTGGAIGAALLFAQLAAMPVHAAEAASATPTTAPAANTEATLNTVTVVGNWLENANEAKVLEHPGARTIVDRETFAEAGANNVREVLRRIPGVQVQDNNGTGGSDVSLNVGVRGLTSRLSPRSTILMDGIPLAVAPYGQPQLSMAPLSLGNLEAIDVVRGAGSVRYGPQNVGGIINFVTRPIPTTFAADASVSTDIYSHGGNVKTNPTAFIGGTNEQGLGGALLYSGIHGNGYRASNDHVNIDDLLLKGAYRISKTDSLSAAFHYYEGTAGMPGGLTPAQYAADPFQSVRPYDNFSGRRHDFSLKYSHNDADRKFEVLTYYTDSFRGSNIEQEGTGAQAGRRRLTAAPRNYHTFAIEPRYSQLFRGDGMSHEVSVGYRFLREASDEQASRTAYYVPGSIDATTLPSPVYQWRTGGTTANAVYIDDTINVGNWTITPGLRYEFIRSYVTDNFSGVRRDVSSNEPLPSLAVMYHVSDQWKLFANAGVSFGPLQYFQIAQTTNGLTPEKAKTYEIGTHFNANGWGGELTLFNIDFDDELQLRGGTGGAPDAWTNLGATTHRGVESSLRYDFGALDKSLMGLSAYATYTYTEATYNQGNFAGRDLPFYSRHVATVGMRYARNRWSFNVDGFAQSRQHSPGDPSTSTTYQTAESANGALGDIPGYALMNLRVGYDFGKAAQNLKLAVGVKNVFDKRYFTRSTDNNAGKYVGMPRTFYIQASLAY

SEQ ID NO: 13551 - protein, 130 aa, Rahnella aquatilis
EIYNKDGNKLDLFGKVDGLHYFSNDDSADGDQSYMRLGFRGETQINNELTGYGEWEYQASLNTGESEDANNFTRVGFAGLKFGQWGSLDYGRNYGVMYDVAAWTDVLPEFGGDTYGADNFMFQRANGVAT

SEQ ID NO: 13552 - protein, 367 aa, Serratia marcescens
MKLRVLSLLVPALLVAGSAGAAEIYNKDGNKLDLYGKVDGLHYFSDDKSKDGDQSYMRFGLKGETQISDQLTGYGQWEYQANLNKAEDQDQGNFTRIGFAGLKFADYGSFDYGRNYGVLYDVTSWTDVLPEFGGDTYGADNFLSQRGNGMATYRNTNFFGLVDGLNFALQYQGKNGSGTETDNGRDVQGQNGDGYGMSLSYDLGWGVSASAAMASSKRTDEQNNLAFGHGDRADAYSGGLKYDANNVYLAATYAQTYNLTRFGNFKNNTDSGFANKAQNIELVAQYQFDFGLRPSVAYLQSKGKDLGNGYSDQDLVKYVDVGATYYFNKNMSTYVDYKINLLDENEFTKNAGINTDDIVAVGLVYQF

SEQ ID NO: 13553 - protein, 359 aa, Citrobacter koseri
MKLKLVAVAVTTLLAAGAVNAAEVFNKDGNKLDLYGKVTGLHYFSDDTDNDGDKTYVRLGFKGETQINDQLTGFGQWEYEFKGNNDETNGDKGNKTRLAFAGLKFNEFGSFDYGRNYGVAYDIGAWTDVLPEYGGDTWTQADVFMTGRTTGVATYRNQDFFGLVDGLNVAAQYQGKNDRDDVTKANGDGWGLSSTYEFDGFGVGATYAKADRTDDQVRYAAQSVLNASGDNAEVWAAGLKYDANNIYLATTYSETRNMTVFGDKHIANKAQNFEMVAQYQFDFGLRPSIAYLKSKGKDIETYGDQDLVEYIELGASYYFNKNMSTYVDYKINLLDDNKFTNDAKIATDNIVALGLTYQF

SEQ ID NO: 13554 - protein, 369 aa, Serratia marcescens
MMKRNILAVVIPALLAAGAANAAEIYNKDGNKLDLYGKVDGLHYFSDDKGNDGDQTYVRFGFKGETQITDQLTGYGQWEYNVQANHAENQGTEGTKTRLGFAGLKFADYGSFDYGRNYGVLYDVEGWTDMLPEFGGDTYTYTDNFMTGRTNGVATYRNNNFFGLVDGLNFAVQYQGKNENDDRDLKKQNGDGWGLSSTYDIGEGISFGAAYASSDRTDDQTQLSTAKGDKADAWTVGAKYDANNVYLATMYSETRNMTPYGESDFTIADKTQNFEVTAQYQFDFGLRPEVSYLQSKGKNLSSRTANGSSFGGGDADLVKYVSVGTTYYFNKNMSTYVDYKINLLDENEFTKANAIATDDIVGVGLVYQF

SEQ ID NO: 13555 - protein, 358 aa, Xenorhabdus nematophilus
MKRNILAVVIPALLVAGAANAAEIYNKNGNKLDFYGKMVGEHVWTTNGDTSSDDTTYARIGLKGETQINDQLIGYGQWEYNMDASNVEGSQTTKTRLAFAGLKAGEYGSFDYGRNYGAIYDVESATDMLVEWGGDGWNYTDNFMTGRTNGVATYRNSDFFGLVDGLSFALQYQGKNDHDRSIRKQNGDGFSTAATYAFDNGIALSAGYANSNRSVDQKRDGNGDKAEAWATSAKYDANNIYDAVMYSQTYNMTPEEDDHFAGKTQNFEAVVQYQFDFGLRPSLGYVQTKGKNLQARGGFGGGDADLVKYVELGTWYYFNKNMNVYAAYKFNQLDDNAYTRAAGVATDDQAAVGIVYQF

SEQ ID NO: 13556 - protein, 339 aa, Pasteurella multocida
MKKTIVALAVAAVAATSANAATVYNQDGTKVDVNGSVRLLLKKEKDERGDLVDNGSRVSFKASHDLGEGLSALAYAELRFSTKVKKTVKEGQVERTYEVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTVAKQEKEKAFMVGTELSYAGLALGVDYAQSKVTNVEGKKRALEVGLKYDLNDKAKVYTDLIWAKEGPKGATTRDRSVILGAGYKLHKQVETFVEGGWGREKDANGVTTKNNKVGVGLRVHF

SEQ ID NO: 13557 - protein, 380 aa, Photobacterium profundum
MKKTLVAAACTTALFAPLAHAQSSVTLYGLIDAGIAYTNNAGGASLWRMTSGTINGSRFGLKGSEDLGGGLKALFVLENGFNVNNGALGQDSKLFGRHAYVGLSEAGYGTLTLGRQYDTMVDFVAPLSATSGDFGDTGFAHPFDNDNLNHSVRINNAVKYTSDTIAGFKVGALYGFSNATNFGSNRAYSFAASYTNGPLKVAGAYLQMNGTKGSTSASPGATDVAEAKSLSQGGWSVGADRMRSYGGGLSYVFGPATVGFVYTRSQYDNSGSFGSTGQVAFNNYDLNVRYAVTPAVSLGAAYVYTDASVSNPDSKHGTDPKWHQVDLQAVYKLSRRTDLYAEAMYQHASGRGYQAFINTSGGASTTANQIVGTIGMRTRF

SEQ ID NO: 13558 - protein, 273 aa, Vibrio parahaemolyticus
MRKSLLALSLLAASSAPVMAADYSDGDIHKNDYKWMQFNLMGAFDEKGAGPESSHDYLEMEFGGRSGIFDLYGYVDVFNLASDPGSDKAGAEKIFMKFAPRMSLDALTGKDLSFGPVQELYVATLMEWGGNSGVNNQKIGLGSDVMVPWLGKVGLNLYGSYYGNNKDWNGFQVSTNWFKPFYFFENGSFISYQGYIDYQFGMEDKQGNKFNTNTSNGGAMFNGIYWHSDRFAVGYGLKLYKDVYGFEDGKALPWTQTVDSSGVAHYLSVTYKF

SEQ ID NO: 13559 - protein, 272 aa, Vibrio parahaemolyticus
MRKSLLALSLLAATSAPVLAADYSDGDIHKNDYKWMQFNLMGAFNEKGYAESSHDYLEMEFGGRSGIFDLYGYVDVFNLASDPGSDKAGGEKIFMKFAPRMSLDALTGKDLSFGPVQELYVSTLMEWGGNSDVNSQKIGLGSDVMVPWLGKIGLNLYGTYDGNKKDWNGFQVSTNWFKPFFFFENGSFISYQGYIDYQFGMDDDKGNKFNTTASNGGAMFNGIYWHSDRFAVGYGLKLYKDVYGFKDGEALPWGHKPESSGAGHYVAVTYKF

SEQ ID NO: 13560 - protein, 333 aa, Photobacterium profundum
MNKKLIALAVAAASISSVATAAEVFSDETSSLAIGGRFEARAVLADVEQSNGKTSSEVSDNSRVRINVAGKTDITDTVYGIGFYEGEFTDGDEVNNRHLNAGIGGDFGQVVYGKTDGSLGMLTDFTDIMAYHGNEAGNKLAAADRTGNNLAYVGSFDLNGDNLTVKTNYVFAGSEENEGYSAAAMYAMDMGLAFGAGYGEQEGQALSGDKTGKQAFGAISYTISDFYFSGLYQDARNTNVYGNINVAESTGYEFAAAYTMGKAVFIATYNYLEDTDKNADLRDSIAVDGTYYFNKNFRTYASYKFNMLDQDSSVGITKARTSDEFVLGARYDF

SEQ ID NO: 13561 - protein, 196 aa, Salmonella typhi
MKSLNRIFSATVLAVAALTAAAGAQAQSNYALYGPGSGYVGLNAGQSNYSLGSGLSLFSADKHDTAYNIYTGTFIHPNFGLELGYTNFGKIDRAGGRTKAEGINLSLVGRAPISPSFNLLGKLGTTYGRTDVSSVPGSGVAAGKETGFGVSYGLGAEYVFNPQLSAVLQYDEHRLKFKGEGRDRISATTVGLRYRF

SEQ ID NO: 13562 - protein, 183 aa, Escherichia coli
MQTKKNEIWVGIFLLAALLAALFVCLKAANVTSIRTEPTYTLYATFDNIGGLKARSPVSIGGVVVGRVADITLDPKTYLPRVTLEIEQRYNHIPDTSSLSIRTSGLLGEQYLALNVGFEDPELGTAILKDGDTIQDTKSAMVLEDLIGQFLYGSKGDDNKNSGDAPAAAPGNNETTEPVGTTK

SEQ ID NO: 13563 - protein, 398 aa, Salmonella typhi
MNRKVLALLVPALLVAGAANAAEIYNKNGNKLDLYGKVDGLRYFSDNAGDDGDQSYARIGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNEDPGAGEGTTNGSDAGSGSRKLARENGDGFGMSTSYDFDFGLSLGAAYSSSDRTDNQVTRGYGDGHHYYANSYAGGETAEAWTVGAKYDAYNVYLAAMYAETRNMTYYGGGDGGNGGIANKTQNFEVVAQYQFDFGLRPSIAYLQSKGKDLGGQDKDSRGNYRYTDKDLVKYVDVGMTYYFNKNMSTYVDYKINLLDEDDDFYANNGIATDDIVGVGLVYQF

SEQ ID NO: 13564 - protein, 383 aa, Salmonella typhi
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLNFALQYQGKNESQSADDVNIGTNNRNNGDDIRYDNGDGFGISTTYDIGMGFSAGAAYTTSDRTNEQVNAGGTIAGGDKADAWTAGLKYDANNIYLATMYSETRNMTPYGKTDAGYAGGVANKTQNFEVTAQYQFDFGLRPAVSFLMSKGKDLTYNNVNGDDKDLVKYADVGATYYFNKNFSTYVDYKINLLDDDDQFYKDAGISTDDIVALGMVYQF

SEQ ID NO: 13565 - protein, 341 aa, Vibrio cholerae serotype O1
MNKTLIALAVSAAAVATGAYADGINQSGDKAGSTVYSAKGTSLEVGGRAEARLSLKDGKAQDNSRVRLNFLGKAEINDSLYGVGFYEGEFTTNDQGKNASNNSLDNRYTYAGIGGTYGEVTYGKNDGALGVITDFTDIMSYHGNTAAEKIAVADRVDNMLAYKGQFGDLGVKASYRFADRNAVDAMGNVVTETNAAKYSDNGEDGYSLSAIYTFGDTGFNVGAGYADQDDQNEYMLAASYRMENLYFAGLFTDGELAKDVDYTGYELAAGYKLGQAAFTATYNNAETAKETSADNFAIDATYYFKPNFRSYISYQFNLLDSDKVGKVASEDELAIGLRYDF

SEQ ID NO: 13566 - protein, 345 aa, Vibrio cholerae
MNKTLIALAVSAAAVATGAYADGINQSGDKAGSTVYSAKGTSLEIGGRAEARLSLKDGKAEDKSRVRLNFLGKAEINDSLYGIGFYEGEFTTADSTATKTDNGSDLDNRYTYAGIGGTYGEVTYGKNDGALGVITDFTDIMSYHGNSAADKIAVADRVDNMLAYKGQFGDLGVKASFRFADRTENTVTDKYEDNGKDGYSLSAIYAFGDTGFNVGAGYADQDEQNEYMLAASYRMENLYFAGLFTDGEKAATNGDYTGYELAAGYKLGQAAFTTTYNNAETNDETSANNFAIDATYYFKPNFRTYISYNFNMIDAGDVLGKVGGNGVATKIDAEDELAIGLRYDF

SEQ ID NO: 13567 - protein, 335 aa, Vibrio parahaemolyticus
MKKTLIALSVSAAAMATGVNAAELYNQDGTSLEMGGRAEARLSMKDGDAQDNSRIRLNFLGTQAINDNLYGVGFWEGEFTTNEQGGVDGDVNKDSSNLDTRYAYAGLGGAWGEFTYGKNEGALGVITDFTDIMAYHGNSAADKLAVADRSDNMMSYKGQFENLNVKASYRFADREEVNGEYTDNKQDGYSLSAIYAVADTGLELGAGYADQDEANEYMLAASYTMGDLYFAGIFTDGEKAKTEGDYTGYELAGAYTLGQTVFTTTYNNAETNNETSANNFAVDASYYFKPNFRGYVSYNFNLIDSGDKLGKVGGNTTASKADAEDELALGLRYDF

SEQ ID NO: 13568 - protein, 334 aa, Vibrio vulnificus
MKKTLIALSVSAAAVATGVNAAELYNQDGTSLDMGGRAEARLSMKDGKVADNSRIRLNFLGKVEIQDGLYGVGFYEGEFTTADEGENKTNNNLDNRYTYAGLGGKFGEVTYGKNDGALGVITDFTDIMAYHGNSAADKIAVADRVDNMIAYKGQFDALSVKASYRFADRSEGTGANDGKYVDNGQDGYSLSAIYAIGQTGLTLGGGYADQDEQNEYMLAASYTMGDLYFAGIYTDGEKAKKDGDYTGYELAAKYTMGQTVFTTTYNNAETNSQTSADNFAVDATYYFKPNFRGYVSYNFNLIDSGDKLGQVGGNTTASKIDAEDELALGLRYDF

SEQ ID NO: 13569 - protein, 172 aa, Enterobacter cloacae
MKKIACLSALAAVLAVSAGTAVAATSTVTGGYAQSDMQGVMNKTNGFNLKYRYEQDNNPLGVIGSFTYTEKDRTENGAYNKGQYYGITAGPAYRLNDWASIYGVVGVGYGKFQQTENEGLNRTASNSDYGFSYGAGMQFNPIENVALDFSYEQSRIRNVDVGTWIAGVGYRF

SEQ ID NO: 13570 - protein, 333 aa, Neisseria gonorrhoeae
AGDPCDPCATWCDAISLRAGFYGDYVFDRILKVDAPKTFSMGAKPTGSATANYTTAVDRPNPAYNKHLHDAEWFTNAGFIALNIWDRFDVFCTLGASNGYIKGNSTAFNLVGLFGVKGTSVAANELPNVSLSNGVVELYTDTSFSWSVGARGALWECGCATLGAEFQYAQSKPKVEELNVICNVAQFSVNKPKGYKGVAFPLPTDAGVATATGTKSATINYHEWQVGASLSYRLNSLVPYIGVQWSRATFDADNIRIAQPKLPTAVLNLTAWNPSLLGNTTTLPTSDSFSDFMQIVSCQINKFKSRKACGVTVGATLVDADKWSLTAEARLIN

SEQ ID NO: 13571 - protein, 224 aa, Neisseria gonorrhoeae
ASHFGVLSAKEEKNTTAKIFGLKQDWGGSAISNSSPTSVFTISNYSFKYENNPFLGFAGAIGYSMGGPRVEFEVSYETFDVKNQGNNYKNEAHRYYALSQDNTIAENKFVVLKNEGLADISFMLNACYDVTTEGIPFSPYICAGIGTDLVSMFETTNPKISYQGKLGLSYSISPEASVFVGGHFHKVIGNEFKDIPAIVPSGSTLAGNHFAIVTLNVCHFGIEL

SEQ ID NO: 13572 - protein, 238 aa, Neisseria gonorrhoeae
AGEGNGRGPYVQADLAYAYEHITHDYPKPTDPSKGKLSTVSDYFRNIRTHSIHPRVSVGYDFGGWRIAADYARYRKWNDSKYSVSIKNLQRRTSNGNRRDRKTENQENGSFHAVSSLGLSAVYDFKLNDKFKPYIGARVAYGHVRHSIDSTKKITQFLTTAGARGTVSTVHPPYKSTQDAHHQSDSIRRVGLGVIAGVGFGITPKLTLDAGYRYHNWGRLENTRFKTHEASLGVRYRF

SEQ ID NO: 13573 - protein, 232 aa, Neisseria gonorrhoeae
ASEDSSRSPYYVQADLAYAAERITHNYPEPTGADKDKISTVSDYFRNIRAHSIHPRVSVGYDFGGWRIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSVGLGVIAGVGFDITPKLTLDTGYRYHNWGRLENTRFKTHEVSLGMRYHF

SEQ ID NO: 13574 - protein, 247 aa, Neisseria gonorrhoeae
AGEDHGRGPYVQADLAYAYEHITRDYPDAAGANKGKISTVSDYFRNIRTHSIHPRVSVGYDFGGWRIAADYARYRKWHNNKYSVNIKELERKNNKTSGGDQLNIKYQKTEHQENGTFHAVSSLGLSTVYDFRVNDKFKPYIGVRVGYGHVRHGIDSTKKTKNTLTAYHGAGTKPTYYDDIDSGKNQKNTYRQNRSSRRLGFGAMAGVGIDVAPGLTLDAGYRYHYWGRLENTRFKTHEASLGVRYRF

SEQ ID NO: 13575 - protein, 738 aa, Haemophilus influenzae
MGYGKRALGGVSALALLAWAGAVHAQDEVTQVEELTVTARRQTENLQDVPAAVSAFGANSLYEDQVETVGDLQSHVPNLSLHVGDASNAVVYIRGVGQIDSISFNDPGVGVYLDDVYMGRVQGSFLDVIDPQQIEVLRGPRGTLYGRNTIGGALKFTSARPTNEVEGYLDATLGNYDDRRFKAVLGGPIASDVLLGKVAFAASRRDGYTKNLLTGEDDGDKDTIAGRISLLFRPTSDFSAYLTLDASRNSPDASRTPHRETPIYSVNTGALRPVIADPDVVEATYNDLEKLKTRGAALTLQYDRGPFTFKSITAYREMEYRTHLDLDSSPDESFGIYDFEDQDQTSQELQVLYKGERLSAVAGLFYFKENDETFAGLVGPDFFVILPGPTYFPFPANTSGLRLAENTSAAAYAQLDYKLTDRASVTVGARYTYEEKWTDNRGEWFDPAVAPSAEDMERLFRTGAGFNVTGFEAEEDWSSFTPKVAFNYQLSDDVLTYVSASKGFKSGGFNGRNTAAAQSFDPETQWSYEAGLKTELAERRVRLNLAAFYQDYKNLQLSRFAADPATGNFVAVFDNAGRANMYGLETELTAVVTPKFRIEANGAYLHSEYDEYIDGGVDISDQRHLVNAPKWSGRLSASYDLDLGDAGELTFTGGVSYRSKTYLTVSSSEVLAQDGYALLDASVVWSQPGGPWSVVVSGRNLTDERYREHAFDLTDSPGVQLGYYGAPRTYSVNVRYRF

SEQ ID NO: 13576 - protein, 233 aa, Neisseria gonorrhoeae
ASEGNGRGPYVQADLAYAAERITHDYPEATAQKKGTTISTVSDYFRNIRTHSVHPRVSVGYDFGGWRIAADYARYRKWNNSKYSVSIKKLQNQYNKKTENQENGTFHAASSLGLSAVYDFKLNDKFKPYIGARVAYGHVRHSIDSTKKTTGFLTTAGARGAAPTVSSPYKNTQDAHQESNSIRRVGLGVIAGVGFDITPNLTLDAGYRYHNWGRLENTRFKTHEASLGVRYRF

SEQ ID NO: 13577 - protein, 239 aa, Neisseria gonorrhoeae
ASEGNGRGPYVQADLAYAAERITHDYPEQTAPKKAQLSTVSDYFRNIRTHSIHPRVSVGYDFGGWRIAADYARYRKWNNSKYSVSIKELGRNDNSTSNSSHLNIKTQKTEHQENGTFHATSSLGLSAIYDFKLNDKFKPYIGVRVAYGHVKHQVRSVESETTTVTTHNGAPVPQGPTPKPAYHKSRSISSLGFGAVAGVGIDITPKLTLDAGYRYHNWGRLENTRFKTHEASLGVRYRF

SEQ ID NO: 13578 - protein, 237 aa, Neisseria gonorrhoeae
ASEDGGRGPYVQADLAYAYEHITHDYPEPTAPNKNKISTVSDYFRNIRTRSVHPRVSVGYDFGGWRIAADYARYRKWNNNKYSVSIKELLRNKGNGNRTDLKAENQENGTFHAVSSLGLSAVYDFKLNDKFKPYIGARVAYGHVRHSIDSTKKTTEVTTILHGPGTTPTVYPGKNTQDAHRESDSIRRVGLGAVAGVGIDITPNLTLDAGYRYHYWGRLENTRFKTHEASLGVRYRF

SEQ ID NO: 13579 - protein, 234 aa, Neisseria gonorrhoeae
AGEDHGRGPYVQADLAYAYEHITHDYPEPTGTKKDKISTVSDYFRNIRTHSIHPRVSVGYDFGGWRIAADYARYRKWNDNKYSVDIKELENKNQNKRDLKTENQENGTFHAVSSLGLSAVYDFKLNDKFKPYIGARVAYGHVRHSIDSTKKTTKFLTSSYGGLNPTVYTEENTQNAHHQSNSIRRVGLGVIAGVGFDITPKLTLDAGYRYHNWGRLENTRFKTHEASLGVRYRF

SEQ ID NO: 13580 - protein, 243 aa, Neisseria gonorrhoeae
AGEDHGRGPYVQADLAYAYEHITHDYPEPTGTKKDKISTVSDYFRNIRTHSIHPRVSVGYDFGGWRIAADYARYRKWNNNKYSVNIKELLRNDNANSGGSHLNIKTRKTEHRENGTFHAASSLGLSAVYDFDTGSRFKPYIGMRVAYGHVRHQVRSVQQETIAVTTYPQNAASSVTTNAPIRKLPHHESRSISSLGFGAVAGVGIDITPNLTLDAGYRYHNWGRLENTRFKTHEASLGVRYRF

SEQ ID NO: 13581 - protein, 234 aa, Neisseria gonorrhoeae
AGEDHGRGPYVQADLAYAYEHITHDYPEQTGTKKDKISTVSDYFRNIRTHSIHPRVSVGYDFGGWRIAADYARYRKWNDNKYSVDIKELENKNQNKRDLKTENQENGTFHAVSSLGLSAVYDFKLNDKFKPYIGARVAYGHVRHSIDSTKKTTKFLTSSYGGLNPTVYTEENTQNAHHQSNSIRRVGLGVIAGVGFDITPKLTLDTGYRYHYWGRLENTRFKTHEASLGVRYRF

SEQ ID NO: 13582 - protein, 234 aa, Neisseria gonorrhoeae
AGEDHGRGPYVQADLAYAYEHITHDYPEQTGTKKDKISTVSDYFRNVRTHSIHPRVSVGYDFGGWRIAADYARYRKWNDDKYSVDIKELENKNQNKRDLKTENQENGTFHAVSSLGLSAVYDFKLNDKFKPYIGARVAYGHVRHSIDSTKKTTKFLTSSYGGLNPTVYTEENTQNAHHQSNSIRRVGLGVIAGVGFDITPKLTLDTGYRYHYWGRLENTRFKTHEASLGVRYRF

SEQ ID NO: 13583 - protein, 223 aa, Neisseria gonorrhoeae
ASDVSGVMNGSFYVSGSYSPSFPSISSFAISESDRGGSYVKGYNKNLSTLNVSDPASFTQHEPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAG

SEQ ID NO: 13584 - protein, 281 aa, Neisseria gonorrhoeae
MNPARKKPSLLFSSLLFSSLLFSSLLFSSLLFGSAGASEGNGRGPYVQADLAYAAERITHDYPEPTAPGKNKISTVSDYFRNIRTHSIHPRVSVGYDFGGWRIAADYARYRKWHNNKYSVNIKELERKNNKTFGGNQLNIKYQKTEHQENGTFHAVSSLGLSAVYDFKLNDKFKPYIGARVAYGHVRHSIDSTKKITGTLTAYPSDADAAVTVYPDGHPQKNTYQKSNSSRRLGFGAMAGVGIDVAPGLTLDAGYRYHNWGRLENTRFKTHEASLGMRYRF

SEQ ID NO: 13585 - protein, 283 aa, Neisseria gonorrhoeae
MNPAEKTFFSSLLFSSLLFSSLLFSSLLFSSLLFSSLLFSSLLSAAQAASEAMRGPYVQADLAFAAERITHDYPEPTGTKKGTISTVSDYFRNIRTHSVHPRVSVGYDFGGWRIAADYARYRKWNNNKYSVNIERVQEAHSNRIDLKAENQENGTFHAVSSLGLSAVYDFKLNDKFKPYIGARVAYGHVRHSIDSTKKTTKILTSFYGVATKPTTYDIGPKTQDAHQESNSIRRVGLGVIAGVGFDITPKLTLDTGYRYHYWGRLENTRFKTHEASLGMRYRF

SEQ ID NO: 13586 - protein, 238 aa, Neisseria gonorrhoeae
ASEDGGRGPYVQADLAYAYEHITHDYPEPTAPNKNKISTVSDYFRNIRTRSVHPRVSVGYDFGGWRIAADYARYRKWNNNKYSVNIENVRIRKENGIRIDRKTENQENGTFHAVSSLGLSAIYDFQINDKFKPYIGARVAYGHVRHSIDSTKKTIEVTTVPSNAPNGAVTTYNTDPKTQNDYQSNSIRRVGLGVIAGVGFDITPKLTLDAGYRYHNWGRLENTRFKTHEASLGVRYRF

SEQ ID NO: 13587 - protein, 456 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVSVSASITGASVKITRNGSASQRNVVPGGFVPNLYFVAPVNDKFALGAGMNVNFGLKSEYGDSYDAGIFGGKTDLTAINLNLSGAYRVTEGLSLGLGVNAVYAKAQVERNAGLIADTVNDNQIKQALSTQQTTLRDLPKHLTSKDKSVVSLQDRAAWGFGWNAGVMYQFNEGNRIGLAYHSKVDIDFTDRTATSLEAEAIKAGKKGDLTLTLPDYLELSGFHQLTDKLAVHYSYKYTHWSRLTKLHASSENGKKAFDKELQYSNNSRVALGASYNLDEKLTLRAGIAYDQAASRHQRSAAIPDTNRTWYSLGATYKFTPNLSVDLGYAYLKGKKVHFKEVKAISQATLTLDTTANYTSQAHANLYGLNLNYSF

SEQ ID NO: 13588 - protein, 459 aa, Haemophilus influenzae
MKKFNQSLLATAMLLAAGGANAAAFQLAEVSTSGLGRAYAGEAAIADNASVVATNPALMSLFKTAQFSTGGVYIDSRINMNGDVNSDAIITSTSSGVKTIKHGSASQRNVIPGAFVPNLYFVAPVNDKFALGAGMNVNFGLKSEYDDSYDAGIFGGKTDLSAINLNLSGAYRVTEGLSLGLGVNAVYAKAQVERNAGIIVDSLKDNQVQTALSVQKEPLKYLHKYLPSKDTSVVSLQDRAAWGFGWNAGVMYQFNEANRIGLAYHSKVDIDFADRTATSVEADVIKAGKKGDLTLTLPDYLELSGFHQLTDKLAVHYSYKYTHWSRLTKLNASFEDGKKAFDKELQYSNNSRIALGASYNLYEKLTLRAGIAYDQAASRHQRSAAIPDTDRTWYSLGATYKFTPNLSVDLGYAYLKGKKVHFKEVKTIGDERSLALNTTANYTSQAHANLYGLNLNYSF

SEQ ID NO: 13589 - protein, 361 aa, Haemophilus influenzae
MKKTLAALIVGAFAASAANAAVVYNNEGTNVELGGRLSIIAEQSNSTVDNQKQQHGALRNQGSRFHIKATHNFGDGFYAQGYLETRFVTKASENGSDNFGDITSKYAYVTLGNKAFGEVKLGRAKTIADGITSAEDKEYGVLNNSDYIPTSGNTVGYTFKGIDGLVLGANYLLAQKREGAKGENKRPNDKAGEVRIGEINNGIQVGAKYDANDIVAKIAYGRTNYKYNESDEHKQQLNGVLATLGYRFSDLGLLVSLDSGYAKTKNYKIKHEKRYFVSPGFQYELMEDTNVYGNFKYERTSVDQGEKTREQAVLFGVDHKLHKQLLTYIEGAYARTRTTETGKGVKTEKEKSVGVGLRVYF

SEQ ID NO: 13590 - protein, 365 aa, Haemophilus influenzae
MKKTLAALIVGAFAASAANAAVVYNNEGTNVELGGRLSIIAEQSNSTIKDQKQQHGALRNQSSRFHIKATHNFGDGFYAQGYLETRLVSAQSGTESDNFGHIITKYAYVTLGNKALGEVKLGRAKTIADGITSAEDKEYGVLNNSKYIPTNGNTVGYTFKGIDGLVLGANYLLAQERHKYTTAAGTRAVTVAGEVYPQKISNGVQVGAKYDANNIIAGIAYGRTNYREDIVDPDLGKKQQVNGALSTLGYRFSDLGLLVSLDSGYAKTKNYKDKHEKSYFVSPGFQYELMEDTNVYGNFKYERDSVDQGKKTREQAVLFGVDHKLHKQVLTYIEGAYARTRTTEQAKGVKTEKEKSVGVGLRVYF

SEQ ID NO: 13591 - protein, 359 aa, Haemophilus influenzae
MKKTLAALIVGAFAASAANAAVVYNNEGTNVELGGRLSIIAEQSNSTVDNQKQQHGALRNQGSRFHIKATHNFGDGFYAQGYLETRFVTKASENGSDNFGDITSKYAYVTLGNKAFGEVKLGRAKTIADGITSAEDKEYGVLNNSDYIPTSGNTVGYTFKGIDGLVLGANYLLAQKREGAKNTNKQPNDKAGEVRIGEINNGIQVGAKYDANDIVAKIAYGRTNYKYNEADEHTQQLNGVLATLGYRFSDLGLLVSLDSGYAKTKNYKTKHEKRYFVSPGFQYELMEDTNVYGNFKYERTSVDQGEKTREQAVLFGVDHKLHKQLLTYIEGAYARTKTTNGGVKTEKEKSVGVGLRVYF

SEQ ID NO: 13592 - protein, 385 aa, Haemophilus influenzae
MKKTLAALIVGAFAASAANAAVVYNNEGTNVELGGRLSIITEQSNSTVDDQEQQHGALRNAGSRFHIKATHNFGDGFYAQGYLETRLVSDYPESSSDHFGGITTKYAYVTLGNKAFGEVKLGRAKTIADGITSAEDKEYGVLNNKKYIPTNGNTVGYTYKGIDGLDGLVLGANYLLAQSRVPGGPSPFPRKQGEVYPQQISNGVQVGAKYDANNIIAGIAFGRTNYKTAGADFDPYGDFGLGRKEQVEGVLSTLGYRFSDLGLLVSLDSGYAKTKYYTTTDSSSGSQTITNPAYDEKRSFVSPGFQYELMEDTNVYGNFKYERTSVNQGKNTREQAVLFGVDHKLHKQVLTYIEGAYARTKTNDKGKTEKTGKEKSVGVGLRVYF

SEQ ID NO: 13593 - protein, 220 aa, Haemophilus influenzae
MKKTLAALIVGAFAASAANAAVLYNNEGTKVELGGRLSVIAEQSNTTVDDQKQQHGALRNQGSRFHIKATHNFGDGFYAQGYLETRFVTDATKNHSDHFGDITTKYAYVTLGNKALGEVKLGRAKTIADGITSAEDKEYGVLNNSKYVPTNGNTVGYTFKGIDGLVLGANYLLAQERDQTDLTNRAGEVVDQSISNGVQVGAKYDANNIVAAIAFWSYKL

SEQ ID NO: 13594 - protein, 369 aa, Haemophilus influenzae
MKKTLAALIVGAFAASAANAAVVYNNEGTNVELGGRLSVIAEQSNSTRKDQKQQHGELRNAGSRFHIKATHNFGDGFYAQGYLETRLVSAQSGTESDNFGHIITKYAYVTLGNKALGEVKLGRAKTIADGITSAEDKEYGVLNNSKYIPIDGNTVGYTFKGIDGLVLGANYLLAQERYKYTTGAAAGAAGAAGAVAGEVYPQKISNGVQVGAKYDANNIIAGIAYGRTNYREDIASPDLGKKQQVNGALSTLGYRFSDLGLLVSLDSGYAKTKNYKDKHEKSYFVSPGFQYELMEDTNVYGNFKYERDSVDQGKKTREQAVLFGVDHKLHKQVLTYIEGAYARTRTTESKKGVKTEKEKSVGVGLRVYF

SEQ ID NO: 13595 - protein, 367 aa, Haemophilus influenzae
MKKTLAALIVGAFAASAANAAVVYNNEGTNVELGGRLSIIAEQSNSTIKDQKQQHGALRNQSSRFHIKATHNFGDGFYAQGYLETRLVSAQSGTESDNFGHIITKYAYVTLGNKAFGEVKLGRAKTIADGITSAEDKEYGVLNNSKYIPTNGNTVGYTFKGIDGLVLGANYLLAQERYKYGGAAGGAGGAGAVAGEVYPQKISNGVQVGAKYDANNIIAGIAYGRTNYRESIHEKDLGKKQQVNGALSTLGYRFSDLGLLVSLDSGYAKTKNYKDKHEKSYFVSPGFQYELMEDTNFYGNFKYERNSVDQGKKEREQAVLFGIDHKLHKQVLTYIEGAYARTRTNDKSKAEKTEKEKSVGVGLRVYF

SEQ ID NO: 13596 - protein, 370 aa, Haemophilus influenzae
MKKTLAALIVGAFAASAANAAVVYNNEGTKVELGGRLSVIAEQSSSTIDDQKQQHGTLRNQGSRFHIKATHNLGDGFYAQGYLETRFVSDFTREKSDHFADISTKYAYVTLGNNTFGEVKLGRAKTIADEITTAEDKEYGLLNSKKYIPTNGSTIGYTFNGIDGLVLGANYLFAQERALNEYAPALGKIGEVRTGSISNGIQVGAKYDANNIIVAIAYGRTNYKDTNATQRGRGSSYLYQGKKEKVNGALASLGYRFSDLGLLVSLDSGYAKTKNYKAKHTKSYFVSPGFQYELMEDTNLYGNFKYERNSIDQGEKEREQAVLFGIDHKLHKQVLTYIEGAYARTRTNDKGKTEKTEKEKSVGVGLRVYF

SEQ ID NO: 13597 - protein, 352 aa, Haemophilus influenzae
MKKTLAALIVGAFAASAANAAVVYNNEGTNVELGGRLSVIAEQSNSTADDQKQQHGALRNQGSRFHIKATHNFGDGFYAQGYLETRFVTKASENGSDNFGDITTKYAYVTLGNKAFGEVKLGRAKTIADGITSAEDKEYGVIKNSKYIPTNGNTIGYTFKGIDGLVLGANYLLAQERYEGEVNPQKISNGVQVGAKYDANNIIAGIAYGRTNYRENTIGIPDLGKKQQVNGALSTLGYRFSDLGLLVSLDSGYAKTKNYKAKHEKRYFVSPGFQYELMEDTNVYGNFKYERNSVDQGKKTREHAVLFGVDHKLHKQLLTYIEGAYARTRTTSGTNVTTEKEKSVGVGLRVYF

SEQ ID NO: 13598 - protein, 363 aa, Haemophilus influenzae
MKKTLAALIVGAFAASAANAAVVYNNEGTNVELGGRLSIIAEQSNSTIKDQKQQHGALRNQSSRFHIKATHNFGDGFYAQGYLETRLVSAQSGTESDNFGHIITKYAYVTLGNKAFGEVKLGRAKTIADGITSAEDKEYGVLNNSKYIPTNGNTVGYTFKGIDGLVLGANYLLAQERNKYGTGVGEVTSQSISNGVQVGAKYDANNIIVGIAYGRTNYREDVSQQDDAGKKQQVNGALSTLGYRFSDLGLLVSLDSGYAKTKNYKDKHEKRYFVSPGFQYELMEDTNLYGNFKYERNSVDQGKKEREHAVLFGVDHKLHKQVLTYIEGAYARTRTTTRDTTKNTSTVKTEKEKSVGVGLRVYF

SEQ ID NO: 13599 - protein, 357 aa, Haemophilus influenzae
MKKTLAALIVGAFAASAANAAVVYNNEGTKVELGGRVSIIAEQSTSTGDDQKHQHGALRNQGSRFHIKATHNFGDGFYAQGYLETRFVTDASKNGSDNFGDITTKYAYFTLGNKAFGEVKLGKAKTIADGITTAEDKDYGVLDSKKYIPTNGNTIGYTYKVTDGLVLGANYLLAQERNYDDGEVIPQKVSNGVQVGAKYDANNIIARIAYGRTNYKENTIAGLDLGKKQQVNGALASLGYRFSDLGLLISLDSGYAKTKNYKAKHKKSYFVSPGFQYELMEDTNLYGNFKYERTSVDQGEKGREHAVLFGVDHKLHKQVLTYIEGAYSRTRTAANDGNTKEKTEKEKSVGVGLRVYF

SEQ ID NO: 13600 - protein, 170 aa, Neisseria meningitidis serogroup C
IQPPKNLLFSSLLFSSLLFSSAAQAASEDRRSPYYVQADLAYAAERITHDYPQATGANNTSTVSDYFRNIRAHSIHPRVSVGYDFGGWRIAADYASYRKWNNNKYSVNTKELENKHNNKKDLKTENQENGTFHAASSLGLSAIYDFKLKGKFKPYIGARVAYGHVRHSID

SEQ ID NO: 13601 - protein, 170 aa, Neisseria meningitidis serogroup C
ILYADWTPTGYIPNPEYRGDLVANVLWQAAYNAISGLHNLTTPPPRASRIGIAGGGSGAYVSQKTRNLKPGFELFSRGYSTQASSPIKKTNHNFALSFSQFYSEIKESESKSKVSSNCYFAGAQLQIPWLNENILSSASLGYAYSHNCVKTKNQNTNTLSQGYFQGHTLG

SEQ ID NO: 13602 - protein, 219 aa, Bordetella bronchiseptica
MSEQITFATSDFASNPEPRCPCILLLDVSGSMNGRPINELNAGLVTFRDELLADPLALKRVELGIVTFGPVHVEQPFTSAANFFPPILFAQGDTPMGAAITKALDMVEERKREYRANGISYYRPWIFLITDGAPTDEWQAAANKVFRGEEDKRFAFFSIGVQGADMKTLAQISVRQPLPLQGLQFRELFSWLSSSLRSVSRSTPGTEVVLEAPKGWTSV

SEQ ID NO: 13603 - protein, 304 aa, Bradyrhizobium japonicum
MLRRTLLASAGAMALTGAALAAEPALAPPPVIPPPPPAWTGLYVGFNAGGTWSNSTTIHTTTEDIVGNPGVVGGPAFGVASADLATGSISPVNHSGFIGGGQVGYNYQFNNSWSSWVAGIEADIQGVAASNSAHLVFGQAFVPGFAGSPIDQNLSSSMTGDFLGTVRGRLGFTIIPTLLFYGTGGLAYGQTDSRTSITQIVENDPALPNHYSSFGSISNSRVGWTAGGGGEWLFAPNWSVKVEYLYYNLGSVSYGLTPLQNFNTAGTLFTDGAPFSRASFRGNIVRAGLNYHFNFTPPPVVAKY

SEQ ID NO: 13604 - protein, 847 aa, Chlamydophila abortus
MKHPVYWFLISSSLIVSNSLYSEEPDQKTLTSAHSYNGNTNSEPFNPLSTSNSNGTIYTCTGNICIAYAGLDGSGLSSSCFTDTAGNLSFLGNGYILCFDNITTQSSHPGAISVSGTNKTLDISGFSLFSCAYCPPGATGYGAIKAVGNTTIKDNSSLVFHKNCSTGEGGAIQCKASSSEAELKIESNQNLVFAENSSSSSGGAIYADKLTIVSGGPTLFSNNSVSASSPKGGAICIKDSGGECSLTADLGDITFDGNKIIKTNGGSPTVTRNSIDLGSSGKFTKLNAKEGFGIFFYDPITGGGSDELNINKQDTVDYTGKIVFSGERLSDEEKKVAANLKSDFKQPLKIGSGSLILKDGVTLETKSFTQTEGATVVMDLGTTLQTPSSGGETITLTNLDINVASLGGGGVAPDPAKVEATTESKTVTINAVNLVDDNGNAYEYPILAASQPFTAIEVRSGSSGSITKPTTNLENYTPPTHYGYQGNWTVTWKQGSSAQEKTATLTWEQTGYSPNPERQGSLVPNTLWGSFSDIRAIQNLMDISVNGADYHRGFWVSGLGNFLHKSGSDTKRKFRHNSAGYALRVYAQTPSEDVFSAAFCQLFGKDKDYLVSKNSSTVYAGSIYYQHISYWNTWNTLLQNTLGAEAPLVLNAQLAYCHASNNMKTNMTDTYAPPKTTYSEIKGDWGNDCFGVEFGAKAPIETASLLFDMYSPFVKLQLVHAHQDDFKENNSDQGRYFESNNLTNLSMPIGVKLEKFSHKDTASYNLTLAYAPDIVRSNPDCTASLLVSPTSAVWVTKANNLARHAFILQAGNYLALTRNTELFSQFGFELRGSCRTYNIDLGLKIQF

SEQ ID NO: 13605 - protein, 847 aa, Chlamydophila abortus
MKHPVYWFLISSSLIVSNSLYSEEPDQKTLTSAHSYNGNTNSEPFNPLSTSNSNGTIYTCTGNICIAYAGLDGSGLSSSCFTDTAGNLSFLGNGYTLCFDNITTQSSHPGAISVSGTNKTLDISGFSLFSCAYCPPGATGYGAIKAVGNTTIKDNSSLVFHKNCSTGEGGAIQCKASSSEAELKIENNQNLVFAENSSSSSGGAIYADKLTIVSGGPTLFSNNSVSASSPKGGAICIKDSGGECSLTADLGDITFDGNKIIKTNGGSPTVTRNSIDLGSSGKFTKLNAKEGFGIFFYDPITGGGSDELNINKQDTVDYTGKIVFSGERLSDEEKKVAANLKSDFKQPLKIGSGSLILKDGVTLETKSFTQTEGATVVMDLGTTLQTPSSGGETITLTNLDINVASLGGGGVAPDPAKVEATTESKTVTINAVNLVDDNGNAYEYPILAASQPFTAIEVRSGSSGSITKPTTNLENYTPPTHYGYQGNWTVTWKQGSSAQEKTATLTWEQTGYSPNPERQGSLVPNTLWGSFSDIRAIQNLMDISVNGADYHRGFWVSGLGNFLHKSGSDTKRKFRHNSAGYALGVYAQTPSEDVFSAAFCQLFGKDKDYLVSKNSSTVYAGSIYYQHISYWNTWNTLLQNTLGAEAPLVLNAQLAYCHASNNMKTNMTDTYAPPKTTYSEIKGDWGNDCFGVEFGAKAPIETASLLFDMYSPFVKLQLVHAHQDDFKENNSDQGRYFESNNLTNLSMPIGVKLEKFSHKDTASYNLTLAYAPDIVRSNPDCTASLLVSPTSAVWVTKANNLARHAFILQAGNYLALTRNTELFSQFGFELRGSCRTYNIDLGSKIQF

SEQ ID NO: 13606 - protein, 145 aa, Chlamydophila abortus
DPEEQSVFPAFVRFGFNANSLFGIRSRTSTLQFTLEPFVNAFSGTEKGVEAGCGFGIRCLQEVARPVDLFLEASVAPMYYSIDTLEQGASGFNFLDQIGAGLQYRLAPGKAVFGGYRFRHISHAHVVSRSNDGINSSAFVLGFSW

SEQ ID NO: 13607 - protein, 926 aa, Chlamydophila abortus
MRPSLYKILISSTLTIPLSFHFSQVHAEVALTQESVLDANGAFSPQSTSTAGGTTYNVESDISIVDAGQAAAMVSAAFVQTADDLTFKGNGRSLAIENVNSGANPGAIYVSAADKTLTLTDFSTLSFKKCPKHTVNTGKGAVKSGGALNLANNASILFNQNHSAEDGGAISCKAFSLTGSSKEISFTTNTSTKKGGAIAATGVANLSDNQGKVIFSGNTAVNSGGAVYAEANTTIAGNSAVVFNNNAVTGTTDGCGGAIHCSKTGATPVLTIRDNKVLLFKENTSAAKGGAIYADKLYLTSGGPTVFVGNKATNAAPKGGAIGIAANGECSITAEHGDITFENNLIATANNATVKRNAINIEGNGKFVNLRAASGNTLTFYDPIVVGGTAADLLTLNQAEGTKVYNGRIIFSGEKLTEDQTADADNLKTVFTQPIALAAGELILRNGVEVEAKAVSQTAGSLILIDAGTKLSAKTEDVTLTNLAINPNSLDGTKIAVIAAVANAKNVTVTGAIGIIDPTGKFYEDHKLNETLALGGIQFSAKGSITTTDVPSTTTRSPAQHYGYQGNWSLSWITDNGSDPKTQTAVFNWNKTGYNPNPERRAPLVLNSLWGSFMDIRSIQDVMERSVDTLLETRRGLWVSGVGNFLHKDPSAENRKFRHISSGYVLGATTNTSQEDTLSVAFCQLFGKDKDYLVAKNAANVYAGSIYYQHVSKFDDLTRLFNGPNTCCSGFSKEIPIFLDAQVTYCHTNNNMTTTYTDYPEVKGSWGNDTVGVALSTSVPIPIFTHAFFDSYAPFAKLQVVYAHQEDFKEPTREGRTFESSDLLNVSVPIGVKFEKLVYGEKTAYDLTLMYVPDVYRHNPNCITGFAINDVTWLTTATNLARQAFIIRAGNHIAVTSGFEMFSQFGFELRSSSRNYNVDLGAKVSF

SEQ ID NO: 13608 - protein, 315 aa, Neisseria flavescens
EVSKVKEGKTSSKTATEIADFGSRIGFKGHEHLGSNLNAIWQVEQRTSIAGGDSGFANRESFLGLEGGFGKVRVGNLDTALNESSDSFDPWESSDANADTLQLGKIKRVDGRKVSVRYDTPVFGGFSASVQYQPRDNANPSDKYDHAVKSRESYDLGLNYENSGFFGRYAGSFAKHAVLDAGYLDTFNGNTTLTAGTYKDHQAHRLTAGYDADNLMVAVVGQYEGFKKDVANAKKNERVEVGATAAYRFGNVTPRVSYAHGFKAKEEGVKQENSVYNQVIVGADYDFSKRTSALLSAGWLKEGKGDNKYEKTAGT

SEQ ID NO: 13609 - protein, 335 aa, Neisseria flavescens
EVSRTKHTYADGENQPIVTTKDRVATEITDFGSRIGFKGHEHLGNNLNAIWQVEQNASVAGTDKGWGTRESFIGLEGGFGKIRAGKLNTVLKDSGDNVNVWESGSENADVLQLGTIGQMEERKVSVRYDSPVFAGFSGSVQYVPRDNADPQDKGKHEQPSLDSYHFGVNYENAGFFGQYAGVYAKNKIVTNDIQNLIDMNDDDYVTGKDYQVHRLTAGYNANNLYVAVTGQHQSYRIHEAYDAASETSFAYDGGKASQTEVAATAAYRLGNVTPRVSYAHGFKGKVEGEKQNYSGYDQVIVGADYDFSKRTSALVSAGWLQTGKGESKAVTTAGM

SEQ ID NO: 13610 - protein, 118 aa, Neisseria lactamica
QSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 13611 - protein, 791 aa, Neisseria meningitidis
MKPLQMLPIAALVGSIFGNPVLAADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYAVEGEGSGANIRGSARGIPDSSKHKYHSFLGKIAYQINDNHRIGASLNGQQGHNYTVEESYNLTASSWREADDVNRRRNANLFYEWMPDSNWLSSLKADFDYQKTKVAAVNNKGSFPMDYSTWTRNYNQKDLDEIYNRSMDTRFKRFTLRLDSHPLQLGGGRHRLSFKTFVSRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNLFNRKYTTWDSLRGLYSYSTTNAVDRDGKGLDRYRAPGRNYAVSLEWKF

SEQ ID NO: 13612 - protein, 792 aa, Neisseria meningitidis
MKPLQMLPVAALVGSIFGNPVFAADEAATETTPVKAEVKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTVEESYNLLASYWREADDVNRRRNTNLFYEWTPESDRLSMVKADVDYQKTKVSAVNYKGSFPIEDSSTLTRNYNQKDLDEIYNRSMDTRFKRITLRLDSHPLQLGGGRHRLSFKTFASRRDFENLNRDDYCFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGDWLPNPNLKAERSTTHTLSLQGRSEKGTLDANLYQSNYRNFLSEEQKLTTSGDVSCTQMNYYYGMCSNPYSEKLEWQMQNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPVKNLTLRAGVYNVFNRKYTTWDSLRGLYSYSTTNSVDRDGKGLDRYRAPSRNYAVSLEWKF

SEQ ID NO: 13613 - protein, 299 aa, Neisseria polysaccharea
QTYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKIGAPEHPYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTAST

SEQ ID NO: 13614 - protein, 169 aa, Neisseria sicca
DGVTPADTPDPINNPPVVDPEGPSVYRPEAGSYISNIAAANSLFSHRLHDRLGEPQYTDSLHSQGSASSMWMRHVGGHERSRAGDGQLNTQANRYVLQLGGDLAQWSSNAQDRWHLGVMAGYANQHSNTQSNRVGYKSDGRISGYSAGLYATWYQNDANKTGAYVDSWA

SEQ ID NO: 13615 - protein, 723 aa, Pseudomonas aeruginosa
MEKRMSTQQRAAGNACPTAAFSFDPARLAQRRRWAGAFAALCGLALSPSALLAEEHSQHQDHAVELAPSVVTGVAQSSPLTIVTNPKEPRQPVPASDGADYLKTIPGFAVIRNGGSNGDPVLRGMFGSRLNILTNGGMMLGACPNRMDAPTSYISPETYDKLTVIKGPQTVLWGPGASAGTILFEREPERFGELGSRVNASLLAGSNGRFDKVLDAAAGNRLGYLRFTGNHAQSDDYEDGAGNTVPSRWKKWNGDVAVGWTPDEDTLIELTAGKGDGEARYAGRGMDGSQFKRESLGLRFVKSNVSDVLEKVEAQVYYNYADHIMDNFRLRTPDPSSMMPMPMASQVDRRTLGGRLAATWRWDDFKLVTGVDAMRNEHRARGSKYDMMTDYYTDADQFPWNKDAVFHNYGAFGELTWFAAERDRLIGGLRLDRASVKDYRQTLKSGHMGHAMANPTANDTRADTLPSGFVRYEHDLADSPTTLYAGLGHAERFPDYWELFSPKRGPNGSVNAFDKIKPEKTTQLDFGLQYNGDKLQAWASGYVGVVQDFILFSYREGMMGSSTQATNVDARIMGGELGASYQLTGNWKTDASLAYAWGKNSSDDRALPQIPPLEARFGLTYEEGDWSAGSLWRVVAPQNRIARDQGNVVGKDFDKSAGFGVFSLNGAYRVTRNVKLSAGVDNLFDKDYTEHLNKAGDAGFGFSANETVPEPGRTFWTKVDFSF

SEQ ID NO: 13616 - protein, 740 aa, Porphyromonas gingivalis
MKRLISRTLIRLLLILCIPMSLAAQRQIAGTVTDTKDRPIVLANVYPINSFDGMATDSLGRFRFTTSSTFPMRLVVSHINYHSDTLTIRKGDPMENIRIRLRETDDYKLSEVVVSVSAFGVGGKQNKTVLNPMDVYTNPSGNGDLSMALRQTPGLQDVGDREGFFVRGGASWETAVTIEGIRVKRFFGKNRFDAPARSRFETGMFSGLSLSTGGYGATEGGALSGLLRLRLAGKSPSSVGIGISPLFVNGGGGHLSRSNRFYIEQNASVSDAAYIRLLLKPEYKLPGTNRSYAYNARTIWNPTSQDEVKGLFLFVHDLSSSALRIPSPATAYMLYAGRNTYGFGMAVWRHDFEGGKTTSTLSAGYSEDHNRLHRQLEIEPDIESTFRTVERDANIRLRFDSRIKAWRLSYGSDYTYSEAKSSVREDKSSALPTLREHLVAAYAEALFPLSNRISATAGLRAEYSGLTESAIVLPRLSATYKLSPSSRITLDAGGYAAPGDYYLSHRIVPQKREHSQQYNLTYEWRPSRTQVLRFQAYDKEYSRLTTLAPDGTASNLGKGYARGLDFFWKASGLIRSFEHWFSYSYTDARRQYLFSPDQERPDFVAKHTLSTVLKYWCAPISSLFNVSMSWRSGMTYHDPNIASPAYLNASLPANFSMSASYNYPFKYKKAGGVLVFSVHNLFNSDPTYGYRFGDKPIGGVYPSVRISTPYRQFYMVGLFINFGIDRRQEIMNTDIKIKSR

SEQ ID NO: 13617 - protein, 871 aa, Shigella dysenteriae
MSRPPHPHALSLALGLALIAWLPWQSTAADMSGGADALTMDAVQVRNPFQSQNTRAIATKQAAPTIVDSVAADSIGQLPDFNVGDALRRVTGVSTVEYQGEPRYVTVRGLNGNYNSMLIDGFAFASNDIGSRQALMDVLPANFVDRIDVVKSLLPENDGGAIGGVTDLVTATGFARPDGLLTASAKGGANLMGSRYGGRTPVGEGELKWGKRFGRDGQFAFLGAASIWRREISVPQQENGGALNWYNADGTRAPSAYGGTGAAVPSERRWYNYDNTRERRGVTARVDWQPDGPLSGHVSGYTFNQHEASDRNAQVAQVQNSARLTRSGAQSGTLDNLNQLVELGQLRWKRGLSGINGELLAELPGQWRGALRASTSRATVDNPQTWDRFQQNRLAYGFDWNGTLPAFTALDPALADDPTRYANLNHQQERTTYAERVSDLQLELRRNMDEDSRGLGLAFGLRQVRTHMQTAFQRTTWSGLPYSLADVLGDPTCALGCNAPMWTIDPDLADARWDAASGQARGVADITAQNSGTYTVDEQVRAGFAQAQWRGERWRLAGGVRLEQTRFGSSGQQLSGTVWAPVSAQRTYRNWLPSLAGQVQTSANGTLRFGASRSIGRPRLDQMALNGGVLALGSNPPTLNQGNPDLQPRRSQNLDLGHDWTFDDGGSLLSIALFHKTIDNEIFRYGQLQNIDGEQVLVTQPRNTDRPVRMRGAELGAIKELGPWLPALAGLSVGANVTFLDVDYPVVLGDGSRTTLSVLPQQPKQLWNLTLNYARGPLRGTLAWSRTGELWDDRYPNYSNQQEFYRNRYQQPLDRLDLKLAWDVSPAVAVSLDVLNLTGQGYEYRIGRHQEYVQSAWKMAPTVMLGVNVKL

SEQ ID NO: 13618 - protein, 275 aa, Synechocystis sp.
MGGPGLYSGIGKKAKDLLYRDYQTDHKFTLTTYTANGPAITATSTKKADLTVGEIQSQIKNKNITVDVKANSASNVITTITADDLAAPGLKTILSFAVPDQKSGKVELQYLHDYAGINASIGLTANPVVNLSGAFGTSALAVGADVSLDTATKNFAKYNAALSYTNQDLIASLNLNNKGDSLTASYYHIVEKSGTAVGAELTHSFSSNENSLTFGTQHTLDPLTLVKARINNSGKASALIQHEFMPKSLCTISAEVDTKAIEKSSKVGIAIALKP

SEQ ID NO: 13619 - protein, 237 aa, Synechocystis sp.
MWGAGPTFWRNCMMYHIPGVLSPQDVARFREQLEQAEWVDGRVTTGAQGAQVKNNQQVDTRSTLYAALQNEVLNAVNQHALFFAAALPRTLSTPLFNRYQNNETYGFHVDGAVRSHPQNGWMRTDLSATLFLSDPQSYDGGELVVNDTFGQHRVKLPAGDLVLYPSSSLHCVTPVTRGVRVASFMWIQSMIRDDKKRAMLFELDNNIQSLKSRYGESEEILSLLNLYHNLLREWSEI

SEQ ID NO: 13620 - protein, 309 aa, Synechocystis sp.
MNTKFITASVFSLISPSILQAADVVAPEEPVHVVSEVVTSSDFSWSGFYFGGQIGGFSSKISGTTRDVDTPLYPDEESKNKPWVPLEKQYKPELSGFVGGLYAGVNFDLGNNLIVGLDTDILLTEKKDTKTFIHTEESSASGSGTEGTEPGGSGTEGTEGTEGTEEKSLKRVKLQGRGFSRSDPENKEEKNSLTFNHTFKQKWTGATRVRLGLSAHRVMPYIAGGIAYGQFQDVLSTVITGDESFNKTSDVTKTMVGYTLGGGVDFAMTDNLVVRAEYRYSDFGKKKFKDEIEIKYKTNDFRAGIAYKF

SEQ ID NO: 13621 - protein, 498 aa, Synechocystis sp.
MQGTKIRLLAGGLLMMATAGYVQADALQPDPAWQQGTLSNGLQWQVLTTPQRPSDRVEIRLLVNTGSLAESTQQSGYSHAIPRIALTQSGGLDAAQARSLWQQGIDPKRPMPPVIVSYDTTLFNLSLPNNRNDLLKEALSYLANATGKLTITPETINHALQSQDMVATWPADTKEGWWRYRLKGSTLLGHDPADPLKQPVEAEKIKDFYQKWYTPDAMTLLVVGNVDARSVVDQINKTFGELKGKRETPAPVPTLSPLRAEAVSIMTDAVRQDRLSIMWDTPWQPIRESAALLRYWRADLAREALFWHVQQALSASNSKDIGLGFDCRVLYLRAQCAINIESPNDKLNSNLNLVARELAKVRDKGLPEEEFNALVAQKKLELQKLFAAYARADTDILMGQRMRSLQNQVVDIAPEQYQKLRQDFLNSLTVEMLNQDLRQQLSNDMALILLQPKGEPEFNMKALQAVWDQIMAPSTAAATTSVATDDVHPEVTDIPPAQ

SEQ ID NO: 13622 - protein, 828 aa, Synechocystis sp.
MNKLTLSIAILAATNAMVESVVAQDSSTLEEITIVGSKATLISAIEKQRESNSLISVVDSDAMGSFADTTAAEAIRRLPGISIENDQSEGRYVTIRGLSSDLNSIAVNGASMVAPENGRSVMLDGLPTELLDSITVAKSLTPDMDSDSIGGRVDFKTKKPLELDDRLLALKVQNNFGQYAAEKLNPKLALTYGDKINDMAAHVLGVTYSSKDIVAFNNETGFGWEDGALNDDYEMRYYELTRERLGITYDVDFLLDDDRLFANLFWNQYNDSELRWKDEYGDIGDQVISTSENGMVVNEIKHDAETRVREETRTIAAFNLGYETAVSGWFVDTMVSYSFAEEDDSNNAEANFRTKYRNDEKITTINWADSQRPYLTPADASLYDPAEMGFDGFEVTANVSQDSEVAFVFNAEKEFDFGVIKTGVKVKSREKDVDDYIIVYDGWGDNTLADMNPQTNSDWFFADQTFSQQADPSLVWAMKDQVDEMDVDFEDDISRDFTTTEDIFAAYVQNTYTWDKGVVVGGMRYEDTSVDSQAHDQVTLAQTTASSDHSFFAPSVNVKYFFNDQLQLRAAIWKGLSRPGFAKTAPKLNVDYDDGGARVSGSAGNPLLKPYEAVNYDLSIEFYGEGMTFISAGLFRKDIKNAIYPTIQENATILGIAFNDGVETWINSGDSTIDGFELNGQYGWDNGIYVAANMTLTDGESSFAVEDDKSFTTPFRKLADEAANISIGYDKGPWDVRVAANYRSEYLDWLADENGSIDDLSENNIRWVDAYVQVDLTAKYKVNEALSIKFEAVNLGNRAEYYYWGDDSQLSQYDIFGKNYSLGMTYSF

SEQ ID NO: 13623 - protein, 645 aa, Synechocystis sp.
MLKLRSLFQVPSVMLGMMMLMSASSQAVPLSELADPDFRLKQSRDGLLNSNRRNQGSISQIINVSDLETQNRLFPKSDRRLPLKQSHEGSLSQVTNVSDLRDVSPTDWAYEALRGLVERYGCIVGYPDRTFRGQRSLSRHEFAAGLNACLNTLERLLQENVAVLREDIEKLKRLAREFEGELMALGARVGNLEARTAYLENHQFSTTTKLTGEIVVGLTGITQGEKNEGTEEINKVTNLGYRGRLELNTSFDGDDSLYIRLATGTVPVYSDIAGTFEGDFGFSQPDDSDLAVELIIYEFTLAENLRMFVEPVGGAFDDFTPTINFLDGDGASGALSAFGTRNPLYYMADGPGIGFQGTLFEVFEWSAGYLATEGNNPGLGRGMFNGPYGAIGQIAYKPSDDFTVAFTYVHGYNNLDTGTGTRRSNFQAFIEEEFETDVRTVNNSYGMEFSWRIAPKFVLGGWAGVTKSRTQNAINIVRELVAEEIPIEEPVIAAVPPEEIATEELLTEESLPQETSVEEPPVQEVIPEEIATEEVPTEELLTIDRGNMDIWNWAVTLAFPDAFKEGDTAAVIFGMQPWVSKSNLNLPDGLRNNDRDTSYHIEAFYQYPLNDNISITPGIIVITAPDYDNKNDALVIGTIRTTFSF

SEQ ID NO: 13624 - protein, 245 aa, Synechocystis sp.
MNFSRTTRFAGATVCICSAFLADDARAQTAGSVTTSVGWLHIAPQGNATPLVVQSVGGVTVNQELAGSSAHASSTDTLGITTEYYVTDNFGVAMLFGMPLKVNLIGDGTLQKYGTLGTTRPMPPAIELRYHLFSATSKFRPYLGIGANYTWFTQVRATNSQFVSDSFGPGGSARATLSASWNPVFEIGTNYALTRHWSVGASVNYMPVKTHLTLYGQTATGTQIVSKSTLRLNPVSVFLNVAYTF

SEQ ID NO: 13625 - protein, 1048 aa, Synechocystis sp.
MTFTSGIQHKKKLLAMLISCALYNTSALAQEEDTSTVEDDANLEEVIVTGVRASQAKAIDIKRNSANVVDSIVAEDIGKLPDTTITDSLQRVTGVQITRSAGEGTSLNIRGMPQVLTTLNGEQFLSPWAITGVQANYSDVPAGMISGADVYKSQSANVLAGGISGVVDLKTLDPTSLDAGFTGKLRIEGATGSRSKDKYEEDGSKSTRAPDHSVSLVLGFNDDDRFSVVTNLYTANSYAANYSMYEDQRLAFLDGQGGTPSDPYDLDGDGDLVNDWYIVPGEYGASSSFVERDRTGGSISSEFVINDNWSVRGDIFYTAMEQYNRGVKAGFNGKSTPESFQADADAALYQTDVYNTLQPNSIVGEGSTISFVDSDGVTQYRDLHTLQVAEVWAADFQTSSTNEIDKTAALNTNLEFNYTNNDNIDASVRAIYAKAEKQYRKATFQQGTPAWLWVDENGVPGKDPIDGYHVTVDYRGDMPAFSFTDDLSNASLLKQYQGFADGANTDATLGALRGDIKLALDGDFIQSVSGGVRYSEREANHNKFYYVTRTGRYTDWEDPRVPVDKRYRLLPGNLIWQKYPNWLKFDYAETNPSLIDIGGLEDNGFSAADTTAFRDFGPIKGFEAGVASLDPADWDNPYEFMNRLYPGTQTASDPGYTYSVKEASINTYAQLDFGNESEGLFGIPYQGNVGLQVVTVDRTVEQIVVPEALDSFNSIGYDDWQKIAFVSEVATHENSQTELLPSINLNLFPRDDVILRVGASKTMTRNDLENVGSSLALWYQQCPKTDENGEPVMVLNPSNGTQVQDTVGCIGGGSDNGQPDIKPWTATVFNTSAEWYFDENAILGLGVFLIKVDSSVESFQEQRPFVDLDGIDRDRVANVWTTRNVGASDLFGAELGYKQPFTFLPGEFLSSTGVEFNYTYSDSESGGEDVEGNAFPLPSNSQHQSNFILWYDRAGLNVRLAYNWRSEEYLGRVGVNSNAAVMELGQWLEPAGYLDLSVNYWVNEHLNFFASGNNLTEQSRKSYAQYEGQFHSLWVQETRYSIGVNLSL

SEQ ID NO: 13626 - protein, 680 aa, Synechocystis sp.
MRTPLVRAALAALSGLPCIALARGDAAASPPPSAYPAAYASAASPSAAAAPAADAAMSTTPAASANAASFAFAASGASEALSASPARSRPASVEPLAPIVVTAQRGQQKLADAIPQTTLFDAQDIADSGATDLPGLLALAPGAQIVRNGGPGASASLFLRGAQSTQSLVLIDGVRIDSASLGRAQIDQLPLDQIERVEVVNGNVSSLYGSGAIGGVVQVFTKNGGNHPPRFDFSVGYGSYHTQTQSAGASGRLDEDGKTTFSVSLARLKTDGFSALDPARKPQANPNANGFLSESASASLRHRFSDKWDAGVTYFQANGRNSYDDAYGSPTDLNDLYSRVQQLSAFANGKLADWWTTRVNVSSGKDRSQSALNGAYTDHFNSGNRQYTWQNDFTVARGHKIQAGYERLDQSFESNRYSAPDRHVNSGWLGYTGRLGDSQFQANVRRDQYSDFGGANSYFLGYGFDVTERWKVSASYSSAFRAPSFNDLYYPNAGNLAIKPERSHSVEAAVQYASDAVGVVRVTAFQTRYTNLIDYRPGASGPYYVAQNVGRAKVQGVEGSWQGHVGKTDVRVAATLQNPIDETAGQDLNRRARRFASISAHRSLGGWRVGGEWLVSGPRDDFGDHLGGYGVVNLSARYDITKSWYVSARIDNLFDKDYELAYAYNTPRRGAYVTLGWQQR

SEQ ID NO: 13627 - protein, 660 aa, Escherichia coli
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 13628 - protein, 384 aa, Chlamydophila abortus
MKHPVIFAAALAAFAAPAFAETSVTLYGVIDEGFNYTNNVNVNGVGKTNYQLASGYAQGSRWGLKGTEDLGGGLKAVFTLENGFDVNNGRLGQGGRMFGRQAFVGLSESRFGTLTFGRQYDAVVDYLAPLTANGNWGGTLFSHPFDNDNTDNSFRVNNTVKYASADWNGLTFGGTYSFSNSTGFSNNRQYSIGAQYSLAGLQVAAAYLQANNPGIGSAGAIAADDANFVADRLRIFGGGVNYTFGPATVGVVYTKTDVKNPVSTVYLPASTFAGLGLTATKFQNFEINGKYQLTPDFYLGAQYVYTDGKYDAAAGSFKPKYHTVGLMADYSLSKRTDVYLQGAWQKVGGDKTGTAADGGYVVGTDGPSASSNQFSVRAAIRHKF

SEQ ID NO: 13629 - protein, 719 aa, Synechococcus lividus
MKRLFPLSLLSLMILNIQGANAEELIDSSSKAAATMPTIKIEAMSELDPIKSYIDYDKANVTRNGLDKKDIPQTVDTIDVQKYKIYGSNDLSVMLQGTPGVSTSYDMRGDGITIRGFGADTGDIYRDGIRESGQVRRSTANIERIEILKGPASVLYGRSAGGGVVNMVSKFANFDSKSSVGAYAGSYDNYGTTADINQVLNDNLAVRLTGEYSEAGSFRSGIENKIEMFSPSFTYKNDDGKLTWTTQYTYDKLGRVPDRGPTRNNLPAGTSIKMGFAQDGDYVDDILQVVRTDVNYEYAPDWNFHWAASYRQAEQNFDHFYFGNYCGLDGKNSKNEACTKKGYIDQIYYWQQTSNKTTTNTFDIKGKFKTGQLEHQIMVGTDWTYEQREPRLANKTQNGSAIYGYVNPITGEREYSRGNGPLKISQHNYNEGTTYGVFMQDLIGLNDQLKLMMGLRYDYFDFSTTNKIKNEHRNVKDSTFSPNVGLVWQPVPEHSFYTSYSKSFAPFGGQMGVNQVTGSTDVAKMDKEPQYNEQYEVGVKSEWFDNRLNTQFSVFDIRKNNIRYKPNPDSEPEVWATAGQHQSRGLEFSFIGRVLDNVFVRGGYGYTDAKVKEDKQNPEREGNYLANTSKNTGNLFVRYLPTEQWYTEVGVTYVGSYYPNINNQVKMEGFNRVDAAIGYSADPWNVTLAVNNLTNKEYWRSDSMPGTPRNVLLRLNYQF

SEQ ID NO: 13630 - protein, 1061 aa, Astrakhan rickettsia
ITLQAGGSLDANNIDFGAGSTLEFNGPLDGGGNAIPYYFKGAIANGNNAILNVNTKLLTAYHLTIGTVAKINIGAGNFFAIDASAGDVTILNNAQDIHFRALDSALVLSNLTGAGVNNILLAADLVAPGADEGTVVFDGGVNGLNIGSNVAGTARNIGDGGGNKFNTLLIYNAVTITDDVNLEGIQNVLINNNANFTSSTAFDAGAIQINNATYTIDANNGNLNIPAGNIKFAHANAQLILQNSSGNDRTITLGANIDPDNDDEGIVVLNSVAAGKKLTIAGGKTFGGAHKLKTIFFKGAGDFGTAGTTFNTTNMVLDITGQLELGATTANVVLLKDAVQLTQTGNIGGVLDFNAKNGTVTLNNNVNVAGTVKNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTAILGGTTSFAHTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAETAGGLKPTPKENVKITINNDNRFVNFTFDASTLTLFAEDIAADVIDEDFAPGGPLANIPNAANIKKSLELMEDAPNGSDARQAFNNFGLMTPLQEADATTHLMQDVVKPSDTIAAVNNQVVASNISSNITALNARMDKVQAGNKGPVSSGDEDMDAKFGAWISPFVGNATQKMCNSISGYKSDTTGGTIGFDGFVSDDLVLGLAYTRADTDIKLKNNKTGDKNKVESNIYSLYGLYSVPYENLFVEAIASYSDNKIRSKSRRVIATTLETVGYQTANGKYKSESYTGQLMVGYTYMMSENINLTPLAGLRYSTIKDKSYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYGINYDTNIGSKYFAQQ

SEQ ID NO: 13631 - protein, 734 aa, Bordetella bronchiseptica
MKPLPLAYLAVLLPWYAGVIQAQAAPAAGGDASITLDAVRVEASADASAGGLAPAFAGGQVATGAKVGILGTRDNLETPFSITAYTNELIQDRQAKGVGDVLQNDPGVRVARGFGNFQESYFIRGFILSSDDIAYNGLYGLLPRQYISTQLFERVEVLRGASAFLTGAPPSGGGIGGVINLVPKRAPNEPLTRFSAGYGSDSMLEASADIGRRFGPDDSVGIRINAAQRGGETAIDGERTRTTVFALGLDWRGERARLSADIGYQDNRLKRARPNVTLAGDAAKVPGAPDAGSNYAQPWSYSNERDVFGTLRGEYDFNDRITGWAAYGMRQSKEENSLANLNGVNGAGQGKFYRFDNAREDTVNTGEIGLRAKARTGPVGHELVASASYFDLEKKNAYVMDFFNQFDTSIYDPVSYAKPAISSTAFRGNDMDDPAKQGVIRLASYALGDTMSFFDDKVLLTAGIRHQRLYQRDYSYDTGIGGTPYEQSHNSPAAGLVVRVTPQVSLYANYIEALSAGDTAPQTANGLPVVNHGESLAPYVSKQKEVGVKFEHDGLGGGLALFSTDKPRGFVGDDQVFRASGKDRHRGVELTTYGELTRSVRVLGGLTWLDAKQLSTGNAATDGKRVIGVPRFQANLGVEWDIPGVQGLTVDGRVVYTGSSYADAANTLEVPGWTRLDAGLRYMTDIGGHLVTWRARVENIANRDYWSSVGGYPGNGYLVLGGPRTFTLSASMEF

SEQ ID NO: 13632 - protein, 797 aa, Bordetella bronchiseptica
MPRPTFRPGLLALAIALAVPAPFLHAAPAEQASVRDYRIAAGPLAGTLNRIAAQAGLVLTLDPALAEGRSAHAVQGRFDAPGALREALKGSGLELVENAGGTYSLRKVPEDTLSLQAMTVSGAEEDPLGPTSGYVAKRSMTGTKTDTPILETPRSISVATRQQMTDRAVHNLDDAVRYMPGVVASSFGSDTRSDWLKVRGFKPTQFLDGLPMAVGVYNNPKLETWNLERVALLRGPASSVYGQTPPGGMLDMVSLRPQNVTSHEVKAEVGNYNHKQVSFDSTGPLDDEGRFLYRISGVVRDSNTQVDHIDDKRYNIAPSLTWNIDDDTRLTFLGQFNRDDTGITSQFLPLRGTKYDAPFGKVSHHKNLGDPDWEYYDRTYYWLGYAFERRINDVWQFRQNLRYLRNDLSFQAVTAGTAHADGTLERSTTSVDEDVSQFVVDNNFQADFETGALRHTLLLGLDHNRTDNQYTSIFGSAPPSNVNNPIYGQPIVKPDRSTAFYDYKQKTYQTGLYVQDQIALDNWRLTLGGREDWVHTGATFYNKGDATNTSRDKKFSGNAALSYIFDNGVAPYISYAESFQPTTGADMNSTSSLKPTEGKQWEIGVKYQPVGSDSLFTAAVYDLRQENVSVSQNIGGTPVTSQTGEVKVSGIELEATSNVTDNLKLIGAYSYADTEVKKGQYAGNRLQQAPRNQASLWADYTWHEGALNGFSVGAGARYVGSTYGDQANTYDGYAGSYTLYDAAVRYDLGQLNGSLKGVSVAVNANNLFNKDYLASCDGYYCYYGDQRSVVGSVSYKW

SEQ ID NO: 13633 - protein, 692 aa, Klebsiella granulomatis
  misc_feature (9)..(9): Xaa can be any naturally occurring amino acid
LTLAVSAAXTTTAFAAVSQPKVVLAGDTVVSDRQGAKIKTNVVTLREKDESTATDLRSLLQDEPAIGFGGGNGTSQFVSIRGMGHNAIDLKIDNAYQDGQLHYHQGRFMLDPEMVKVVSVQKGAGFASAGIGATNGAIVTKTLDANDLLANSSNPNFGAKVKASYSSNKGHGYGASAFGKTDNFDFVVSANVVNDSNYKDGSGREIEYSALDKKSYLAKAGVNLGDHRLSLSHLQESHKGVRPVREEFVNFDLKRQAPHQRDTYQKLTNLEWTGENLGFANEAVANVYRLEHGRDSQSDLGNTYATNDSPEAKDDKLADTPSNMHVVATGANLNFDTEFNHSLLKGFGVDHTLLKYGINYRHQEAVPPRSLKPGVVHQEKTDAGIYLEAVNQINDFTINTGVRVDRFDFKAMDGKKVGKTDINPSFGVIYDVNPNLSVSGNLIYATRSPRFADAILSRGYRGGVISIDDNAKAEKARNTEIGFNYNNGPYTAFGSYFWQRVDNARATADIVRHGTTDANGKPIKVPTLGNQGHQTNHGYELGVGYTEGAWRARAGVAHSKPTMHNVKFGGNPEYAVRTGRTWTADVAYRLPNPSVELGVRHTLVEGVDAKDTSIISGKLSTSRDGKTIYNREGYNVGDIYANWKPYGNDKVNVNFAVNNVFNKNYRPHTQNASDTTLPGAGRDFRVGVNFTY

SEQ ID NO: 13634 - protein, 154 aa, Eikenella corrodens
EVDGVTGAKKKNADTNVTTDLYKASFMAGGSAFGYKMDDIRVDIEGLYSQLSRDTFETAPAPAIADNLNALSGLVNVYYDVVIEDMPVIPYVGIGVGAAYLSNPLAIKVTGDKEYGFGFAYQAKAGVSYDVTPEVKLFAGARYFGSYGAKFDKP

SEQ ID NO: 13635 - protein, 656 aa, Escherichia coli
  misc_feature (87)..(87): Xaa can be any naturally occurring amino acid
MRLKKHYLCTALSLAFTQQAVAAQESDSLTVWSSPVSSTTTTVLDQPTMKALDKQNVAQALSVVPGVVLQKSGSRNEEQVKVRGFDXRQVPVYFDGVPIYVPYDGNLDLARILTNNLGAVEVSKGYSSLLQGPNQMGGAINITTQKPTKPLEASLGYRQGWSRSQDNAYDMHASFAASSELGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLTFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFVEEGRNFWAGVEYTF

SEQ ID NO: 13636 - protein, 1060 aa, Israeli tick typhus rickettsia
ITLQAGGSLAANNIDFGVGSTLEFNGPLDGGGNTIPYYFKGAIANGNNAILNVNTKSLTAYHSTIGTVAEINIGAGNLFAIDASAGDVTILNAQDINFGAPDSTLALSNLTGVGVKNILLAADLVAPGANEGDVVFDGGVNGLNIGSNVAGTARNIGDGGGNKFNTLLIYNAVTITDDVNLEGIQNVLINNNADFTSSTAFNAGAIQINDATYTIDANNGNLNVPAGNIQFAHADAKLILQNSSGNDRTITLGANIDPDNDYEGIVTLNSVTAGKKLTIAGGKTLGGAHKLQAIVFKGAGDFSAAGTTFNTTNVVLDTTGQLELGATTANVVLLNDAVQLTQTGNIGGFLDFNAKNGTVTLNNNVNVAGAVQNTGGTNSGTLIVLGASNLNSVNGIAMLKVGAGNVTIAKGGDVKIGEIQGTGTNTLTLPANFNLTGSINKTGGQALKLNFTNGGSVSGVVGTAANSVGDITTAGATSFVSSVNAKGTATLGGTTSFADTFTNTGAVTLAKGSITNFAKNVTATSFVANSATINFGNSLAFNSNITGSGTTLTLGANQVKYTGTGSFTDMLTLNTTFDGAAKSGGNILIKSGNTLDLSGVSTLALVVTATNFDINNISPDTKYTVISAETAGGLKPTTEENVKITINNDNRFVDFTFDASTLTLFAEDIATDVIDEDFEPGGPLANIPNAANIKKSLELMEDAPNGSDARQAFNNFGLMTPLQEADATTHLMQDVVKPSDTIAAVNNQVVASNISSNITALNARMDKVQAANKGPVSSGDEDMDAKFGAWISPFVGNATQKMCNNISGYKSDTTGGTIGFDGLVSDDLVLGLAYTRADTDIKLKNNKTGDKNKVESNIYSLYGLYNVPYENLFVEAIAFYSDNKIRSKSRRVIATALETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVPAIDARLQGMTAPLPTNSFKQSKTSFDVGVGVTAKHKMMEYGINYDTNIGSKYFAQQ

SEQ ID NO: 13637 - protein, 111 aa, Klebsiella pneumoniae
LVDGLDLTLQYQGKNEGCEAKKQNGDGVGTSLSYDFGGSDFAVSAAYTSSDRTNDQNLLARGQGSKAEAWATGLKYDANNIYLATMYSETRKMTPISGGFANKAQNFEAVA

SEQ ID NO: 13638 - protein, 759 aa, Moraxella catarrhalis
MNKFQLLPLTLAVSAAFTTTAFAAVSQPKVVLAGDTVVSDRQGAKIKTNVVTLREKDESTATDLRGLLQDEPAIGFGGGNGTSQFISIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTLDIEKNKKKRTEAELQAELDDKYAGKGYKLGSKTPDGKKYNVVDANGKLVDNLVGNNPTQRETYQKLTNLEWTAKNLGFANEVTANVYKLEHGRNSSSDKGNSYILRDVPNTINDNGDSPSNMHVSAKGANINFDKEFNHGLLKGFGVDHTLLKYGINYRHQEAVPPRGIRPGFQHQEKTDAGIYLEAVNQINDFTINTGVRVDRFDFKAMDGKKVGKTDINPSFGVIYDVNPNLSVSGNLIYATRSPRFADAILSRGFRDGVVSIADNAKAEKARNTEIGFNYNNGPYTAFGSYFWQRVDNARATADAVQHPTVTTAKITYLGNQGHQTNHGYELGVGYTEGAWRARAGVAHSKPTMHNVKFKANPEYAVRTGRTWTADVAYRLPNPSVELGVRHTLVEGVDAKDTSILSGKFDDKDGAILNREGYNVSDIYANWKPYGNDKVNVNFAVNNVFNKNYRPHTQRASIDTLPGAGRDFRVGVNFTY

SEQ ID NO: 13639 - protein, 758 aa, Moraxella catarrhalis
MNKFQLLPLTLAVSAAFTTTAFAAVSQPKVVLAGDTVVSDRQGAKIKTNVVTLREKDESTATDLRGLLQDEPAIGFGGGNGTSQFISIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTLDIKKDDKTLTETELQAELDNKYAGKGYKLGSKTPDGKKYNVVDANGKLVADLDRNNPTQRETYQKLTNLEWTGKNLGFANEVTANVYKLEHGRNSSSDQGNTYITKDVPKEIIDNVDTPSNMHVVATGANINFDKEFNHSPLKGFGVDHTLLKYGINYRHQKAVPPRSLKPGVVHQEKTDAGIYLEAVNQINDFTINTGVRVDRFDFKAMDGKKVGKTDINPSFGVIYDVNPNLSVSGNLIYATRSPRFADAILSRGYRGGVISIDDNAKAEKARNTEIGFNYNNGPYTAFGSYFWQRVDNARATADITRHGTTDANGKPIKVPTLGNQGHQTNQGYELGVGYTEGAWRARAGVAHSKPTMHNVKFSGNPEYAVRTGRTWTADVAYRLPNPSVELGVRHTLVEGVDAKDTSIISGEVSKLNREGYNVSDIYANWKPYGNDKVNVNFAVNNVFNKNYRPHTQRASIDTLPGAGRDFRVGVNFTY

SEQ ID NO: 13640 - protein, 174 aa, Neisseria gonorrhoeae
MKKALAALIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSTGLGVLAGVSYAVTPNVDLDAGYRYNYIGKVNTVKNVRSGELSAGMRVKF

SEQ ID NO: 13641 - protein, 346 aa, Neisseria gonorrhoeae
MKKSLIALTLAALPVAATADVTLYGAIKAGVQTYRSVEHREGKVVGVGTGSEISDFGSKIGFKGQENLGNGLKAVWQLEQGASVAGTNTGWGNKQSFVGLKGGFGTIRAGSLNSPLKNTDDNVNAWESGKFTGNVLEISGMAKREHRYLSVRYDSPEFAGFSGSVQYAPKDNSGSNGESYHVGLNYQNSGFFAQYAGLFQRYGEGTKKMEGYLYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 13642 - protein, 348 aa, Neisseria gonorrhoeae
MKKSLIALTLAALPVAATADVTLYGAIKAGVQTYRSVEHREGKVVSVETGSEIADFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQSYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 13643 - protein, 348 aa, Neisseria gonorrhoeae
MKKSLIALTLAALPVAATADVTLYGAIKAGVQTYRSVGHREGKVVSVETGSEISDFGSKIGFKGQEDLGNGLKAVWQLEQGASVAGTNTGWGNKQSFIGLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLLVEKLQVHRLVGGYDNNALYASVAAQQQDAKLYGTWHANSHNSQTEVAATAAYRFGNLTPRVSYAHGFKGSVRSANYDNTYDQVVVGAEYDFSKRTSALVSAGWLQEGKGADKIVSTASAVVLRHKF

SEQ ID NO: 13644 - protein, 348 aa, Neisseria gonorrhoeae
MKKSLIALTLAALPVAATADVTLYGAIKAGVQTYRSVGHREGKVVSVETGSEISDFGSKIGFKGQEDLGNGLKAVWQLEQGASVAGTNTGWGNKQSFIGLKGGFGTIRVGSLNSPLKNTGANVNAWESGKYTGKFLEISKMAEREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWHANSHNSQTEVAATAAYRFGNLTPRVSYAHGFKGSVRSADYDNTYDQVVVGAEYDFSKRTSALVSAGWLQEGKGADKIVSTASAVVLRHKF

SEQ ID NO: 13645 - protein, 339 aa, Neisseria gonorrhoeae
MKKSLIALTLAALPVAATADVTLYGAIKAGVQTYRSVEHREGKVVGVGTGSEISDFGSKIGFKGQEDLGNGLKAVWQLEQGASVAGANSGWGNKQSFVGLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKIEYVFVEKLQVHRLVGGYDNNALYVSVAAQQQDAKLYETRRANSHNSQTEVAATAAYRFGNVTPRVSYAHGFKGTVDNADHDNTYDQVVVGAEYDFSKRTSALVSAGWLQEGKGADKIVSTASAVVLRHKF

SEQ ID NO: 13646 - protein, 348 aa, Neisseria gonorrhoeae
MKKSLIALTLAALPVAATADVTLYGAIKAGVQTYRSVEHREGKVIGVGTGSEISDFGSKIGFKGQENLGNGLKAVWQLEQGASVAGTNSGWGNKQSFVGLKGGFGTIRVGSLNSPLKNTGSKVNAWESGKFTGNVLEISGMAEREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGSVDSADYDHAYDQVVVGAEYDFSKRTSALVSAGWLQEGKGADKIVSTASAVVLRHKF

SEQ ID NO: 13647 - protein, 348 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 13648 - protein, 348 aa, Neisseria gonorrhoeae
MKKSLIALTLAALPVAATADVTLYGAIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQNYSIPSLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 13649 - protein, 348 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSRHYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 13650 - protein, 175 aa, Neisseria meningitidis
MKKALAALIALALPAAALAEGASGFYVQADAAHAKASSSLGSAKGFSPRISAGYRINDLRFAVDYTRYKNYKQAPSTDFKLYSIGASVIYDFDTQSPVKPYFGARLSLNRASAHLGGSDSFSKTSAGLGVLAGVSYAVTPNVDLDAGYRYNYVGKVNNVKNVRSGELSAGVRVKF

SEQ ID NO: 13651 - protein, 181 aa, Paracoccus denitrificans
MKKALIASAVAVGLSVFAFAANAGEHTISGGYAQSHVKVDGEKLDENPKGFNLKYRYELDNNFGVIGSFTLTHQGYDYYYGSSKIGTGDLDYYSLMAGPTYRFNEYVSVYGLVGAAHRKVKGEFSAYGYDFEYKESKTSAAYGLGLQFNPMPNWVIDASYEYSKLGDFKVGTWVIGAGYRF

SEQ ID NO: 13652 - protein, 646 aa, Porphyromonas gingivalis
MKSVVTKQALIGLLFFSISIYSHAANPPAQPTDTIVSGNIALEDIVVTGSRTARLLKDVPVPTKVFKAKDIKAIAPSSFIDVLQYILPGIEFTKHGSRDQLNAQGFDESSILFLVDGELISTGSTSGIDFERINPDDIERIEVLRGASSALYGSNAIGGVINIITRTAKDPFRVSASARYDSRDGQKYDVAAGVKRGIFTSQSGVQYRADKSYILADQFEQELNVAGNTTWNINQKFTISPTENLSFNLTGLVNLRKQHWTDKIDFLYNSYDVKAGANWRISETSDLDVSYHYDKYSRDTCLIKTENQKKLPIFDEDMHHLRAQYNLNLAEVHLLNVGLEYIHDNVASPRLSSPNDPGEKSVNNKILYGQYIYKVTPKLVLSYGGRLDKHSGFGLYYTSRLSAMYKCSHVTNRLSYAEGYRAPSLQEMYFFFNHGAFFIYGNPDLKPEKSRMLSYSAEAHWNKLTLMGNVFFNHVRNRIDFTYKGTDLIYTNVSKEMRIFGFEGQANVVLPYGFGFRASYSYTYDRWKATDKAGTEMKLSNTRPHAATATLSYGHNFSKNYRLASNFSTRFLSDLKTGRMNSDELFEEITYPGYTICRLDIENHFYRNYTLHIGAENLFDYKPKALAFNSPTSPGRIIYGLVRITF

SEQ ID NO: 13653 - protein, 2021 aa, Rickettsia africae
MANISPKLFQKAIQQGLKAALFTTSTAAIMLSSSGALGIAVSGVIATNNNAAFSDNVGNNWNEITAAGVANGTPARGPQNNWAFTYGGDYTITADVADHIITAINVADTTPIGLNIAQNTVVGSIVTGGNLLPVTITAGKSLTLNGNNADAANHGFGAPADNYTGLGNIALGGANAALIIQSAAPAKITLAGNINGGGIITVKTDAAINGTIGNTNALATVNVGAGIATLEGAIIKATTTKLTNAASVLTLTNVNAVLTGAIDNTTGVDNVGVLNLNGALSQVTGNIGNTNALATISVGAGKATLGGAVIKATTTKLTDNASAVTFTNPVVVTGAIDNTGNANNGIVTFTGDSTVTGNIGNTNALATISVGAGKATLGGAIIKATTTKLTDNASAVTFTNPVVVTGAIDNTGNANNGIVTFTGDSTVTGNIGNTNALATISVGAGKATLGGAIIKATTTKLTDNASAVTFTNPVVVTGAIDNTGNANNGIVTFTGDSTVTGNIGNTNALATISVGAGKATLGGAIIKATTTKLTDNASAVTFTNPVVVTGAIDNTGNANNGIVTFTGDSTVTGNIGNTNALATISVGAGKATLGGAIIKATTTKLTDNASAVTFTNPVVVTGAIDNTGNANNGIVTFTGNSTVTGNIGNTNALATVNVGAGIATLEGAVIKATTTKLTNAASVLTLTNVNAVLTGAIDNTTGVDNVGVLNLNGALSQVTGNIGNTNALATISVGAGKATLGGAVIKATTTKLTDNASAVTFTNPVVVTGAIDNTGNANNGIATFTGDSTVTGNIGNTNALATVNVGAGLLRVQGGVVKSNTINLTDNASAVTFTNPVVVTGAIDNTGNANNGIVTFTGDSTVTGNIGNTNALATISVGAGKATLGGAIIKATTTKLTDNASAVTFTNPVVVTGAIDNTGNANNGIVTFTGDSTVTGNIGNTNALATVNVGAGVTLQAGGSLDANNIDFGARSTLEFNGPLDGGGNAIPYYFKGAIANGNNAILNVNTKLLTAYHLTIGTVAEINIGAGNLFAIDASAGDVTILNAQDIHFRALDSALVLSNLTGVGVNNILLAADLVAPGVDEGTVVFDGGVNGLNIGSNVAGAARNIGDVGGNKFNTLLIYNAVTITDDVNLEGIQNVLINNNADFTSSTAFNAGTIQINDATYTIDANNGNLNIPAGNIKFAHADAQLILQNSSGNDRTITLGANIDPDNDDEGIVILNSVTAGKKLTIAGGKTFGGAHKLQDIVFKGEGDFGTAGTTFNTTNIVLDITGQLELGATTANVVLFKDAVQLTQTGNIGGFLDFNAKNGTVTLNNNVNVAGTVKNTGGTNNGTLIVLGASNLNRVNGIAMLKVGAGNVTIAKGGNVKIGEIQGTGTNTLTLPAHFKLTGSINKTGGQALKLNFMNGGSVSGVVGTAANSVGDITTAGATSFASSVNAKGTATLGGTTSFAHTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSNLALVVTATNFDMNNISPDTKYTVISAETAGGLKPTPKENVKITINNDNRFVDFTFDASTLTLFAEDIAAGVIDEDFAPGGPLANIPNAANIKKSLELMEDAPNGSDARQAFNNFGLMTPLQEADATTHLMQDVVKPSDTIAAVNNQVVASNISSNITALNARMDKVQAGNKGPVSSGDEDMDAKFGAWISPFVGNATQKMCNSISGYKSDTTGGTIGFDGFVSDDLVLGLAYTRADTDIKLKNNKTGDKNKVESNIYSLYGLYSVPYENLFVEAIASYSDNKIRSKSRRVIATTLETVGYQTANGKYKSESYTGQLMAGYTYMMSENINLTPLAGLRYSTIKDKSYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYGINYDTNIGSKYFAQQGSVKVRVNF

SEQ ID NO: 13654 - protein, 1059 aa, Rickettsia aeschlimannii
ITLQAGGSLAANNIDFGVGSTLEFNGPLDGGGDIIHYHFKGAIANGNNATLNVNTKSLTAYHSTIGPVAEINIGADSFFTIDASAGDVTILNAQDINFRAQNSTLMLYNLTGVGVKNILLAADLVAPGADEGCVVFNGGMNGLNIGSNVAGTARNIGDGGGDKFNNLFIYNVVKVTDDVNLEGIKNVFIGNDADFTSSTACNAGTIQINNATYAIDANNGNLNVPAGNIQFVHAGAQLVLQNSSENDRTIIGANIDPDNDGDGIVILNSVTAGKKLTIAGGKTFGGAHKLQAIVFKGAGNFGVAGTTFNATDIVLDITSQLELGATTANVVLLNDAVQLTQTGDIGGFLDFNARNGTVTLNNNVNVVRAVQNTGGTNNGTLIVLGASNLNSVNGIAMLKVGAGNVTIAKGGDVKIGEIQGTGTNTLTLPANFNLIGSINKTGGQALKLNFTNGGSVSGVVGTAANSVGDITTAGATSFASSVNAKGTVTLGGTTSFADTFTNTGAVTLAKGSITNFAKNVTATSFVANSATINFGNSLAFNSNITGSGTTLTLGANQVTYTGTGSFTDTLTLNTTFDRAAKSGGNILIKSGSTLDLSGVSTLALVVTATNFDINNISPDTKYTVISAETAGGLKPTSKENVKITINNDNRFVDFTFDASTLTLFAEDIAADVIDEDFEPGGPLANIPNAANIKKSLKLMEDAPNGSDARQAFNNFGLMTPLQEADATTHLMQDVVKPSDTIAAVNNQVVASNISSNITALNARMDEVQAVNKGPVSSGDEDMDVKFGAWISPFVGNATQKMCNNISGYKSDTTGGTIGFDGLVSDDLALGLAYTRADTDIKLKNNKMGDKNKVESNIYSLYGLYSVPYENLFVEAIASYSDNKIRSKSRRVIATALETVGYQTANGKYKSEGYTGQLMAGYTYMMPENINLTPLAGLRYSTIKDKGYKETGTTYQNLTVKGKNYNTFDGLLGARVSSNINVNEIVLTPELYAMVDYAFKNKVSAIDARLQGMAAPLPTNSFKQSKTSFDIGVGVTAKHKMMEYGINYDTNIGSKYFAQQ

SEQ ID NO: 13655 - protein, 114 aa, Rickettsia japonica
VTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADAVKDQKGFGFAYQAKAG

SEQ ID NO: 13656 - protein, 119 aa, Rickettsia mongolotimonae
ISKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSY

SEQ ID NO: 13657 - protein, 1060 aa, Rickettsia montana
ITLQAGGSLAANNIDFGARSTLEFNGPLDGGGKAIPYYFKGAIANGNNAILNVNTKLLTASHLTIGTVAEINIGAGNLFTIDASVGDVTILNAQNINFRARDSVLVLSNLTGVGVNNILLAADLVAPGADEGTVVFNGGVNGLNIGSNVAGTARNIGDGGGNKFNTLLIYNAVTITDDVNLEGIQNVLINNNADFTSSTAFNAGAIQINDATYTIDANNGNLNIPAGNIQFAHADAQLVLQNSSGNDRTITLGANIDPDNDDEGIVILNSVTAGKKLTIAGGKTFGGAHKLQTILFKGAGDCSTAGTTFNTTNIVLDITGQLELGATTANVVLFNDAVQLTQTGNIGGFLDFNAKNGMVTLNNNVNVAGAVQNTGGTNNGTLIVLGASNLNRVNGIAMLKVGAGNVTIAKGGKVKIGEIQGTGTNTLTLPAHFNLTGSINKTGGQALKLNFMNGGSVSGVVGTAANSVGDITTAGATSFASSVNAKGTATLGGTTSFANTFTNTGAVTLAKGSITSFAKNVTATSFVANSATINFSNSLAFNSNITGGGTTLTLGANQVTYTGTGSFTDTLTLNTTFDGAAKSGGNILIKSGSTLDLSGVSTLALVVTATNFDMNNISPDTKYTVISAETAGGLKPTSKENVKITINNDNRFVDFTFDASTLTLFAEDIAADVIDGDFAPGGPLANIPNAANIKKSLELMEDAPNGSDARQAFNNFGLMTPLQEADATTHLIQDVVKPSDTIAAVNNQVVASNISSNITALNARMDKVQSGNKGPVSSGDEDMDAKFGPWISPFVGNATQKMCNSISGYKSDTTGGTIGFDGFVSDDLALGLAYTRADTDIKLKNNKTGDKNKVESNIYSLYGLYNVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYRINYDTNIGSKYFAQQ

SEQ ID NO: 13658 - protein, 1060 aa, Rickettsia parkeri
ITLHAGGSLDANNIDFGARSTLEFNGPLDGGGNAIHYYFKGAIANGNNAILNVNTKLLTAYHSTIGTVAEINIGAGNLFAIDSSAGDVTILNAQDIHFRALDSGLVLSNLTGVRVHNILLAADLVAPGANEGTVVFDGGVNGLNIGSNVAGTARNIGDGGGNKFNTLLIYNTVTITDDVNLEGIQNVLINNKANFTSSTAFNAGAIQINDATYTIDANNGNLNIPAGNIQFAHADAQLILQNSSGNDRTITLGANIDPDNDDEGIVILNSVTAGKKLTIAGGKTFGGAHKLQTIVFKGAGDCGTAGTTFNTTDIELDITGQLELGATTANVVLFKDAVQLTQTGNIGGFLDFNAKNGTVTLNNNVNVAGIVKNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTATLGGTTSFAHTFTNIGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAETAGGLKPTPKENVKITINNDNRFVDFTFDASTLTLFAKDIAADVIDKDFAPGGPLANIPNAANIKKSLELMEDAPNGSDARQAFNNFGLMTPLQEADATTHLMQDVVKPSDTIAAVNNQVVASNISSNITALNARMDKVQVGNKGPVSSGDEDMDAKFGGWISPFVGNATQKMCNSISGYKSDTTGGTIGFDGFVSDDLVLGLAYTRADTDIKLKNNKTGDKNKVESNIYSLYGLYSVPYENLFVEVIASYSDNKIRSKSRRVIATTLETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYALKNKVSAIDARLQGMTAPLPTNSFKQSKTSFDVGVGVTAKHKMMEYGINYDTNIGSKYFAQQ

SEQ ID NO: 13659 - protein, 1062 aa, Rickettsia rhipicephali
ITLQAGGSLAANNIDFGVGSTLEFNGPLDGGGNTIPYYFKGAIANGNNAILNVNTKSLTAYHSTIGTVAEINIGAGNLFAIDASADDVTILNAQAINFGAPDSALTLSNLTGVGVKNILLAADLVAPGANGGDVVFNGGVNGLNIGSNVAGTARNIGDGGGAKFNTLLIYNAVTITDDVNLEGIQNVHINNNAAFTSSTAFNAGAIQINDATYTIDANNGNLNVPAGNIQFAHANAQLILQNTSGNDRTITLGANIDPDNDDEGIVTLNSVTAGKKLTIAGGKTLGGAHKLHTIVFKGAGDFGAAGTTFNTTNIVLDTTGRLELGATTANVVLLNDAIQLTQTGGNIGGFLDFNAKNGTVTLNNNVNVAGAVQNTGGTNNGTLIVLGASNLNSVNGIAMLKVGAGNVTIAKGGDVKIGEIQGTGTNTLTLPANFNLTGSINKTGGQALKLNFTNGGSVSGVVGTAANLVGDITTAGATSFASSVNAKGTATLGGTTSFADTFTNTGAVTLAKGSITNFAKNVTATSFVANSATINFGNSLAFNSNITGSGTTLTLGANQVTYTAGTGSFTDTLALNTTFDGAAKSGGNILIKSGSTLDLSGVSTLALVVTATNFDINNISPDTKYMVISAETVGGLKPTPEENVKITINNDNRFVDFTFDASTLTLFAEDIAADVIDEAFEPGGPLANIPNAANIKKSLELMEDAPNGSDARQAFNNFGLMTPLQEADATTHLMQDVVKPSDTIAAVNNQVVASNISSNITALNARMDKVQAVNKGPVSSGDEDMDAKFGAWINPFVGNATQKMCNNISGYKSDTTGGTIGFDGLVSDDLALGLAYTRADTDIKLKNNKMGDKNKVESNIYSLYGLYNVPYENFFVEAIASYSDNKISSKSRRVIATALETVGYQTANGKYKSESYTGQLMAGYTYMMPENINLTPLAGLRYSTIKDKGYKETGTTYQNLTVKGKNYNTFYGLLGAKVSSNINVNEIVLTPELYVMVDYAFKNKVPAIDARLQGMTAPLPTNSFKQSKTSFDVGVGVTAKHKMMEYGINYDTNIGSKYFAQQ

SEQ ID NO: 13660 - protein, 1060 aa, Rickettsia rickettsii
ITLQAGGSLAANNIDFGAGSTLEFNGPLDGGGNVIPYYFKGAIANGNNAILNVNTKLLMAYHSTIGTVAEINIGAGNLFAIDASAGDVTILNAQDINFRALGSALVLSNLTGVGVNNILLAADLVAPGADEGTVVFNGGVNGLNIGSNVAGTARNIGDGGGNKFNTLLIYNAVTITDDVNLEGIQNVLINDNADFTSSTAFNAGTIQINDATYTIDANNGNLNIPAGNIQFAHADAQLILQNSSGNDRTITLGANIDPDNDDEGIVILNSVTAGKKLTIAGGKTFGGAHKLQTIVFKGAGDCGAAGTTFNTTNIVLDITGQLELGATTANVVLLNDAVQLTQTGNIGGFLDFNAKNGTVTLNNNVNVTGTVQNTGGTKNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTATLGGTTSFANTFTNTGAVTLAKGSIISFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPGTKYTVISAETAGGLKPTPKENVKININNDNRFVDFTFDASTLTLFAEDIAADVIDEDFAPGGPLANIPNAANIKKSLELMEDAPNGSDARQAFNNFGLMTPLQEADATTHLMQDVVKPSDTIAAVNNQVVASNISSNITALNARMGKVQAGNKGPVSSGDEDMDAKFGAWISPFVGNATQKMCNSISGYKSDTTGGTIGFDGFVSDDLALGLAYTRADTDIKLKNNKTGDKNKVESNIYSLYGLYNVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFRNKVSAIDARLQGMTAPLPTNSFKQSKTSFNVGVGVTAKHKMMEYGINYDTNIGSKYFAQQ

SEQ ID NO: 13661 - protein, 1061 aa, Rickettsia sp. Bar29
ITLQAGGSLAANNIDFGVGSTLEFNGPLDGGGNIIPYYFKGAVANGNNAILNVNTKSLTVYHSTIGTVAEINIGAGNLFAIDASAGDVTILNAQDINFGALDSALALSNLTGVGVKNVLLAADLVAPGANEGGVVFDGGVNGLNIGSNVAGTARNIGDGGGNKFNTLLIYNAVTITDDVNLGGIQNVLINNNADFTSSTAFNAGAIQINDATYTIDANNGNLNVPAGNIQFAHADAQLILQNSSGNDRTITLGANIDPDNDDEGIVTLNSVTAGKKLTIAGGKTLGGAHKLQAIVFKGAGDFGAADTTFNTTNIVLDTTGRLELGATTANVVLLNDAVQLTQAGGNIGGFLDFNAKNCTVTLNNNVNVAGAVQNTGGTNNGTLIVLGASNLNSVNGIAMLKVGAGNVTIAKGGDVKISEIQGTGTNTLTLPANFNLTGSINKTGGQALKLNFTNGGSVSGVVGTAANLVGDITTAGATSFASSVNAKGTATLGGTTSFANTFTNTGAVTLAKGSITNFAKNVTATSFVANSATINFGNSLDFNSNITGSGTTLTLGANQVTCTGTSSFTDTLTLNTTFDGAAKSGGNILIKSGSTLDLSGVSTLALVVTATNFDINNISPDTKYTVISAETAGGLKPTPEENVKITINNDNRFVDFTFDASTLTLFAEDIAVDVIDEDFEPGGPLANIPNAGNIKKSLELMENAPNGSDARQAFNNFGLMTPLQEADATTHLMQDVVKPSDTIAAVNNQVVASNISSNITALNARMDKVQAANKGPVSSGDEDMDAKFGAWISPFVGNAMQKMCNNISGYKSDTTGGTIGFDGLVRDDLALGLAYTRADTDIKLKNNKTGDKNKVESNIYSLYGLYNVPYKNLFVEAIASYSDNKISSKSRRVIATALETVGYQTANGKYKSESYIGQLMAGYTYMMPENINLTPLAGLRYSTIKDKGYKETGTTYQNLTVKGKNYNTFDGLLGAKVSSNINVNEIVLTPELYAMVDYAFKNKVPAIDARLQGMTASLPTNSFKQSKTSFNVGVGVTAKHKMMEYGINYDTNIGSKYFAQQ

SEQ ID NO: 13662 - protein, 1057 aa, Rickettsia sp. S
ITLHAGGSLDANNIDFGARSTLEFNGPLDGGGIPYYFKGAIANGNNAILNVNTKLLTAYHLTIGTVAEINIGAGNIFAIDASAGDVTILNAQDIHFRALDSTLVLSNLTGVGVNNILLAADLVAPGAGEGTVIFNGGVNGLHIGSNVAGTARNIGDGGGNKFNALLIYNAVTITDDVNLEGIQNVLINNNADFTSSTAFNAGVIQIQNATYTIDANNGNLNIPAGNIQFAHADAQLILQNSSGNDRTITLGANIDPNNDDQGIVILNSVTAGKKLTIAGGKTFGGAHKLQTIVFKGAGDCGTAGTTFNTKNIVLDITGQLELGATTANVVLFKDAVQLTQTGNIGGFLDFNAKNGTVTLNNNVNVAGTVQNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTAKLGGTTSFAHTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAEAAGGLKPTPKENVKITINNDNRFVDFTFDASTLTLFAKDIAADVIDKDFAPGGPLANIPNAANIKKSLELMEDAPNGSDARQAFNNFGLMTPVQEADATTHLMQDVVKPSDTIAAVNNQVVASNISSNITALNARMDKVQAGNKGPVSSGDEDMDAKFGAWISPFVGNATQKMCNSISGYKSDTTGGTIGFDGFVSDDLVLGLAYTRADTDIKLKNNKTGDKNKVESNIYSLYGLYSVPYENLFVEAIASYSDNKIRSKSRRVIATTLETVGYQTANGKYKSESYTGQLMAGYTYMMPENINLTPLVGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKYKMMEYGINYDTNIGSKCFAQ

SEQ ID NO: 13663 - protein, 1061 aa, Rickettsia slovaca
ITLQAGGSLDANNIDFGAGSTLEFNGPLDGGGNAIPYYFKGAIANGNNAILNVNTKLLTAYHLTIGTVAKINIGAGNFFAIDASAGDVTILNNAQDIHFRALDSALVLSNLTGVGVNNILLAADLVAPGADEGTVVFDGGVNGLNIGSNVAGTARNIGDGGGNKFNTLLIYNAVTITDDVNLEGIQNVLINNNADFTSSTAFNAGAIQINDATYTIDANNGNLNIPAGNIKFAHADAQLILQNSSGNDRTITLGANIDPDNDDEGIVILNSVTAGKKLTIAGGKTFGGAHKLQTIFFKGEGDFGTAGTTFNTTNIVLDITGQLELGATTANVVLLKDAVQLTQTGNIGGFLDFNAKNGTVTLNNNVNVAGTVKNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTAILGGTTSFAHTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAETAGGLKPTPKENVKITINNDNRFVDFTFDASTLTLFAEDIAADVIDEDFAPGGPLANIPNAANIKKSLELMEDAPNGSDARQAFNNFGLMTPLQEADATTHLMQDVVKPSDTIAAVNNQVVASNISSNITALNARMDKVQAGNKGPVSSGDEDMDAKFGAWISPFVGNATQKMCNSISGYKSDTTGGTIGFDGFVSDDLVLGLAYTRADTDIKLKNNKTGDKNKVESNIYSLYGLYSVPYENLFVEAIASYSDNKIRSKSRRVIATTLETVGYQTANGKYKSESYTGQLMAGYTYMMSENINLTPLAGLRYSTIKDKSYKETGTTYQNLTVKGKNYNTFDGLLGAKVSSNINVNEIVLTPELYAMVDYAFKNKVAAIDARLQGMTAPLPTNSFKQSKTSFDVGVGVTAKHKMMEYGINYDTNIGSKYFAQQ

SEQ ID NO: 13664 - protein, 1055 aa, Rickettsia sibirica
ITLHAGGSLDANNIDFGARSTLEFNGGGGIPYYFKGAIANGNNAILNVNTKLLTAYHLTIGTVAEINIGAGNIFAIDASAGDVTILNAQDIHFRALDSTLLLSNLTGVGVNNILLAADLVAPGADEGTVVFNGGVNGLNIGSNVAGTARNIGDGGGNKFNALLIYNAVTITDDVNLEGIQNVLINNNADFTSSTAFNAGAIQIQNATYTIDANNGNLNIPAGNIQFAHADAQLILQNSSGNDRTITLGANIDPDNDDEGIVILNSVTAGKKLTIAGGKTFGGAHKLQTIVFKGAGDCSTAGTTFNTTNIVLDITGQLELGATTANVVLFKDAVQLTQTGNIGGFLDFNAKNGTVTLNNNVNVAGTVQNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTAKLGGTTSFAHTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAETVGGLKPTPKENVKITINNDNRFVDFTFDASTLTLFAKDIAADVIDKDFAPGGPLANIPNAANIKKSLKLMEDAPNGSDARQAFNNFGLMTPLQEADATTHLMQDVVKPSDTIAAVNNQVVASNISSNITALNARMDKVQAGNKGPVSSGDEDMDAKFGAWISPFVGNATQKMCNSISGYKSDTTGGTIGFDGFVSDDLVLGLAYTRADTDIKLKNNKTGDKNKVESNIYSLYGLYSVPYENLFVEAIASYSDNKIRSKSRRVIATTLETVGYQTANGKYKSESYTGQLMAGYTYMMPENINLTPLVGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKYKMMEYGINYDTNIGSKYFAQQ

SEQ ID NO: 13665 - protein, 1058 aa, Rickettsia honei
ITLQAGGSLAANNIDFGAGSTLDFNGPLGGGNAIPYYFKGAIANGNNAILNVNTKLTAYHSTIGTVAEINIGAGNLLEIDASAGDVTILNAQDINFRALDSALVLSNLTGVGVNNILLAADLVAPGADEGTVVFNGGVNGLNIGSNVAGTARNIGDGGGNKFNTLSIYNAVTITDDVNLEGIQNVLINDNADFTSSTAFNAGTIQIKDATYTIDANNGNLNIPAGNIQFAHADAQLILQNSSGNDRTITLGANIDPDNDDEGIVILNSVTAGKKLTIAGGKMFGGAHKLQTIVFKGAGNCGAAGTTFNTTNIVLDITGQLELGATTASVVLFNDAVQLTQTGNIGGFLDFNAKNGTVTLNNNVNVAGTVQNTGGTNNGTLIVLGASNLNRVNGIAMLKVGAGNVTIAKGGNVKIGEIQGTGTNTLTLPAHFNLTGSINKTGGQALKLNFMNSGSVSGVVGTAANSVGDITTAGATSFASSVNAKGTATLGGTTSFANTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAETAGGLKPTPKENVKITINNDNRFVDFTCDASTLTLFAEDIAADVIDEDFAPGGPLANIPNAANIKKSLELMEDAPNGSDARQAFNNFGLMTPLQEADATTHLMQDVVKPSDTIAAVNNQVVASNISSNITALNARMDKVQAGNKGPVSSGDEDMDAKFGAWISPFVSNATQKMCNSISGYKSDTTGGTIGFDGFVSDDLALGLAYTRADTDIKLKNNKTGDKNKVESNIYSVYGLYNVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNNFDGLLGAKVSSNINVNEIVLTPELYAMVDYAFKNKVSAIDARLQGMTAPLPTNSFKQSKTSFDVGVGVTAKHKMMEYGINYDTNIGSKYFAQQ

SEQ ID NO: 13666 - protein, 407 aa, Haemophilus ducreyi
MKKTLVTLAVLSATAVATAAPQADTFYVGAKAGWASFHRGINQFDNKYKNRKHTAVMKEGKLNIRRDSVTYGVFAGYQIFNQNKAGLAAELGYDYYGQLSAKFKHAEKNSIQFPVVSAMKDRATDNNEEYVVRHTAHGVNFSLKPSYELLPDLDAYAKVGIGLARNDYSVKPKKKAVNNKTEKVKNRVYDVKPSLILGAGFEYAIIPELALRVEYQYLNRVGNLGKAIKKAYKTNDMVGKYSPDMHSVSAGLSYRFGQGAQMMMDEPTPVAEPEVVSKNFAFSSDVLFDFAKADLKQEAAQVLDATNAEIVNLGLATPAIQVNGYTDRIGKEEANLKLSQRRAEMVANYLVAKGQNPVSINAVGYGEANPITGNTCDAVKGRKQLIACLAPDRRVEVQVQGTKQITM

SEQ ID NO: 13667 - protein, 301 aa, Haemophilus ducreyi
MKKTLVAVAVTTAAFTAVTAQAADVDTYGNIQLVYADGEDTAELTDNGSTFGFKGEKELKHGLTGFFKYELEADADEKTNDVDVNLDQAYVGLKGDFGKVQIGTYDSIYNNAIQDGINSFEYADLTELTTTDEGDTIAYFSPEVNGFEVQVSAQVKGDAEDEVADDSVEEGTALTAVVKYSAGDLEIAAGYDSLNNELDAEETIGFSAAYNLGVANVMAKYEDNSDEGTNIGFGFNADYTDGLVYGSIQAVEVESGSDYDEYAVGVTYNLDLDGDVYVYVEAGQQGTAEDSFSALGAVYAF

SEQ ID NO: 13668 - protein, 174 aa, Neisseria meningitidis
MKKALATLIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSIGLGVLTGVSYAVTPNVDLDAGYRYNYIGKVNTVKNVRSGELSAGVRVKF

SEQ ID NO: 13669 - protein, 758 aa, Pseudomonas fluorescens
MMRIECKRKLPLLMSLAFLSFGQNISAAPIEEIIVISSKQAAGISTQELAGSVVTFNEAALKQSFTVDLVDIGKMVANAELNNVGTYASYPNFFIRGMGVNGSTRTNDPKVGVFVDGIYVGYNAGALSSTFDLEAVEVLRGPQGTLLGRNVTGGAVLVKSKRPGNEFGFNAEVSVGNYGTTEFNASVEGPLGKNVFGKVAFVKMDRDGYFEDNNGGSIDLNIYPDGMPDTDTGDKVGMDLTIVRPMLRFEFSDNFEATVIAEFLKNDAGSANSQNVAHNCVPIPGVDNRNIVCGEGSQFLAQNRWGYTPPDDKYEINHDLIGYTELETNSIVLDATWDLGHGIVTTIAGYRDVEYNSSTDFDGTPFTIFHFNDNKEEQDQTSIEVRYSSTFSDRFNFVVGVNQFQQNYSIGERRNFFIALNSATYSETEHDTFGIFGEINFNVTDALSLTAGGRWTKEEKSIDIGILGSCELDFSSCTNNASNEKDWSNFSPKVAAQYQFTDDMMAYASWTRGFASGVFNARAATLDAVGPTDPESVDSIEVGFKTSFLDGRGIFNIAYFQADYEDLILFVNNPCDNCGASLINFNAGEAEISGFEAEVQFQPVEGLRLEASVGTVDPEFTSIKYFDANADGVVDSKDNALARTWDFQKVAELSYNVAGTYTMNMAQGGSLMTRAAYSWRDDYMTDLYNKPWLQQKSFGLLDASLTYTSPNQSVRVSVYGKNLTDEEYFDYAADVGTLDSARWGGAPRTYGVRVSYQY

SEQ ID NO: 13670 - protein, 96 aa, Neisseria gonorrhoeae
NGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAAT

SEQ ID NO: 13671 - protein, 1062 aa, Rickettsia massiliae
ITLQAGGSLAANNIDFGVGSTLEFNGPLDGGGNTIPYYFKGAIANGNNAILNVNTKSLTAYHSTIGTVAEINIGAGNFFAIDASADDVTILNAQAINFGVPDSALVLSNLTGVEVKNILLAADLVAPGANGGYVVFNGGVNGLNIGSNVAGTARNIGDGGGDKFNTLLIYNAVTITDDVNLEGIQNVHINNNAAFTSSTAFNAGAIQINDATYTIDANNGNLNVPAGNIQFAHANAQLILQNTSGNDRTITLGANIDPDNDDEGIVTLNSVTAGKKLTIAGGKMLGGAHKLHTIVFKGAGDFGAAGTTFNTTNIVLDTTGRLELGATTANVVLLNDAIQLTQTGGNIGGFLDFNAKNGTVTLNNNVNVAGAVQNTGGTNNGTLIVLGASNLNSVNGIAMLKVGAGNVTIAKGGDVKIGEIQGTGTNTLTLPANFNLTGSINKTGGQALKLNFTNGGSVSGVVGTAANLVGDITTAGATSFVSSVNAKGTATLGGTTSFADTFTNTGAVTLAKGSITNFAKNVTATSFVANSATINFGNSLAFNSNITGSGTTLTLGANQVTYTAGTGSFTDTLTLNTTFDGAAKSGGNILIKSGSTLDLSGVSTLALVVTATNFDINNISPDTKYTVISAETVGGLKPTPEENVKITINNDNHFVDFTFDASTLTLFAEDIAADVIDEAFEPGGPLANIPNAANIKKSLELMENAPNGSDARQAFNNFGLMTPLQEADATTHLMQDVVKPSDTIAAVNNQVVASNISSNITALNARMDKVQAVNKGPVSSGDEDMDAKFGAWISPFVGNATQKMCNNISGYKSDTTGGTIGFDGLVSDDLALGLAYTRADTDIKLKNNKTGDKNKVESNIYSLYGLYNVPYENLFVEAIASYSDNKISSKSRRVIATALETVGYQIANGKYKSESCTGQLMVGYTYMMPENINLTPLAGLRYSTIKDKGYKETGTTYQNLTVKGKNYNTFDGLLGAKVSSNINVNEIVLTPELYAMVDYAFKNKVPAIDARLQGMTAPLPTNSFKQSKTSFDVGVGVTAKHKMMEYGINYDTNIGSKYFAQQ

SEQ ID NO: 13672 - protein, 760 aa, Pseudomonas sp.
MSASKLSEVFDTESSSCYGTPMPILDTPRAVSPISQTLMKTAGLGSWGKLDPLSFTYINPAAMVDPSQTGCASAPDIRGTTGLTFINGMEETVNMPLQDVPWNLNMVESIDLVEGPPGAVYGSTQPSNGYVNYITKQPYFDRFRGDVWDTTGMYDQYMWGADIGGPIKGTQGRLAYRFSYMGIESGSYYELIKDNQQNFYAALGYRPSTDYQADLYLDFGTYSYMLEDVLLNRPTEALIQNGLYYPGFLPPSEVNTGTVNNPPASGYLGTPIPISRRVNVKYPGDLGRAQTAMAQWIQRFQINDHLRVVNNTFFWYQSHVSSEDEFFFNEAWIGNYEIDNRTEVLLNFDTAGPIGPISHSLDTGLDSRYQYVLAYDSFNFVVPNGWSVFENPYLRNALFSQNFQALIGNPSGPGGGEWLVPSGPYPLYFEPLNGATGSNLSRYLRIAPFAQDRLQLSQNLFLILGARMNLYLVSAETPPGTPPLLFESLNTSQLAPLVNISPYWKPYPWMSFYFNFNLQQTTVVAGGGGYSPLFGASAFHLLNELEEIGAKFSLVENKLFFSGDLFSENTYLFNFGLPPTPVNIKGFEMSVQYQPFDRFWLKANTLFMNGVENWSGLPTGPPLAQTYSTATAFLLSLPLDNSGTFPPGKYALIAWPEQIFSGLVSYQFKKGIGISLGALLMSDMYLGYEHQERIPTQFILNGQLFYTAHRWEARLSLFNFTNEHYWLPNGFGFTQVRTLNLDTIFPGWPFWVEGTLLYRF

SEQ ID NO: 13673 - protein, 911 aa, Bordetella bronchiseptica
MNMSLSRIVKAAPLRRTTLAMALGALGAAPAAYADWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIANSGFYLDATLRASRLENDFKVAGSDGYAVKGKYRTHGVGASLEAGRRFAHADGWFLEPQAELAVFRVGGGSYRAANGLRVRDEGGSSVLGRLGLEVGKRIELAGGRQVQPYIKASVLQEFDGAGTVRTNGIAHRTELRGTRAELGLGMAAALGRGHSLYASYEYSKGPKLAMPWTFHAGYRYSW

SEQ ID NO: 13674 - protein, 905 aa, Bordetella parapertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGFGPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 13675 - protein, 915 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGAVPGGFGPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 13676 - protein, 1299 aa, Escherichia coli
MNKIYRTLWNAATQSWVVVSELAKAGGKSASGKSALVNSVSGFSFTLIAASVVLGSGQVNAAEVTGNTGVSGDDKYCFYNASSQSVICGDATTKTTDKTDNKPAKSVVIGFGATNDGETNVAIGAKSKSSKAASIAIGDNAKALDNQAIAIGQNATANSDWDISIGRQAGAEQTEVSAEGRNIAIGDGALKRGKGVNNNIALGTSAGDRLAGTHNVLMGTYVNADEAVRSALTAGSTTKEINAKETTDNKYYIEASNTVALGTRALATQLAAVAIGQQAKAFGNQSVAVGNGTKASGQTAIATGSNAHATGSSSIAIGGTVNGNDTARTLASDNFTIAMGLSAQATKSDAIAVGRNAKAAGINTVSIGYNAGVTKTADEAQSDPNNKLEPATDAVFIGNKAGYKSNQNRMQVSLGKDSGEGVVGTENVTIGNSAGKNTKGNTNVAISSRAGQNVEGHDNFAALIEAGQNIKGSDNIAIGKHAGRSADPNTKLNINNTISLGKESVSLKNFGIAQGNKAKTDGLASIAIGRNAEAVGGETANIAIGDSASADASGAIVLGTKAQAKSLTVDGKKYGAYSAIVIGTEAKAIAQAAPAGKNENPKDAIAIGTKAEAHYASTIALGFGAKSDTKAQAVSIGYNSNAKGYQAIAFGSEAKTTENAGSSIAFGTKAQTRASASIAIGMGAETGFDGGQALDGSDAVALGREAKAKRQNALAFGYKAVADHKDAVALGAGAETAAAEGTNEATVNEFKYSGFAGIKPIATVSVGKKDAERTITNVAAGRIDKTSTDAINGSQLYLALNALGNVGNTLVTNVLGGDAAIVKEGDEAGTLTMSNIGGTGKGTIHDAIEAVNNTAKASKTTVKEGDNITVTEEAAADGSRTYTVATKKDVKFDSVVAGGTKIDANGLTFVDDQGTKIDNTPSISKTGIDAGNQKVTNVQNGNIAKDSKDAVNGGQLFAQGEGVKNIIGGDTTYNPETGEYANTNIGGTGASTIDEAIKAVNTTAKAAKTEVVQGENIVVTSAPGANGNTVYTVATAKEVTFDKTTVGSVVTDKNTNDITGLSNKTLGGDNFAKNGRAASEEQLNATQTNLATLLGGNAQNTNGNVAMTDIGGTGKNNINDAIKASRNEVKQGKNMVVTPTTGANGQTIYEVATADKVAFDEVKVGGITIDATTNKISGIAKGDISENSTDAVNGSQLYELQQKIAKSGDNYNILNNRINKVDKDLRAGIAGANAAAGLPQAYIPGKSMVAVAAGTYKGQNAIALGMSRISDNGKVIIKLTGNTNSRGDFGASIGAGYQW

SEQ ID NO: 13677 - protein, 746 aa, Pseudomonas aeruginosa
MSSRALPAVPFLLLSSCLLANAVHAAGQGDGSVIELGEQTVVATAQEETKQAPGVSIITAEDIAKRPPSNDLSQIIRTMPGVNLTGNSSSGQRGNNRQIDIRGMGPENTLILVDGKPVSSRNSVRYGWRGERDSRGDTNWVPADQVERIEVIRGPAAARYGNGAAGGVVNIITKQAGAETHGNLSVYSNFPQHKAEGASERMSFGLNGPLTENLSYRVYGNIAKTDSDDWDINAGHESNRTGKQAGTLPAGREGVRNKDIDGLLSWRLTPEQTLEFEAGFSRQGNIYTGDTQNTNSNNYVKQMLGHETNRMYRETYSVTHRGEWDFGSSLAYLQYEKTRNSRINEGLAGGTEGIFDPNNAGFYTATLRDLTAHGEVNLPLHLGYEQTLTLGSEWTEQKLDDPSSNTQNTEEGGSIPGLAGKNRSSSSSARIFSLFAEDNIELMPGTMLTPGLRWDHHDIVGDNWSPSLNLSHALTERVTLKAGIARAYKAPNLYQLNPDYLLYSRGQGCYGQSTSCYLRGNDGLKAETSVNKELGIEYSHDGLVAGLTYFRNDYKNKIESGLSPVDHASGGKGDYANAAIYQWENVPKAVVEGLEGTLTLPLADGLKWSNNFTYMLQSKNKETGDVLSVTPRYTLNSMLDWQATDDLSLQATVTWYGKQKPKKYDYHGDRVTGSANDQLSPYAIAGLGGTYRLSKNLSLGAGVDNLFDKRLFRAGNAQGVVGIDGAGAATYNEPGRTFYTSLTASF

SEQ ID NO: 13678 - protein, 351 aa, Citrobacter freundii
MKKSTLALMVMGIVASASVQAAEVYNKDGNKLDIYGKVKAMHYISDNDNKDGDQSYIRFGFKGETQINDQLTGYGRWEAEFAGNKAESDTTQQKTRLAFAGLKYKDLGSFDYGRNLGALYDVEAWTDMFPEFGGDSSAQTDNFMTKRASGLATYRNTDFFGIVDGLNLTLQYQGKNENRDVKKQNGDGFGTSLSYDFGGSDFAISGAYTNSDRTNEQNLQSRGTGKRAEAWATGLKYDANDIYLATFYSETRNMTPISGGFANKTQNFEAVAQYQFDFGLRPSLGYVLSKGKDIEGIGDEDLVNYIDVSATYFFNKNMSAFVDYKINQLDSNNKLNINNDDIVAVGMTYQF

SEQ ID NO: 13679 - protein, 351 aa, Enterobacter cloacae
MKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLESDNKLNINNDDIVAVGMTYQF

SEQ ID NO: 13680 - protein, 312 aa, Klebsiella oxytoca
MKKSSIVATIITILSGSANAASSQLIPNISPDSFTVAASTGMLSGKSHEMLYDAETGRKISQLDWKIKNVAILKGDISWDPYSFLTLNARGWTSLASGSGNMDDYDWMNENQSEWTDHSSHPATNVNHANEYDLNVKGWLLQDENYKAGITAGYQETRFSWTATGGSYSYNNGAYTGNFPKGVRVIGYNQRFSMPYIGLAGQYRINDFELNALFKFSDWVRAHDNDEHYMRDLTFREKTSGSRYYGTVINAGYYVTPNAKVFAEFTYSKYDEGKGGTQTIDKNSGDSVSIGGDAAGISNKNYTVTAGLQYRF

SEQ ID NO: 13681 - protein, 350 aa, Klebsiella pneumoniae
MKKSTLALMMMGFVASTATQAAEVYNKNANKLDVYGKIKAMHYFSDYDSKDGDQTYVRFGIKGETQINDDLTGYGRWESEFSGNKTESDSSQKTRLAFAGVKLKNYGSFDYGRNLGALYDVEAWTDMFPEFGGDSSAQTDNFMTKRASGLATYRNTDFFGLVDGLDMTLQYQGKNEGREAKKQNGDGVGTSLSYDFGGSDFAVSAAYTSSDRTNDQNLLARGQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQLKSDNKLGINDDDIVALGMTYQF

SEQ ID NO: 13682 - protein, 1372 aa, Escherichia coli O6
MNKVYSLKYCPVTGGLIAVSELARRVIKKTCRRLTHILLAGIPAICLCYSQISQAGIVRSDIAYQIYRDFAENKGLFVPGANDIPVYDKDGKLVGRLGKAPMADFSSVSSNGVATLVSPQYIVSVKHNGGYRSVSFGNGKNTYSLVDRNNHPSIDFHAPRLNKLVTEVIPSAVTSEGTKANAYKYTERYTAFYRVGSGTQYTKDKDGNLVKVAGGYAFKTGGTTGVPLISDATIVSNPGQTYNPVNGPLPDYGAPGDSGSPLFAYDKQQKKWVIVAVLRAYAGINGATNWWNVIPTDYLNQVMQDDFDAPVDFVSGLGPLNWTYDKTSGTGTLSQGSKNWTMHGQKDNDLNAGKNLVFSGQNGAIILKDSVTQGAGYLEFKDSYTVSAESGKTWTGAGIITDKGTNVTWKVNGVAGDNLHKLGEGTLTINGTGVNPGGLKTGDGIVVLNQQADTAGNIQAFSSVNLASGRPTVVLGDARQVNPDNISWGYRGGKLDLNGNAVTFTRLQAADYGAVITNNAQQKSQLLLDLKAQDTNVSEPTIGNISPFGGTGTPGNLYSMILNSQTRFYILKSASYGNTLWGNSLNDPAQWEFVGMNKNKAVQTVKDRILAGRAKQPVIFHGQLTGNMDVAIPQVPGGRKVIFDGSVNLPEGTLSQDSGTLIFQGHPVIHASISGSAPVSLNQKDWENRQFTMKTLSLKDADFHLSRNASLNSDIKSDNSHITLGSDRAFVDKNDGTGNYVIPEEGTSVPDTVNDRSQYEGNITLNHNSALDIGSRFTGGIDAYDSAVSITSPDVLLTAPGAFAGSSLTVHDGGHLTALNGLFSDGHIQAGKNGKITLSGTPVKDTANQYAPAVYLTDGYDLTGDNAALEITRGAHASGDIHASAASTVTIGSDTPAELASAETAASAFAGSLLEGYNAAFNGAITGGRADVSMHNALWTLGGDSAIHSLTVRNSRISSEGDRTFRTLTVNKLDATGSDFVLRTDLKNADKINVTEKATGSDNSLNVSFMNNPAQGQALNIPLVTAPAGTSAEMFKAGTRVTGFSRVTPTLHVDTSGGNTKWILDGFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFASLGTKHYNTHSWYAGAETGYRYHLTEDTFIEPQAELVYGAVSGKTFRWKDGDMDLSMKNRDFSPLVGRTGVELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 13683 - protein, 989 aa, Escherichia coli
MNKVYNTVWNESTGTWVVTSELTRKGGLRPRQIKRTVLAGLIAGLLMPSMPALAAAYDNQTIGRGETSKSMHLSAGDTAKNTTINSGGKQYVSSGGSATSTTINIGGVQHVSSGGSATSSTINSGGHQHVSSGGSATNTTVNNGGRQTVFSGGSAMGTIINSGGDQYVISGGSATSASVTSGARQFVSSGGIVKATSVNSGGRQYVRDGGSATDTVLNNTGRQFVSSGGSAAKTTINSGGGMYLYGGSATGTSIYNGGRQYVSSGGSATNTTVYSGGRQHVYIDGNVTETTITSGGMLQVEAGGSASKVIQNSGGAVITNTSAAVSGTNDNGSFSIAGGSAVNMLLENGGYLTVFDGHQASDTMVGSDGTLDVRSGGVLYGTTTLTDKGALVGDVVTNEGNLYYLNNSTATFTGTLTGTGTLTQEGGNTRFSGLLSQDGGIFLQSGGAMTMDALQAKANVTTQSGTTLTLDNGTILTGNVAGDSTGAGDMAVKGASVWHLDGDSTVGALTLDNGTVDFRPSTTTRMTPAFQAVSLALGSLSGSGTFQMNTDIASHTGDMLNVAGNASGNFVLDIKNTGLEPVSAGAPLQVVQTGGGDAAFTLKGGKVDAGTWEYGLSKENTNWYLKADTPPPVTPPTNPDADNPDAGNPDAGNPDAGNPDAGNPDAGKPGTGKPDAGTSSSPVRRTTKSVDAVLGMATAPAYVFNSELDNLRFRHGDVMQNTRAPGGVWGRYTGSDNRISGGASSGYTLTQNGFETGADMVFDLSDSSLAVGTFFSYSDNSIKHARGGKSNVDSSGGGLYATWFDNDGYYVDGVLKYNRFNNELRTWMSDGTAVKGDYSQNGFGGSLEAGRTFSLNENAWAQPYVRTTAFRADKKEIRLNNGMKASIGATKSLQAEAGLKLGMTLDVAGKEVKPYLSAAVSHEFSDNNKVRINDTYDFRNDISGTTGKYGLGVNAQLTPNAGVWAEARYENGKQTESPITGGVGFRINF

SEQ ID NO: 13684 - protein, 1372 aa, Shigella flexneri
MNKVYSLKYCPVTGGLIAVSELARRVIKKTCRRLTHILLAGIPAICLCYSQISQAGIVRSDIAYQIYRDFAENKGLFVPGANDIPVYDKDGKLVGRLGKAPMADFSSVSSNGVATLVSPQYIVSVKHNGGYRSVSFGNGKNTYSLVDRNNHPSIDFHAPRLNKLVTEVIPSAVTSEGTKANAYKYTERYTAFYRVGSGTQYTKDKDGNLVKVAGGYAFKTGGTTGVPLISDATIVSNPGQTYNPVNGPLPDYGAPGDSGSPLFAYDKQQKKWVIVAVLRAYAGINGATNWWNVIPTDYLNQVMQDDFDAPVDFVSGLGPLNWTYDKTSGTGTLSQGSKNWTMHGQKDNDLNAGENLVFSGQNGAIILKDSVTQGAGYLEFKDSYPVSAESGKTWTGAGIITDKGTNVTWKVNGVAGDNLHKLGEGTLTINGTGVNPGGLKTGDGIVVLNQQADTAGNIQAFSSVNLASGRPTVVLGDARQVNPDNISWGYRGGKLDLNGNAVTFTRLQAADYGAVITNNAQQKSQLLLDLKAQDTNVSEPTIGNISPFGGTGTPGNLYSMILNSQTRFYILKSASYGNTLWGNSLNDPAQWEFVGMNKNKAVQTVKDRILAGRAKQPVIFHGQLTGNMDVAIPQVPGGRKVIFDGSVNLPEGTLSQDSGTLIFQGHPVIHASISGSAPVSLNQKDWENRQFTMKTLSLKDADFHLSRNASLNSDIKSDNSHITLGSDRAFVDKNDGTGNYVIPEEGTSVPDTVNDRSQYEGNITLNHNSALDIGSRFTGGIDAYDSAVSITSPDVLLTAPGAFAGSSLTVHDGGHLTALNGLFSDGHIQAGKNGKITLSGTPVKDTANQYAPAVYLTDGYDLTGDNAALEITRGAHASGDIHASAASTVTIGSDTPAELASAETAASAFAGSLLEGYNAAFNGAITGGRADVSMHNALWTLGGDSAIHSLTVRNSRISSEGDRTFRTLTVNKLDATGSDFVLRTDLKNADKINVTEKATGSDNSLNVSFMNNPAQGQALNIPLVTAPAGTSAEMFKAGTRVTGFSRVTPTLHVDTSGGNTKWILDGFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFASLGTKHYNTHSWYAGAETGYRYHLTEDTFIEPQAELVYGAVSGKTFRWKDGDMDLSMKNRDFSPLVGRTGVELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 13685 - protein, 973 aa, Chlamydia pneumoniae
MKSQEVGIKPKVNVVLEGDNQMLDEVMVVAYGTAKKSSFTGSASTISNEKLELRPITNLTKGLEGQATGLLTTSGSGQPGEDASIVIRGYGSINASQDPLYVVDGIPFDGSLSSINPSDIESMTVLKDASAGALYGARGANGVVMITTKQGKEGKAQVTWRSTVGWASRAIQPYDMVDQKEFVQLTYEALRNGYVFNSGYSWEQAQQMARAGLSANLGGELYNPFKNYTWDNLINPETGMVQADAVSAWNERWMDAVQRDNAFRQEHQLSVNGGSEKTKYMFSLGYLNEDGILINTGFQRYNARVNVNSNITDWFKANMNASLSNSVQDYSDYDGSSTSNVWYSAQFVSPLFPVYVKGLDGKNVLGEDGKPQLDYGENGRPGSYTDYNPVGGLTDDKSNKKNDVASLRTGVTFGSDKDNFGVFKGIKLNVNFGLDYRNQSRMSYMNMYHGNQATAGGLLTKYNTRMQSYTFNQLLSWNRSFGLHSFDVLAGHEFYAYSHEYLKAGKTNLVDGILELRPGTTLYAADSYTDKYRIESWLGRFNYNYDEKYYFSASLRTDGSSRFHKDHRWGTFWSIGGNWRISKEAFMEDVKWIDNLSLKLSYGQQGNDNILNSDKTSNYYLWQSLYDLDWPNSNQIGGMVSSLENQVVSWEKNGNLNVGVEATFLGSRLSVNAEYYNRKTVDMLLSYPMATSTGFNGYNANVGDMRNSGFEFEIRGTAIRTDDFVWNISWMGSTVKNKVLKLTNTAPEIIKGVYSIKEGMPINTFYMAKSAGVDPATGAQLYWVYDKDENGNIINERISDDYSKASTSKYYQGNRIPDLYGSIGTDFSYKGFDLSVLTSYSIGGKIYDSLYTGSMNAQYATNTWNKHQLRRWQKPGDITDVPRVEINGAYTTTDRFLINASYFAIKNITLGYSLPKDWMRKAKLGNVRVFGSIDNLALFSHLKGMDPQYNFKGETDYSYTPNKTYSFGVEINF

SEQ ID NO: 13686 - protein, 90 aa, Chlamydia pneumoniae
MKTSDNERIKYEITGQAVLQILRMKINFSLQTLIKQLLVMKSAEEDAFRRDLIDSIIRDFSNSDSGGPNRRTATADNKSMFNGKKINRIH

SEQ ID NO: 13687 - protein, 848 aa, Chlamydia pneumoniae
MKTSIQNIFTILFFLTFSISFAQNIEGIVTTSENVPLEAVNVVVKGTTNSAVTDNSGKFIIDSKGRLPLTLLIQYVGYTTAEIELTAIPANPLQVALKEENELIEVVVSSRRRIEKVQDVPIAISVITGKQAEQTGAFNVNRIKELVPSVQLYSSNPRNTGINIRSLGSPFGLTNDGIDPGVGFYVDGVYYARPAATTLDFIDVEQIEVLRGPQGSLFGKNTTSGAFNITTRKPSFTSGADFEVSYGNYSFLQAKASVTGALGKKVAGRLSFSGTSRDGLVDNIATGRSTNTLNNQGIRGQLLWTPTVNTNVIFAADITTQRPDGYAQVVAGVAPTQRAAYRQFDAIIADLNYQLPSLNAFDRKIDQDTPWRSNQDMGGFSLNVDTKIGGGTLTSTTAWRFWNWDPSNDRDFTGLQVLAKSQNPTRQTQITQEVRYAGQITSKISGVAGVFFIDQTSQTDGTEESGNAQWRFSQSTTSNLWKTPGLFEGYGIKTDARIRASSAAVFGQIDWAITDRLHILPGLRYNFDKKDAHYARTTYGGLQTTDPQLLALKKLVYSDQAFDSSTDNTDFSGNITVTFKASDKINAYGTFAKSYKPVGVNVAGLPTNSAGQPLLDLAVIKPEKVYHYEVGVKTSPFRNSIFNIALFKTDIKDFQTNVQAAELGVNRGYLANADKVRVQGVEVDGSFVISPNLTINGAVTYTDGTYVKFTNAPLPLEETGAPVSFKDVSGTNLPGASRWAGSLGGELSDNARFFGNAGKVFLAVDSYARSEFSSSPSASKYLVVQGYAIFNARLGFRASQGLSVHFWGRNLLNKDYYEQLLPAGGNAGQYAGVLGDQRTYGITLKYSL

SEQ ID NO: 13688 - protein, 822 aa, Chlamydia pneumoniae
MPLRRRRRRPVCAARSIPRPEHAVLKRAYRAYRDSYAFRDKIAIDGFDYPLKSFDPVEELIRRNYRTTISGPCSVAMSAACSPNSGGKTMNKGFFGAASLAAMAVAMPAYAEEASSDERDIVVTAQKREERLIDVPQSVSVVSGEALENIQATNFSDYLKLVPGLQLNQATPGFGRLVLRGVNTGGVASTVAVYQDETTFGSSSGLVNGAILAGDFDTFDIERIEVLRGPQGTIYGSSSMGGVLKYVTNKPDTSAFEVRARGSVETTTGGDESYLGSAVVNLPLGETLALRASGFYRDFGGFIDSIGTGGADIESDINSSKSYGGRASVLFKPSETFSIQLAAYLQNLETDASNSVDSDPSTGRTLYGRLSQSQFVPEFTDVRYRVYSGVVDADLGFANLVSATSYSTLSQSFRGDLTTQFGALIEAVFGTPNDFFQGQLTRVKRFTQEVRLQSPESDRFEWLIGVYYTRERGLIDQDFNAVEPGTLTPIAGLPLLGVATINSRYRELAGFANATIHFGDRFNLSFGGRYSGNKQSAVQVSDGVLAGGPNALPKARSSEDVFTFSVAPQFEVSDNVTIYARVAKGFRPGGPNVLAPGAPPEIATYGSDSLISYELGLKAETVDRTFSIDIAAFHIDWKDIQVFGQVNDFGVNFNGGKAKSDGVEFTTTLRPAQGLSFSLNGAWTNAKLKDDTPPLVGGLSGDRLPYTPEFSIGANADYEWELGGDTTAYVGASVRSLSKQPAGYDLAFRIANGRQRYLPAYEVVDLRAGVDFGRYSIELYAKNLTDSEGKTSLEAPANIPFGAAGTGVIRPRTIGATLTAGF

SEQ ID NO: 13689 - protein, 791 aa, Chlamydia pneumoniae
MRFEKKQCSAILLSLLLRIQNIEGGEMARMRHYFASIIAMSVALHMNAGAAHAQDQVSPQPDEAAARPASADDIVVTALRRAERLQDVPVAVTALSAANLEAKGASDIAAIAPSTPGLSFNGGAVGGSGTSSSAQIFIRGIGHDDYLPTTDPGVGIYIDEIYLGRTTGSILSLTDIERVEVLRGPQGTLFGRNTIGGAILVTTRKPDLSDAYVNLSGNFGERSLVELKGSANAPVTDTLAVKVSAGMRKQDGYGRSTVTPGRFGDTDRWGVTGQVLFQPTPELKFLLSGDYSKIDQPSPTQVVTNIGPAVGLIAAYNGTAAARGLPLFNQALVATDRFTSGSQRRGYDKATVKGISLSGEYEFAKDWAIKSITAYRKSDVAFSADADTTAAPIFDVTTTVNQEQFSQEFQVSGTVGPLSLTAGTYYYDEDIDYSLTADILPGLYGFLVGNGVCPSAAAPCFAATRGFRQPSTLSIKAYAGFGQGTLKFTDWLSATGGIRYSVEKRQFETQSFGTATGALQFAGNQHRRYSQWTPKIGLEVKPTRDVLLYASYSKGYKSGTFNGRATSGPALNEVLPESSDSYEAGIKSQFWDRRITLNLSVYDVTYKNLQTTVTVRDSNGAPATALINAAKAKAKGFEAELTVRPMDGLMLNATWGYIDGKITETTPIAAAQGLLIGNRLTKTPKNKISLAAQYDWELFGSDAFARVDYSWQSSMFHTPLNQVNTFEDSYALTNARIGYTLPNTQVRTSVFVNNVFNKRYALNRSYVAFADYNTANFARPREWGVSLAVDF

SEQ ID NO: 13690 - protein, 415 aa, Chlamydia pneumoniae
MSKTPLARAVALATLGASLTMPSLAHADFIGDSKATLELRNFYMNRDLRETTAAQQSKREEWAQGFILKAESGFTEGTVGFGLDAYAGLGLKLDSSDERAGTNLLPNAFGNEGPDEYSEATGAVKARISKTVAKVGGLMPKLPIVASGDSRLLPQVFTGGMLTSQEIDGLTLNGGQLREVNFRNSTDRQDITATNVGGRSDRYNYAGGDYKFNGGNTTVGLWYGELEDIYDQKLYNLIHVQPIGDWKLGANLAYFDSQDNGRKLGGKLDNDLTSVNLWAGIGAHTFRVGYQKVGGDNAFPFLNETDPYIVNYLQILDFTRKDEKSWQARYDINFASYGIPGLTAFVRYVTGDGFDGVGGVSGKEWERDVDISYIIQEGPLKNLGVRWRNAMVRSNASIGDLDENRLIVSYTIPLM

SEQ ID NO: 13691 - protein, 1178 aa, Chlamydia pneumoniae
MQNNFSIQVLRVVKSFWLTSKKIPRTMRLVILFLFCFVGLTNATDSYAQSAKVTMNVRNQTVEDVLRAIEKQTEFSFFYNNAHINLKRLVTISADRNDIFKVLDEVFKNTNVEYKVIDKKIILSTELASVEQAHQEKVKVSGRVVDAAGEPVIGASVIEKGSANGTITDMDGNFILNVGSKEAILEISYIGYQGQSLKVTPGKTLSVVLKEDTQSLDEVVVVGFGVQKKANLTGAVSQVKMDDVLGSRPVVNAMSALQGAMPGLQITPNNDAAGPGQSKSFNIRGTTSINGGGPLVLIDNVPGDIDMLNPEDIESVSVLKDAASAAIYGARAAFGVILVTTKKAKKGDGFHVNYNNNFGFQSSINRPEQADGLEWMQAYLDGEFNAGKYYTGQDIKTWMNYLTEYRKNPGKFQTTGDGVYVDPETGLNYYLNEKDLYANMLDDYGFLQAHNVSLSGGTDKLAYRLSLGYNSEQGILITDKDRYKRLSGSAYISAEITSWLTQSVDIRYAQSDKNMPVTSDKTGLYDMRLPVVYPEGSLTLPDGTSLMTNTPSNVLRMATDNNTIRDNARILSKTVLKPLKGLEVAFEYTFDKTWSNQNVNKASIDYTTVELAKIQTATTSSLETTHQSTDYNAINLYANYRYSWNDTHNLSLMGGFNQESSDWKKLYTYSYDMINEKYPSHSTATGENKVITDDHRVYTVRGAFYRVNYDYKGKYLFETNGRYDGSSKFPKKNRFGFFPSVSVGWNIARENFMKPVAGDWLSDLKLRGTWGQIGNQGIDPYKFVPTMSQVEKKDVAWLVNGAKPLTLNAPGLVSDSFTWETVETLDFGFDITALNGRLQSTFDWYRRDTKDMLAPGAELPSVVGASAPLQNTADLRTKGWELSLTWRDRIGAWGYNVGFNLYDSKTVVTKYHNESKIILKSDGTNNYYEGYEIGSIWGYVTDGYYTADDFEDTNTWKLKEGVVTVDGVSPRPGDIKYQNLRDDGSSTNRIDTGDGTFDNPGDRKIIGNNSLRLQYGINLGVNYKGFDLSVLLQGVGKRDVWISDARRWPFNSGQFGSLFKDQLDYWKPVDSANGDWTAANPNAEYFRIYGQGNNSSYNTRAQTKYLMNGSYLRVKNVTLSYNFPKSWLAPITLTSLKAFVSCENLHTFTKLMKGYDPERLSWGYPFYRTISFGFNVTL

SEQ ID NO: 13692 - protein, 812 aa, Chlamydia pneumoniae
MKQMRLSAVALGCAVSLSVSAEQHNTSIEQQASAEVERITVYGRQNKVVMNSGLATKSDMSLMETPAAVVVVDEELITTQGATELQELLRNISGVTQAGNNYGIGDNIVIRGLGANYTYDGMYGGAGLGNTFNPTRSLTNVESVEVLKGPATGLYGMGSAGGVINLIEKKPQFNASHQFTAEVGQWDSYSLGLDSTAALTDKAAYRLVAKHARSEGYRDIGTDRDEAYASLKYLLSDQQDIMLSAAYIKDAIAVDSIGHPIRIYNAASVGGKPAGEVSWQDLINDASNAGLQLSDEQRQQLADSLSAGDGLTPYAFGEAGIISPMAKDNEGEELRFKLTHNIFFADNLFLNQQLQYRDYQSGFARQTGAYNYVYWNRNGVINSDPRAPLVVDDRLYPFAARRQEYRQVQADETSWQYFADLRYDFSVAGIDNELLVNANFEDRNIRFKQYSIYDADKVIKNKAGEVIYQGQLPYIFDIRSPNWAEGQFEDYDPLMTSNYNKKVQAWGVGLQHVGYFDFGITTRIGVAFNDISQRYEHYGVDARYSASLAQPTPEADTSDDGMTYNLGITYMPTDDLSFFINHAKGRTAYSVLGSLKGDGADREDSESISNDIGVRFKAFDDQMLASIVVFESSRTNLQYNNKDYEAGVSGPDVAQYFYDGKEETKGVELDLNAHLGERWAINVNGVYQDARDKQDPNSTSFDTRQKGVPYVTASTWVTYDADWFKLPSPLSVSLGAKYVDERSTHSASFGIPDGYVPSYTVMDAALSYQADSWTVQLNVNNLLDEHYYEKAMFLGGMPGAERNAKLSLSYRL

SEQ ID NO: 13693 - protein, 713 aa, Chlamydia pneumoniae
MRFSKLSLAVATTLVTANVLAQSIELDSINVIATRDPSRFAYTPEKQSKDSLLSKQATSVAAALEDIPNVDIRGGSRSIAQKPNIRGVSDNRVVQVIDGVRQNFDLAHRGSYFLPMSLIQEIEVIKGPSSSLWGSGALGGVVAMRTPNALDLLKNNDKFGVKIRQGYQTANNLSERDASVFAANDKFDVLISAFYNNADNLRTGKGNKLNNTAYKQFGGLAKFGWQINDANRVELSHRETRFKQTAPSNNEVENELTNEKIIDQINEFHGSNNGLPQRAKPSSETSAFYSKVKTRFGSVSYLTDQQIPDQSTVFNYYLTPDNSYLNTHIALYNNKTIEKEQRKVSGVKDQTKLTTRGINLRNSSELSHISFVYGVDYMRDKIRTERGTNDKDAKFRADPYNANSNTTGVYLIAHIPLFGEKLLVSPSVRYDHYDTSSKTVKYKDNHLSPATKLTWKVTNWLDFSAKYNEAFRAPSMQERFVSGSHFGADIRGANQINKFVANPNLRPETAKNKEITANLHFDSLFKQDDKFKIEATYFRNDVKDLINLKTFNNPNENSPSQLLPTRSQYQNIANARLSGIELQAQYQTERLTLFTNYGSTKGRDKDSGEALSNIAASKIGVGADYALVKDKFTVGATITHYAAQNRVPKDHAVTYPSYILTDLRATYAPLKGEWKNLRLDFALENLFDRKYQPAFSLMEGTGRNAKISAVYSF

SEQ ID NO: 13694 - protein, 302 aa, Chlamydia pneumoniae
MKWLIWSVAMRSLVMAVSVFGMVSAAQAADMPDLPVLRGGLTEGLNGARANWDGYYVGGQFGYGTSDMDFSRSAASLTNFIFRNSVLQTPTSTWSVLNKNHVQGSSFGVYVGRNFQWEDTVWGIEVNYNYMNRMVSSSGSSMALNIVNPSGETVAANETRTYSTSVQAAAALQIKDVVTLRGRVGWAADNFLPYVFGGLAVGRMETSRVATTNVYLTDTFVNQTTGAIISQTGPSYLPSVSRTYGESRTNSFVGGWTGGLGFEYMMWGGLFARGEWEYVKFMTVKDTAVTLNSFRAGVGYKF

SEQ ID NO: 13695 - protein, 641 aa, Chlamydia pneumoniae
MVAGVVAIGLVGATSVSAQAQFTGIYGFGDSYADTGAAPGGAFRLAGAPAGCQSLPLPDNCRFTGGTNFVETLQSIYGLRGLTNYAIGGALTDNTNTLNSEIPGLVPPLPGFVYELARLAHDGGRFSSTDLVTVSIGGNDSSLLTSSVASATALGIAAAGRAVNGTGVAPLSGTYDGVTYNNVVTSGVHQLVDAGARNIAWLSAGNSKYFPVPEGGGAIGDAARDAFAHTYYQQIQLLLRPMALAGVRIFLFDFEILQARIYANPAQYGFAADPLCQQSSAPHSPTCFYQNAVHPTAAAMTLIGNYMANQIDAPSTVAPQAGIANAVITGFTASALDRLDASRRFQPFGLGAAMAAMPTKAAMPAAPEDRWSVYGDVSYAGGNRDRQFYASGYDYTSTGGYLGVEYRLDPNWRVGGVFGYAQPEVKLGVQDARNRIDAFQFAGYGSYADAHWFADAIVAYGRHELSLERRGIIDMIRGSTHADVFTAAAKTGYLFDAGKLRVGPIASLQYSYATIQGYTETGDVLLAMMVDRQTLDSLTGDAGVQFRYPLQLGSGIYTPFVNLTAAHDFLGGHSVTTTLVTAPLLPILTPVSADGGTYGRVAAGVSALVTDKVSATVTGTTSFARRSGNDAGVSGGLKVAF

SEQ ID NO: 13696 - protein, 930 aa, Chlamydia pneumoniae
MKIPLHKLLISSTLVTPILLSIATYGADASLSPTDSFDGAGGSTFTPKSTADANGTNYVLSGNVYINDAGKGTALTGCCFTETTGDLTFTGKGYSFSFNTVDAGSNAGAAASTTADKALTFTGFSNLSFIAAPGTTVASGKSTLSSAGALNLTDNGTILFSQNVSNEANNNGGAITTKTLSISGNTSSITFTSNSAKKLGGAIYSSAAASISGNTGQLVFMNNKGETGGGALGFEASSSITQNSSLFFSGNTATDAAGKGGAIYCEKTGETPTLTISGNKSLTFAENSSVTQGGAICAHGLDLSAAGPTLFSNNRCGNTAAGKGGAIAIADSGSLSLSANQGDITFLGNTLTSTSAPTSTRNAIYLGSSAKITNLRAAQGQSIYFYDPIASNTTGASDVLTINQPDSNSPLDYSGTIVFSGEKLSADEAKAADNFTSILKQPLALASGTLALKGNVELDVNGFTQTEGSTLLMQPGTKLKADTEAISLTKLVVDLSALEGNKSVSIETAGANKTITLTSPLVFQDSSGNFYESHTINQAFTQPLVVFTAATAASDIYIDALLTSPVQTPEPHYGYQGHWEATWADTSTAKSGTMTWVTTGYNPNPERRASVVPDSLWASFTDIRTLQQIMTSQANSIYQQRGLWASGTANFFHKDKSGTNQAFRHKSYGYIVGGSAEDFSENIFSVAFCQLFGKDKDLFIVENTSHNYLASLYLQHRAFLGGLPMPSFGSITDMLKDIPLILNAQLSYSYTKNDMDTRYTSYPEAQGSWTNNSGALELGGSLALYLPKEAPFFQGYFPFLKFQAVYSRQQNFKESGAEARAFDDGDLVNCSIPVGIRLEKISEDEKNNFEISLAYIGDVYRKNPRSRTSLMVSGASWTSLCKNLARQAFLASAGSHLTLSPHVELSGEAAYELRGSAHIYNVDCGLRYSF

SEQ ID NO: 13697 - protein, 738 aa, Chlamydia pneumoniae
MKYSLIAILLFSFTALQAQVKGTVKDNLGDPIAGANLFWQGTTQGTTTSADGTFSLSKPNDKHMLVVSFIGFENDTIHVSNRNETLDIVLREGVELSEVNVVSRKLGTMKLRNSVMNEDMISSAELSRAACCNLGESFVTNPSVDVTYSDAATGAKQIKLLGLSGTYVQMMTENIPNYRGSAAPYGLGYVPGPWMQSIQVSKGSSSVKNGYEAITGQINVEFKKPQLPEADWFSANLFASSTNRYEANADATVKLSKRWSTSLLAHYENETKAHDSNDDGFADIPRVEQYNLWNRWAYMGDRYVFQAGIKVLTEDRNSGQVSHGKTSLADPYKISIGTDRYEAFTKNAYIFNKEKNTNLALILSGSLHKQDALYGRKIYDVDQHNAYASLLFETELTKRQSLSAGLSFNYDSYDQHYRLDNDAAQPLTKKFTKEAVPGAYVQYTYNWDDKLVLMGGIRGDHSSEYGYFVTPRFHVKYNPNEYVHFRLSAGKGYRTNHVLAENNYLLASSRRIDIAKRLDQDEAWNYGASTSAYIPLFGKTLNLNAEYYYTDFSKQVVVDMDTDPHAVLFYNLHGRSCSQVVQVEASYPFFQGFTFTAAYRWTDAKTNYNGELMEKPLTSKYKGLLTASYQTPLGLWQFDVTLQLNGGGRMPAPYELTDGNWSWERRYGGFEQLSAQVTRYFRRWSIYVGGENLTNFKQKNPIIDASNPWGSNFDATMVWGPMHGAKAYVGVRFNLPRI

SEQ ID NO: 13698 - protein, 358 aa, Chlamydia pneumoniae
MKSSVSRALQTTFACAAVAALAAGAPSVRAQSSVQLYGQVDEWIGAQKFPGGQRAWGVQGGGMSTSYWGLRGTEDLGGGYQAIFTLEDFFRAQNGHYGRFDGDTFFGRNAYVGLATPYGTVRAGRLTTQLFVSTILFNPFVDSYVFSPMVYHVFLGLGTFPTYTTDQGVVGDSGWNNAIDYTSPSFGGFNAAAMYAFGNTAGDNRSKKWSGQLNYSNGPFAATAVYQYVNFNGGPGDLGALVSGMKSQGVAQVGLSYDFKLAKIYAQYMYTNNERNAGNWHVNTVQGGVAVPLGPGSALASYAYSRDSGGLDQTRRTWALGYDYPLSKRTDLYAAYMNDRYSGMSSGDTFGAGIRAKF

SEQ ID NO: 13699 - protein, 1053 aa, Chlamydia pneumoniae
MKIPCRIWLLAATLSVGQAAFSTEMETISFSTGQDIAQQKKVIEVTGTVTDNFGPVIGATVTVKGMSAGVITDTDGNFKLKVPVGATIVVSYIGYENKEIHYKGERSLKIKLNENVQELEEVQIIAYGSQKKVTVTGALSSINNEELLKSPVASMANALTGKVTGLASVQSSGQPGADDATLYVRGVGSLSTDLSQPLMLVDGVERSFFQLDPNEVESITVLKDASATAVFGVRGANGVILVTTKRGTSGKAKVNFSTTYAWQMPSRVPEFADSYGYANAYNNAQLHDGVSEDQLAFSSDIIEKFRTNSDPLVYPNTDWTDMLIKKSALQTQHNFNISGGSERVKYFASLGVFTQDGLFKTFEENGNDKGFKYNRYNYRINMDINVTSTTSMQINLGGYLNDKQEPNYNNGTYTQLKYLFRDIYTAVPFAGAGIVDGKWVVSDTDLFSIGNYYDALNTYYGKGYNNRTQNTLNFDFQLDQKLDFLTKGLKVHVKGAYNSGVTITKRREGRANKYEAIYNTNNELIYKKSQDYQKLGYSESTGQTRNWYLEAAVNYKRDFGNHHVSALAMYNQSMTYYPYEGSSPSEFIGIPRSYVGLVGRATYDYKTKYLLDLSLGYNGSENFAEGQRFGLFPAGSLGWIISEENFFQPIKKVINYFKIRGSYGIVGNDRVSDYSRFLYLPDKYLISSGSYNFGINTSTNIAGAVESKKGNPNVTWETAAKQNYGVDMKFLKDRLSLNFDYFVEHRKNILKARTVTPDYLAVSLPIANIGKVDNKGYEINLKWEDRINEVRYNIGANLSYAKNKVVFIDEITYPYEWMQTEGKPVGQQFGYVFDGYFTEEEAANYENLKGNIEGGIPDQGSGYVPLAGDVKYKDLNKDGKIDEKDVRDIGYPKYPLYTAGMNLGVSWKGFDFSMTWSAAFKTSRLLSSMYRVPFGESNNSAVMKYMIEDAWTPEKGNSAKAPALSFKSKSHNYQDSDLWLRDASYVRLKNIELGYSFPSSLMKKAHIGSLRLFVSGYNLLTFDKLKVSDPEANPDGTAYPLIKVVNVGLKVGF

SEQ ID NO: 13700 - protein, 1273 aa, Chlamydia pneumoniae
MKSSKPVPTTPRACLGSAEHSRTSHRRLLPSWLAVLCVAAPFAGAQTTTPPAPAPVEDEEIIMLSPFEVSASESEGYAAATTLAGNRLNTQLRDVGAAVSVVTTQFLRDTGATGNTSLLQYTVGSEVGGVNGNFAGTGDGAVLAEPSRPSETTRVRGLAAADNTRDFFLSQIPWDSYNIDRVDLQRGPNSILFGQGSPAGIINAGTKVASFRNSGEVETRIGSYGTLRGSLDLNRELVENQLAIRLNLLDNEEKYQQEEAFTNDRRAAGSLRYEPEALNRNGFRFTVKAGFETGRIDSNNPRILPPQDQITPFFEDGTITVTDPNGSARSVARGTNQATYNGWQLWDNQSGRIGSGVARPTAYEHAGSMLIPYASDWIKNSNFGGSINANNPVAFFGNGGGAQTAYWVTTASQQYQGNLSLGYVTAPGSWASIAPTATWAVNANLPYSGAGIFKNNVITDPSVFDFYNHLIDGDTKRERQRFHRATFNVATTALNDQIGLSFDYNKEAYKFTQSALLGGNVTLYIDPMAVYNNGTADAGLTGVPYSDGTANPNVGRPFVSSVGGSNNSTATESEDKRVTAFVTRDLREDLPGWLGRIVGKHTVTGLWADSEQTTDNRGWDSYGYRDPNVYRLQDPDLDPQTVNFTFVRPAMVMYLGPSLLGKSATGASIPVISGTPMIASGAVTYFDDTWNAPASVRPTDPWTNNAFTLDPTKLAPGYLAAAGAGAVNPANFTQANNPANYVGWTTAPLNITHADSDANRDALTTSAALNRAQTVSKALVWQGKMLDDSIVATLGWRRDTAKAYGFQRVLGNDPQINLSNYTITGSANHVLEVGSRSESFVAHLMDLPGLKGLTKNLPFEVSLAYSHSTNFQPLAGRVNVYGEEIAPPSGKTYDRSITIATRDQKYSLKVGKYVTSQKNITSLNNIFANDFNWWIGSLTNYTNMFDPAIQGGPVWGPMKSGSNIEQYMFSDSTTTQSPELAARQAAAVAGVRAFQNAVDPRFWSAWGFTSKEFIQSNQTGNPYTNVNSVPNGFALTEDGVSEGYEFELSAQPLPNWRLIFNASKMTAVRSNIGGDALNEMMEQIITMVNGDGGKMHFWWGTSDVPDARQVFYTGVGAPGNRGLGADWASLKLIEGASAPEIRTWHYNLITNYDFTDGFLKGFSAGGAVRYQSGDTLGYPPTGNPTDPASLGFDLANPYKGPSETYVDFWVGYRRKLTAKIDWRVQLNVQNVGKNDGLIPITVQGPIPGQPGGTPAGYRIAPVQTFTLTNTFEF

SEQ ID NO: 13701 - protein, 259 aa, Chlamydia muridarum
MNQVAVVIGGGQTLGAFLCHGLAAEGYRVAVVDIQSDKAANVAQEINAEYGESMAYGFGADATSEQSVLALSRGVDEIFGRVDLLVYSAGIAKAAFISDFQLGDFDRSLQVNLVGYFLCAREFSRLMIRDGIQGRIIQINSKSGKVGSKHNSGYSAAKFGGVGLTQSLALDLAEYGITVHSLMLGNLLKSPMFQSLLPQYATKLGIKPDQVEQYYIDKVPLKRGCDYQDVLNMLLFYASPKASYCTGQSINVTGGQVMF

SEQ ID NO: 13702 - protein, 975 aa, Chlamydia trachomatis
MNRVIEIHAHYDQRQLSQSPNTNFLVHHPYLTLIPKFLLGALIVYAPYSFAEMELAISGHKQGKDQDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTIIFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEIRAGNAPLRLSGSPSIHDPEGLFYENRDTAASPYQMEILLTSDKTVDISKFTTDSLVTNKQSGFQGAWHFSWQPNTINNTKQKILRASWLPTGEYVLESNRVGRAVPNSLWSTFLLLQTASHNLSDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 13703 - protein, 1754 aa, Chlamydia muridarum
MSSMKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKITGEGGAIFSQGELLFTDLTGLTIQNNLSQLSGGAIFGESTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPESAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDALVSLSVTENLVGKEGGGLHAKTVNISNLKSGFSFSNNKANSSSTGVATTASAPAAAAASLQAAAAAVPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKIGSTQNVYETLDINKEENSNPYTGTIVFSSELHENKSYIPQNAILHNGTLVLKEKTELHVVSFEQKEGSKLIMKPGAVLSNQNIANGALVINGLTIDLSSMGTPQAGEIFSPPELRIVATTSSASGGSGVSSSIPTNPKRISAAAPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 13704 - protein, 1038 aa, Chlamydia trachomatis
MSSMIAGAMFVASAAIPAMAQEDDTVVTTDAAPEDAESRQQRITVTGSRILQPNLTTTSPVSSVTSEDFKLQGATRVEDLVVQLPQAFAAQNSTVSNGASGTATVSLRNLGSTRTLVLIDGKRLPYGSPNDPAADLNLIPSQMVERVDVLTGGASAVYGSDAIAGVVNFIMKKDFEGVQVDAQYGFFNHENDYDTNGNLRDSLEAFSQTNPSQFQIPEDNISTGWSKEVTGMIGASTDDGRGNFTGYIGFRDNDSILQKDYDYSACSIGGITAGNFTCGGSGTSFPGRFTDFASFNYTIDAATGDFRDFTAADNYNFGPVNFFQRPDERYSAGFFAEYEVNPFVNVYSNFMFMDYKSNAQIAPSGNFFSTQGISCDNPLLSATQRSQLCEVDLVPDLVDDPETDEDEVADFLALNPLGGQDFIDATLGVQNALTGGAPRLNADGTVSLTAFDGVSPAYIGRRNVEGGGRQDTLGYQTFRGVIGMNGDLYNAPGFTYDISAQYSKVNLTRAYRNEFSTVRLGRALDVVTDPDTGLPVCASVLDGTDANCVPWNIFAIDGVTPEALNYLQVPLLQNGTTEQSVVTASLTGDLTEYGFKLPTADRGLQVAGGVEYRRDAISQQVDVSFATGDGAGQGGPTLPLSGSIDSYDLFTEFQLPLVEGRPGIELLAIDGAFRYSDYSTGVSAESWKVGGEYAPTSDLRVRGSFQNAVRAPNVIDLFQSQGFNLFDLDDDPCDFTDPAEDGTGGAACLGTNPWQVNSVQANNGSLTSPAGQYNFLQGGDPGLEPEQAETFTVGFVATPSFLPGLNLSVDYYDIKITEAISQVGASVTMQLCYVYDDADACSLIQRNQNGQIWVGEGNVVDLNKNIGGISTSGFDIAGNYAFDIGSLGGLNLSYNGTLLDSFTVDPAGNVVFEYDCVGKYGNDCGTPTPEYRHRTRLSWATPMEGLGVNATWRHIGAVDLDTGATGRPDSTLDATNYFDLSGTFAAADWAALRFGVNNVLDQDPPLSASVGTTGNGNTYPQTYDAMGRYVFVGVTLDF

SEQ ID NO: 13705 - protein, 803 aa, Chlamydia muridarum
MKFLNTGIFLLISCSILAQKGGIYGKVKFDNNDPVIDAYLILTSKNYIRETSTDFNGSFSFKNIPFGTYEIQIRSLNSQPKNISVQLNTKRKEIDVVLDYFENQLDEVLVTTKSKKTKTETKGFSVNVIETKESSLRNIQTNELLNTTVGVKIRQNGGLGSEVNYSLNGLAGNAVRIFIDGIPISVYGSSFNLNSIPPSMIKNIEVYKGVVPGHLADDALGGAINIVLHKNAKSNLNGSISYGSFNTLQTSANGLYRFKKSGITFKTSLFHNYSDNNYKVSGRSVVVTGIGGAQTPIVSKRFNDAYSSTGGMIQAGYTDVKWADQFFIGVTGSEDYKEVQHGAFMTITPYKGRFFESDAILANITYQKKNFLTRGLEINIHGLYGKRNRMLNDTVAAAYSWNGNRAIDFRGNEFEYSWGSQQEGGPTLAKINRDVASFRTGISYTFDKNHKVLANHLYSGIDRQDSDALRSVLENTFIGSRELRKNIYSITYEINAFKNRLKANLFGKHYQQNTVNLDPAIAEDENGNDKIIDEIISSNKTLNGYGFAISYTVHPKITLLASAEKAIRLPNETEVFGNDGDNVVANPSINPEQSNNFNLGFRLGTFHFNNHNFTLSTNLFTRNLKDRIGLPIENSTNINDELIVYVNQGSGTSKGFDAQLNYNYKNNFGLNFNISRFDLKLINNGVEIDVPNTPFFTMNGSLRYSFKDVIRKKARLNLFYNIYFTDQFSYLVPQGSNTVGDDFFKIPQQLAQDLGLSYAFPNQKLVMSFDIKNILDKPVYDNLSVQKPGRAFYLKLNYSINKL

SEQ ID NO: 13706 - protein, 825 aa, Chlamydia trachomatis
MKFMRQKMKYPLTILSGILCSAYVGATDMQNNVEVVVKDTIEAPLSSTQILTSEEIKQRPTGDGNVTDLLKTNPAVQFSNSANNAMTQGEIKPADISIHGSTAYQNSFTLDGMNINNDIDPASGQLGVTNSQLSSDEQGFYLDSKLIESVTVYDANVPVEFGGFTGGVVEVKSRRWQGETSAHVYYRTTDASWNNLFVDEKLDFSSKNNDASRPARFQPKYSKNSYGVSFETGITDNLGMIVSLSRRSSSIPMQRVGGKSVNLNGDTFYEFEMQDSMQTQTRTADNIFSKLTWYVSPKTTADLSVTYSGYDAELFMNGIAKSNYSDKHDGLSTTLQVQHMFDFATLDVSAGFQSMQDKRTSEQNNFVSLVDYSDWKNPTSYSSGGPGDLLSKQQNSSLKAKISFNPVKLAGVTHQVVTGAEMTHSNAKSSRKKTYFRNSYNAYMPTPSVDAFFAGEKKTNYTNIAAFIEDTLKLGDVTVRAGLRIDRDDFIKRTNIAPRVSSSWDVFSDNSTTLSAGASRYYGRSMLTYALYEAQNAGLKHCMMNCTPNSESANVWTNTPDYEGMGELQTPYNDELTLGVAQVINNSLWSLNYVHRLGRDEVRARYKYPDANKYSAEAKIRSFDNQGKTYHDSVALTVANRVPFEIAQSLNQMSASVVWQKTTSNSPSNQGYAFHDPSMSLDRTKVWYDGKIIDADDLPSTDFNAPWRVNLEWTSQLPTYDLTFYNLLQWQSSREQVTRHENEYAIDSATGNQVMKYEAVDFEDTLRWDVKAQWQPKFAYGASLALEVTNLLNNKNASDAFVSGGNVYRSYEAGRQFWLQVSFDY

SEQ ID NO: 13707 - protein, 1531 aa, Chlamydia muridarum
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNYGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAVNQALFASEDGDLSPQSSISSEELVKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 13708 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGRAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVKQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 13709 - protein, 755 aa, Chlamydia muridarum
MKKLEQKKMEWATGTRLRAIAAAASVAFGTAAAGHAYAQTAPAMNAGAAASASSAQNGATTNPSTGAQNGTLPAITVNAASAGDGTVGLVAKRSTTGTKTDTPLSEIPQTINVVTAQQIEMTGATDVNAALRYVPGFSSYGSDNRSDWYAALRGFTPTAYVNGLQVPNTINLASWRVDPYMIDSISVLRGPTSVLYGAGDPGAIIDVHTKLADGERVREAGVQIGNYARKQFMIDVGDKLDPDGKYAYRFVGVARDGNALTGPNNDQRVALAPSFRWRPDADTSLTLSATYLQDWGDISSNFLPAQGTVLPNPNGQINKDIYEGDGNFNYYRKKQWSIGYQFERNLTPAWTFRQNTRLMHLSLDNASVFANGFAGDSLTDVSRWAGLFQMNYSRFDIDNNLEGRFATGPLQHTLLLGFQYNRQTATDSEWLAAAPTLNLYNPVYTPVTMGVFSDPDATSRTNTYTTMNTFGLYAQDQIKWNRWTLTLGGREDWVNMRQDDRAAGTSTKADVTAFTGRVGLTYQGDYGLSPYISYATSFNPLIGVNLLGGGLPQPTRGKQIEAGLRWQPPGKNLMLNAAIYQINQTNGITPALPSQDPGGTKSVQSGEVRSRGIELSATGKVTPNLSVVASYVYQDVKVIQANDVSLNNWPVDIPRPRQMASLWTDWTWHTGPLAGFGLGGGIRYQSASAGAADNSLTVSSVTLFDAGVHYDTRNWRFAVNGTNLFNRHYISGCQSTNVCIFGTDRTVIATAKYNW

SEQ ID NO: 13710 - protein, 365 aa, Chlamydia trachomatis
MKKAFFALYIVLLTYASSSVAQSSVTLFGILDEGVSYTNNIKGSSSTKTASGIKWPTYWGIKGQEDLGGGWDAVFNLQDQFDINSGAMGYGGLLFGRLAIVGLANKDYGQVTLGRQSDFMNDFLYLVSDREQYLTLYSLAPGNLDRIGGGQLNNSIKYRYGLGTGISLGAMYAFSNSGTGTAANGTARSFELRYTNQSVRALAVYTDIHGVSVAPASSIGSSSFLGYQLGLGASTVVPLNSLSIAALGMSYTYQKLTGMVTYTNVHMDSVRESGALQTLTLGGIYRFTPAFLLEAGASTSRLSSSRWNQLVATLDYYLSKGTDIYLTADYEHASGHGQTAELYMSGGPSSTGSQAIVRVGVKHYF

SEQ ID NO: 13711 - protein, 790 aa, Chlamydia muridarum
MTRRFRFPLDRTPPSGTDYTLALLLALGGALPASAAEAPDDAAPATSVAAATPGRADTALGKVTVTARRREEDSQKVPTPITVLGGETLEAQRISRVQDLQQVLPSVNVAYIHARQSSVAVRGIGNNPASDGLEGSAGIYLDNVYLGRPGMAVFDLLDIEQLELLRGPQGTLFGKNTTAGVLNISTRAPTFTAERTVEVSGGQDGYFQGRGTVSGPLGETLAGRLSAYRTRDDGYIKNIHDDNYLNGGERQGARGQLLFEPNEDFSLRWIADYNEEDSSNGSMVVYGAAERFWQRAALVGASPLRDPQRKKVNVNGRQHVSVHQGGSSLEANWNLASGYRLTSISAYRYWHFTPANDEQLNVSAINDTGVEVHDRQFSQEIRLASPTGGAFDYVVGAYAFRQNLGNKTFTSYGPLADLYLLGANLGALNDTYSKANGKIETDSFALFAQGTWHLTERLDFTAGLRGTYEEKDAKVERFAPLGGAAVGGIGAAVRNGQLGAYDSGDLSQYNFAPSALLSLSYQFSDELLGYASLSHGEKSGGVNLAVGSAPSAGADSLLVGPERANDAELGLKSTLFDRRLLLNANLFWTGIHGYQATTLYQAPGSTQLVQVLANAGSVRSRGLEFEATALPLRGLTLNFNGSYNDVTYLSFKDAPCPAEVSTRPGAPSSCDLTGQRVVGASKWIANLNGEYRWRLDDRFQPYVSASYAYRSAAEGTLDNSDLSKIDGYALVNLAAGLRSDLGDGQLDTSVWLKNAFDKDYYLSAFASINGSYTASVGQPRTLGVSLRYDF

SEQ ID NO: 13712 - protein, 1034 aa, Chlamydia trachomatis
MIKRTSLSFACLSFFYLSTISILQANETDTLQFRRFTFSDREIQFVLDPASLITAQNIVLSNLQSNGTGACTISGNTQTQIFSNSVNTTADSGGAFDMVTTSFTASDNANLLFCNNYCTHNKGGGAIRSGGPIRFLNNQDVLFYNNISAGAKYVGTGDHNEKNRGGALYATTITLTGNRTLAFINNMSGDCGGAISADTQISITDTVKGILFENNHTLNHIPYTQAENMARGGAICSRRDLCSISNNSGPIVFNYNQGGKGGAISATRCVIDNNKERIIFSNNSSLGWSQSSSASNGGAIQTTQGFTLRNNKGSIYFDSNTATHAGGAINCGYIDIRDNGPVYFLNNSAAWGAAFNLSKPRSATNYIHTGTGDIVFNNNVVFTLDGNLLGKRKLFHINNNEITPYTLSLGAKKDTRIYFYDLFQWERVKENTSNNPPSPTSRNTITVNPETEFSGAVVFSYNQMSSDIRTLMGKEHNYIKEAPTTLKFGTLAIEDDAELEIFNIPFTQNPTSLLALGSGATLTVGKHGKLNITNLGVILPIILKEGKSPPCIRVNPQDMTQNTGTGQTPSSTSSISTPMIIFNGRLSIVDENYESVYDSMDLSRGKAEHLILSIETTNDGQLDSNWQSSLNTSLLSPPHYGYQGLWTPNWITTTYTITLNNNSSAPTSATSIAEQKKTSETFTPSNTTTASIPNIKASAGSGSGSASNSGEVTITKHTLVVNWAPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRLSSRYYLSALCFEHPMFDRIALIGAAACNYGTHNMRSFYGTKKSSKGKFHSTTLGASLRCELRDSMPLRSIMLTPFAQALFSRTEPASIRESGDLARLFTLEQAHTAVVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 13713 - protein, 745 aa, Chlamydia muridarum
MMQSTTVFSSSRQPALRPLPRLLHISLLSLAAGVVLPAQAADAAAADVTMPAVTVLGQSMATTEGTQSYTAGETRSATRMDLSLRETPQSVSVITRQLLDDLGAVRLDQALAQTTGIQVNQNDTERTTFSARGFGINNIQIDGMARGGNAPLQDTILYDRIEVVRGATGLMGGKGDPSATINMIRKRPTKEFQASAGLIMGRWDDQRFEADLSTPLNPQGSVRARTALAWQKRDSYLDMYHERKTVGMLIVEADLRPGTLLTAGVDFQDNKPTGATWGAVPYWNADGSLANLPRNTSWTTPWSTWANKQHTVFTSLDQRLPGNWNMHLGYARTESTNRTTVLYAGKGYPDPATGEGMKLWTGAWGAGKNTGDNFDLYASGPFTLLGRKHTAIVGWNGSNQRSRSLGGEAEINYPDFIPDYRSWTGNIPRPVFHPDGSHTETVTRLAGGYVATRLSLADPLHLIIGARSSTYRTDTRNYNTQGVYTGSGDFAETRNEVTPYVGAVFDINKQYSAYASFTQLFNPQTSKDRNDKFLPPETGDNAELGIKGEFYEGKLNASAALFHTKKKNLAELDRTVPPGFLLPDGGQAMVANGAGVTAKGVEFDVSGQFSPSWEASGGYTYLHAAEADGRRAATTQPRHLLRLATSYRFDGRLAGLKAGASMTAQSATYSESWYGRPPSGEMTNIPQAGYALVNAMASYALNRHASVQLNVNNLLDKKYYRNVGFFDGVFWGEPRNISLAVRTAF

SEQ ID NO: 13714 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAANQPTNGQASNTSNNYGDGGAIFCKNGAQAAGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKINVLKLQLGTKPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFIRASYGFGNQHMKTSYTFAEESDVRWDNNCLAGEIGAGLPIVITPSKLYLNELRPFVQAEFSYADHESFTEEGDQARAFKSGHLLNLSVPVGVKFDRCSSTHPNKYSFMAAYICDAYRTISGTETTLLSHQETWTTDAFHLARHGVVVRGSMYASLTSNIEVYGHGRYEYRDASRGYGLSAGSRVRF

SEQ ID NO: 13715 - protein, 1018 aa, Chlamydia muridarum
MPFSLRSTSFCFLACLCSYSYGFASSPQVLTPNVTTPFKGDDVYLNGDCAFVNVYAGAENGSIISANGDNLTITGQNHTLSFTHSQGPVLQNYAFISAGETLTLKDFSSLMFSKNVSCGEKGMISGKTVSISGAGEVIFRDNSVGYSPLSTVPTSSSTPPAPDPSPTASSSSSPTVSDARQGSIFSIETSLEISGIKKEVMFDNNAGNFGTVFRGNSNNNAGSGGSGSATTPSFTVKNCKGKVSFTDNVASCGGGVVYKGTVLFKDNEGGIFFRGNTAYDDLGILAATSQDQSNTETGGGGGAICSPEDTVTFEGNKGSIVFDYNFAKGRGGGILTKKFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVLGGELVVTEGATLTTGTITATSGRVTLGSGASLSAVAGTANNYTCTVSKLGVDLESFLTPNYKTAILGADTTVTVNNNPTLDLVMKNEAEVYDNPLFVGSLTIPFVTLSSVNNTNSNGVVKTAVTINDADAAHYGYQGSWSADWTKPPLAPDAKGMVPPNTSNTLYLTWRPASNYGKYRLDPQRKGELVPNSLWVAGSALRTFTNGLKEYYVSRDVGFVASLHALGDYILNYVQDDRDGFLARYGGFQATAAYHYENGSIFGVAFGQLYGQTKSRMYYSKDAGNMTMLSCFGRSYVDIKGTETVVYWETAYGYSVHRMHTQYFNDKTQKFDHSKCHWHNNNYYAFVGAEHNFLEYCIPTRQFARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 13716 - protein, 1006 aa, Chlamydia trachomatis
MPFSLRSTSFCFLACLCSYSYGFASSPQVLTPNVTTPFKGDDVYLNGDCAFVNVYAGAEEGSIISANGDNLTITGQNHTLSFTDSQGPVLQNYAFISAGETLTLRDFSSLMFSKNVSCGEKGMISGKTVSISGAGEVIFWDNSVGYSPLSTVPTSSSTPPAPTVSDARKGSIFSVETSLEISGVKKGVMFDNNAGNFGTVFRGKNNNNAGGGGSGSATPSSTTFTVKNCKGKVSFTDNVASCGGGVVYKGIVLFKDNEGGIFFRGNTAYDDLRILAATNQDQNTETGGGGGVICSPDDSVKFEGNKGSIVFDYNFAKGRGGSILTKEFSLVADDSVVFSNNTAEKGGGAIYAPTINMSTNGGSILFERNRAAEGGAICVSAASSGSTGKLTLSASDGDIVFSGNMTSDRPGERSAVRILSSGTTVALNASGLSKLIFHDPVVQNNSAAAASTPSPSSSSTPAAVTINQSGNGSVIFTAESLTPSEKLQVLNSTSNFPGTLTVSGGELVVTEGATLTTGTITATSGRVTLGSGASLSAVAGAANNNYTCTVSKLGIDLESFLTPNYKTAILGAYGTVTVKRGSTLDLVMENEAEVYDNPLFVGSLTIPFVTLSSSSTSNGVTMKRVTINDADAAHYGYQGSWSADWTKPPLAPDAKGMVPPNTSNTLYLTWRPASNYGEYRLDPQRKGELVPNSLWVAGSALRTFTNGLKEHYVSRDVGFVASLHALGDYILNYTQDDRDGFLARYGGFQATAACHYENGSIFGVAFGQLYGQTKSRMYYSKDAGNMTMLSCFGRSYVDIKGTETVVYWETAYGYSVHRMHTQYFNDKTQKFDHSKCHWHNNNYYAFVGAEHNFLEYCIPTRQFARDYELAGFMRFEMAGGWSSATQETGSLTRYFARGAGHNMSLPIGIVAHAVSHVRRSPLSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 13717 - protein, 878 aa, Chlamydia muridarum
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCASIPIVSNGSGLFSSFSIFSKLQGFSGTQDGFEESSGEIRSFSASSFRNISLPIGITFEKKSQKTRNYYYFLGAYIQDLKRDVKSGPVTLLKNAVSWDALMANLDSRAYMFRLTNQRALHRLQTLLNVSYVLRGQSHSYSLDLGTTYRF

SEQ ID NO: 13718 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLPKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYVHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCASIPIVSNGSGLFSSFSIFSKLQGFSGTQDGFEESSGEIRSFSASSFRNISLPIGITFEKKSQKTRTYYYFLGAYIQDLKRDVESGPVVLLKNAVSWDAPMANLDSRAYMFRLTNQRALHRLQTLLNVSCVLRGQSHSYSLDLGTTYRF

SEQ ID NO: 13719 - protein, 441 aa, Pseudomonas aeruginosa
MKVMKWSAIALAVSAGSTQFAVADAFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGALKVRISKTMLKWGEMQPTAPVFAAGGSRLFPQTATGFQLQSSEFEGLDLEAGHFTEGKQGTTTKSRGELYATYAGQTAKSADFAGGRYAITDNLSASLYGAELKDIYRQYYLNTNYTIPLASDQSLGFDFNIYRTTDEGKAKAGDISNTAWSLAGAYTLDAHTFTLAYQQVHGDEPFDYIGFGENRSGGGGDSIFLANSVQYSDFNGPGEKSWQARYDLNMASYGVPGLTFMVRYINGKDIDGTKVDSSSSYAGLYGEDGKHHETNLEAKYVVQAGPAKDLSFRIRQAWHRANADEGEGDQNEFRLIVDYPLSIL

SEQ ID NO: 13720 - protein, 351 aa, Pseudomonas fluorescens
MKLKNTLGAIIGSMVAASSISALAQGQGAVEVEAFAKHWFSDESSRDFENDEAELYGASIGYFLTDDVELVLSHGVYRDVTTDEPIGDGGHKDIKGELTSIDALYHFGEPGAGLRPYVSGGFAHQSIGQARGGRNNSTLANVGAGLKYYFTDMLYARAGLEGMYNFDDDQTDWQAGVGIGLNFGGSGGKQQPVAEPVAEVCADVDNDGVCDNVDRCPDTPANTTVNAEGCTAVAEVVRVELDVKFDFDKAQVKEESYADIKNLADFMKQYPQTNTTVEGHTDSVGTDAYNQKLSERRANAVRDVLVNEYGVQGSRVDSVGYGESRPVADNATESGRAINRRVEAEVEAQAQ

SEQ ID NO: 13721 - protein, 338 aa, Pseudomonas syringae
MKLKNTLGLAIGSLVAATSIGAMAQGTGAVEVEGFYEKEFFDSQRDFKNDGNLFGGSIGYFLTDDVELRLGYDEVHNARGEDGKNIKGSNTALDAVYHFNNPYDAIRPYVSAGFSHQSLGQTGRGGRDHSTFANVGAGAKWYITDMFYARAGVEAQYNIDQGDTEWAPSVGVGLNFGGSPKQAEAAPAPVAEVCSDSDNDGVCDNVDKCPDTPANVTVDADGCPAVAEVVRVELDVKFDFDKSVVKPNSYGDIKNLADFMKQYPQTTTVVEGHTDSVGPDAYNQKLSERRANAVKQVLTQQYGVESTRVDSVGYGETRPVADNATEEGRAVNRRVEAA

SEQ ID NO: 13722 - protein, 360 aa, Enterobacteria phage PA-2
MKKLTVAISAVAASVLIAMSAQAAEIYNKDSNKLDLYGKVNAGHYFSSNDKHDGDKTYARLGFKGETQINDKLTGFGQWEYEFKGNHAESQGSSADKTRLAFAGLKFGDYGSIDYGRNYGVAYDIGAWTNVLPEFGGDTWTQTDVFMTDRTTGVATYRNNDLFGLVDGLNFAAQYQGKNDRTDVTQANGDGFGFSTTYEYEGFGVGATYAKSDRTNNQVIYGNNSLNASGQNAEVWAAGLKYDASNIYLATTYSETQNMTVFGKNHIANKAQNFEVVAQYQFDFGLRPSVAYLQSKGKDLGVFGDQDLVKYVDVGATYYFNKNMSTFVDYKINLLDKNDFTRNLDINADDIVAVGMVYQF

SEQ ID NO: 13723 - protein, 175 aa, Rhodopseudomonas blastica
EILPLYTKVDGITNAAGKEKDSPLTRSFIAGGGAFGYKMDDIRVDVEGLYSQLTKDANVVNDNSAADDVTAFSGLVNVYYDIAIEDMPITPYIGVGVGAAYLSNPSKADGVKDQRGLGFAGQVKAGVSYDVTPEIKLYAGARYFGSYGASFKKATTSTNKDINVLYSTVGAEAGV

SEQ ID NO: 13724 - protein, 330 aa, Rhodobacter capsulatus
EVILYGKIRGGVEYTHEGDFANKSEKNAWGVVDYSSYIGFKGSEDLGGNLKAIWQVESRVDIGGGKDSSGNPRGFATRDSFIGLEGGFGTVKVGYVSTPLRNTHAAQDQWEYSSDILGLGRYTRFSTRRTSLNYQSPDFAGFNFEFQMAPGKNAHTPDARTNDGKPAFGLGLGYKNSGFFARYAVDYARKSVTTTSNGLKDSHVHNLSAGYDANNLYVAGGIQYGKNVEVSVDSQNIANTHEDGTNSKEAQITAAYTFGAVTPRVSVAYGRFDSKDTNVDGARYVQAILGADYAFSRRTTGIVSTGWIQDKVGSEKTNNWGVGTGLVHKF

SEQ ID NO: 13725 - protein, 743 aa, Buchnera aphidicola
MTNRKPLFIILFSLGYSGIYSQEQQVKKDSVYQLQEIVVSSQQILGSKFKARNRTGSAYYISPEEIRRLGYTDINRMLKAVPGVNMYEEDGFGLRPNISLRGTKAERSERISIMEDGVLAAPAPYSAPAAYYFPNVARMEAIEVLKGSSQVQYGPFTTGGAINLVSTPIPNSFSGKANISYGSKNTFKSHTSVGSSWKHFGYMVEYLRYQSDGFKKYEDHAAKGFKRNDIIAKIRVKTDHVKGVNHALELKFGYADENSDETYVGLSADDFKKTPFLRYAGSQMDKLKTDHRQWVATYLLTFSNKLKITTNAYYNYFHRNWYKLNDVRAGITSKEKRSIADVLVDPETNIRYFDILTGKTDREEEALLVRANNRTYRSRGIQTRAEYRFNLNEFFFDLEFGLRYHADEEDRFQWDDSYSMKNKKMVLFMEGIHGTNANRVTSANALAGYLLAKLRYDAWTVTAGLRYEDVDLLKKDYTKEDLARSGKVRIETPNHARVLIPGVGLHYQLMPAASVFFGIHKGFAPPSAELYQKPESSVNMELGTRVAIGNFRAELIGFYNNYSNMLGSDLAASGGAGTLEQFNVGEARVKGAEFLVQYQPLPKNCNVRLPLQVSYTYTDTEIRNSFESHSWGNVVRGDEIPYIFKHALNMQLGIECKWFYANIGTRYNSDMRTSPGQGTIAEREKVPANLIFDASLNVFVNKYLTVRLNAINLTNRVYLTSRHPAGLRAGHPFGIYAGANVQF

SEQ ID NO: 13726 - protein, 362 aa, Buchnera aphidicola
MKNHKIIFRTSMIAAAMALASTQGYAAEQPLSEQVEALNQRIAQLEAQAAPSQFKNSEVSLYGSIRPTLSYLDDSTDETWDVRDALSRVGIKASTEFADGWRAIAQGEWSVDIANSGNFGKARQAYVAIASPYGQVGIGKQRPAQYSLIAEYVDIFNHGNSPYAYDHESPFFVDNFVTYKLVTGGFTWMAGAQFDGDKGDTGADFVNIGVGYDVGALHLGLGYVTQDSLENGQVNGDNQTLGGVVAYTFDNGLYLAASYQDKQYNFDNQVQHGDRSGSTLDTALAYPLSNEYKIKLGYFQFKDGIEDISSMDYDGFNTTLEWNPLANVRVHLEYLDKNYDNLNDDRAVTVGFRYDFNLNWKG

SEQ ID NO: 13727 - protein, 915 aa, Pseudomonas aeruginosa
MIRRHGKLTLLTLLLSASCSGIFAQEIPVTTPIDSLITVGYATGSLKTLSGSVEKITETQMNKDQITNPLEAIRGRVPGLTIQRGSNGPAALDAVRLRGTTSLTSGNDPLIIVDGVFGDLSMLTSIYPTDIESFTILKDASETAQYGSRGASGVIEVTTKKGMSGRTQVAYNGSFGISTVYKNLKMLSGDEYRRVASERGISILDKGNNTDFQKEIEQTGLQQNHHIAFYGGSSESSYRVSLGFMDRQGVILNEDMKNFTSNMNMNQKMFDGFLNCELGMFGSIQKNHNLVDYQKTFYSAATFNPTYPNHKDPVTNSWDGITTASQITNPLAWMEVQDDDATSHISTHARLTFNLLEGLKLNLFGAYTYNIVENSQYLPTSVWANGQAYKGTKKRESLLGNMMLTYKKNWKKHFFDVLALAELQKETYTGYYTTVSNFSTDKFGYNNLQAGALRLWEGTNSYYDQPRLASFMGRFNYTYADRYVLTLNARTDASSKFGANHKWGFFPSASAAWVISEEEFMKQLPMVDNLKFRIGYGLAGNQSGINSYTTLNLVKPNGVVPVGNSAVVSLGDLRNTNPDLKWEVKHTFNTGIDVALFGNRLLLSANYYNSRTTDMLYLYNVSVPPFTYNTLLANIGSMRNWGTEIAIGITPLKIKDMELNINANITFQRNKLLSLSGMYNGEMLSAPEYKSLASLDGAGFHGGYNHIVYQMVGQPLGVFYLPHSTGLESDGNGGYTYGIADLNGGGVSLEDGEDRYVAGQAVPKTILGSNISFRYKRFDLSLQVNGAFGHKIYNGTSLTYMNMNIFPDYNVMKKAPKQNIKDQTATDYWLEKGDYVNFDYVTLGWNVPIEKVQKLKKYVRSLRLAFTVNNLATISGYSGLSPMINSSTVNSTLGVDDKRGYPLARTYTLGLSINF

SEQ ID NO: 13728 - protein, 1045 aa, Serratia marcescens
MILNKKLKLAYCVFLGCYGLSLHSSLAAYREPGQLGSPDSWKNAEFNRQWGLEAISAEFAYARAYTGKGVTIGVIDDAILSHPEFAGKLTRLDNGSYNFSYDKQDNMSFGTHGTHVAGIAAAKRDGSGMHGVAYDADIIGTKLNDYGNRNGREELIQSAARVINNSWGIRPDIRRDAKGDIIWLPNGRPDYVAWVKTDVINEVMRNKSNLEWGSEQPVPTGGHSAMATLLRAAKHGKLIVFSAGNYNNYNIPEAQKSLPYAFPEVLNNYLIVTNLSNNDKLSVSSTSCGHTASFLACQPGSSIYSSVGELVSNTGGAVNREAYNKGELTVKPDYGNMSGTSMAPDVTGFAAVLMQRFPYMSAAQISAVIKTTATDLGEVGIDHLFGWGRVNLRDAINGPKMFITQEDIPQEFYVPGSYSEKQFVVNIPGLGNIVEAGTPVERRCTSGECDFDSWSNDIRGHGGLTKTGAGTLAVLGNNTYSGDTWVKQGVLAYNGSVASNVYIENSGTVAGDRTVGAFRAVRGCEHGDAGNGYGTLHVLLDAVFDRGSQYNVELADKGRSDKLAARRAFLNGGSMNVSLDRSQKLMSQNEAELLVGNNYTILTTLDGVTGRFDNANPSYPFVKVALDYRGNDTGLGITKTDATFDSLASTENDKEVARAVETLNATEPVTETAKRSVSIPASEEANLQQSDAGAAQAVNEEASIVAGHPIYESFLGFTTARELQQATRQLSGQIHADMASAQINESRYLRDTATERLRQADGRRTASDIKADDNGAWAKLLGNWGHASGNDNATGYQTSTYGVLLGLDSELFDDGRLGVMTGYTRTSLVGGLQSVVHSDTTHLGLYGDKRFGALALPAGGTYTWHRIDTSRSVNYGAQADREKARYNARTGQLFIESGYDWSNDVVNLEPFANLAYTHYRNEGINEQGGAAALRGDKQSQSATASTLGLRADTQWQTDSVAIALPGELGWQHQYGKLERKTQLMFKRSDVAFDVNSVPVSRDGAILKAGVDVSINKNVVLSLGYGGQLSSNHQDNSVNAGLTWRF

SEQ ID NO: 13729 - protein, 704 aa, Serratia marcescens
MILNIKIIIFKGINLTQIKNMKFKKSLLCFLILSGALLKAEEKYQLNDVVVSASGFEQDLVDAPASISIITKEELEKKPIKDIGEAIGDIPGVDVTMNKTGTYDFSIRGFGSSYTLVLIDGKRQSVANGFYDNGFSGSESGYLPPLSMIERIEVIRGPASTLYGSDAVGGVINIITKKNPDKTEANIEFNTLLQQHSNHYGNAGGFNAYVATPLIEDILSISARLKYYDKAASDLKWPTPVWNNGNQRPDNYQIASHSPGAFTSLGFGSRLNWTVDDKNNIYFDIERYINEISVNSTSSRAIKSERQLFKDNIVLNHDGNYDFGSTNSYLQYGSTKDKELHSQIWVGEGKVVLPWNLGQYGNLVNTFGARIDYEILKNDQASAGSQIRGKNLDQTTVALYGENEYFIADDLIFTTGLRYIYSDLFDSEFTPRVYLVYHLNDNIALKGGVSKGYKTPAAKQLTNGYYNYANNNAYFGNPDLKPEESINYELGVDFMVFDFAHYSITGFITDFTNQISSEDLTGMQNDINCSNGIVCKRPINLGKTQTKGIEFAFNTKTYNGFSLNSSYTFMDNRYKDGQKNWFGGDRIENLPRHIAMLKLNYERGKFSSYIKTRARLDAIAKAKGGGNGSLPWQKYKPFYIVDLGINYKINKQSSLSFAVQNLFDKNFFNPQVTRWDGANPAGYANRYQDYTEGRSFWLSYKYDF

SEQ ID NO: 13730 - protein, 1083 aa, Pseudomonas putida
MSKPLFMTIVLLGAACSALAQTATIDGLVTDSSQAVVVGAVVTVTNLDTGLRRVARSNETGGYTFTQLPVGRYKVAAAMSGFTTQTAPELKLDVDQVVRLDFALKPGTLTETVEVSASAALLDSETATVGQVISNKSIVEMPLNGRNYLSLATLTAGTSPNVGGRTQSEGGFVAGGAHSYQMNVQVDGLDNSTSYSGGPVGYEAQAVKPSIDAVGEFKVITNNLSAEYGSRMGGTVLVTIKSGTNQLHGTAYEFLRNDDLDGTNFFANRNGAAKPEYRQNQFGGTMGGPIRKNKLFLFGSFDGTRIRSGTSSISTLPTAAQRTGDFSKIRNIFDPLTTSGAGAAMTRQMFPGNIIPKNRWDPLFPALMALYPATTNSGVVNNYYFSGADRNDWNNYDFKGDESFNDNNRLSVRYSRRDKDQYQNGPLPLPADGGLATTTTIHSNSVVGSYVRILSPNMNNEVRFGQSRMPTAFDIPYDKPLFDQYGIKGIPKTSFASSNDHGLTLFNPSGYAQLGSRAFWPNTNNLNVTQFDDVLFRSAGHHGLKVGVEYKHEDVFRVAARYARGQMTFNREFTADPQNRAATGDGMAEFMLGLPAAGNLGNENGENLMVNSLAAFIQDTWKVSSRLTVNLGVRYDIFFAPTFPDGGVSNFLLDYTQTGAAGRLPQIRPRNGSDCGCQQNYKDFAPRVGLAYRLTNKTVVRSGFGIIFAQDDTFYQQSARWINQSPDFVEYGFATVDRINPLLTLQGGFPSVTLPAASVPGPAAVGINIQASRMPDQYSQQWFFDLQRELPYDTLMTLEYSGNGARKLIVPLDYDVPYGPAASTVASRRNFPYYTGVTRQMPMGNSSYNAFVWKLEKRFSKGLSFLSAFTWAHTIDDETEISNGTGGNGAVVPWNIELNRGNSYSDVRRQWAFSAAYELPFGKGKKLLNRGRAVNAVFGGWQLASLATMRSGIPFTVVTSGGLTNAGGADRPNRTGNGTLPSGQQSIDHWFDTTAFAVQPQYTYGNSGRNILFGPVLRNLDLSLSKSIFLAEGKRLQFRAESFNFTNTPAFGQPAATLNGAGVGQITSAGDPRRIQFGLKFIM

SEQ ID NO: 13731 - protein, 800 aa, Pseudomonas putida
MNHSYRLIFNRSLQVWQAVSELARSAGKGGGALKKSALVLALSLVAGGAIAQVAVSGDVTPSSVATPIWNIGAPLSVGRDGIGTLAITTGGEVSNTGGYIGYNAGSKGTVTVAGPNAIWKNIDSLLIGFMGTGTLEIKDGGKVTNRFTGYIGANATGTGTVTVTGADSRWETTDATKSLIVGESGHGTLNIKGGGTVTSPYTQLAKDAGSAGTLHLSNEDGARGVLETAYVKKGLGTATFNWDGGILRATAANTNLLQDFAAGGVNVMAGGAFIDTQNLTVRLETAGVLAGLGGLTKLGSGTLNISGQNSYAGNTTISEGTLQFGTYNQSASQTLVIGARNATDYGKLHVTGTATFNPNANINVDVASVNTLAKDNILLNVITAGTLTESGFKVTDNSALFNFLAVRDNNSVNLKVVSNSSTGTGILGAVTGQGNVSARGAAAILDGQLNASAGGDMGNVINALGQLTNNRDVSRAVTQTLPLVSGTQAVQGALSAFQTLVQHRNGAGGSMTGLSSGDALSNKEAWGKVFGSRATQDDRNGTAGFTADSWGLGLGADAQVATDARFGVAYGYAKTSVNGNTDLSGTAQRANIDSHVFSAYGSKDIGNNRSVSFQGDVGVNSNESTRQLNFGGLNRTATADYRTYTAHVGAALSQAISLNAATTLTPSLRADYTWMKSQRYSETGAGALNLNVAAQKTDAFVISADAHLQHHFTAVSKIEANFGVGYDTINESGNIVAAYAGAPGQSFVTTGINHSPWLVRGGMGYSHKTLNGTTITVRYDAEGRSDYLNHTASVRANWAF

SEQ ID NO: 13732 - protein, 455 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVTASIATTKMNSAKYGSASERNVVPGAFVPNLYFVAPVNDKFALGAGMNVNFGLKSEYDDSYDAGIFGGKTDLTAINLNLSGAYRVTEGLSLGLGVNAVYAKAQVERNAGIIANSVNDTQVKTALSVLAPPLKGLDQNLPSKDKSVVSLQDRAAWGFGRNAGVMYQFNEANRIGLAYHSKVDIDFTDRTATSVEANVIKEGKKGNLTLTLPDYLELSGFHQLTDKFAVHYSYKYTHWSRLTKLHASFEDGKKAFDKELQYSNNSRVALGASYNLDEKLTLRAGIAYDQAASRHHRSAAIPDTDRTWYSLGATYKFTPNLSVDLGYAYLKGKKVHFKEVKTIGDKRTLTLNTTANYTSQAHANLYGLNLNYSF

SEQ ID NO: 13733 - protein, 653 aa, Pseudomonas stutzeri
MSSISRSPGRVRALSVALSLALAPLARAAPAAAVAPQESEPPVVLPEVEVRVPRAEVEKDPTASATVVTAERFEGEAKDVAQLLATAPGVSVTRYGTLGQLATVSIRGVAADGVKVLLDGLPLGTAGGGVDLATIPRQWISRIEVVRGAAGAQFGAGALGGAVNVVTRGGQVGDVSGEATAGAFGTYAASVDTVAPVGPFALFAAASGEITEGDFSYELDRTPDRPGGPVEEKTRVNNGARRAGAIAKLGGLAGGFRVDGLAQLTAGRRELPGSPYQPTPGDWQEDGRVLAMLRVAREVRPRLTLAGRVHGRRDLLDTELATLGTEPTRQRGGAIGVEVEGGLTHGVGVLTAVLSAENEGYESEALGGTRDRAGFAGALAEDLLLAGGRLRIGASVRAERTGDFAGVSAKLGAAFELARGLALRASGGRTYRVPSFAELHLEQGLLSPNPDLRPETGAGADAALVYDGALGLLSVGGHAAVYEDIITYEPASLGHFRPFNTGRAVVSGVEAEAATTPWRRALGLALSGAYTFLPTEVLRGSPGVLGNALPRRPLHRLYARAAVSPGRFGAHVQVEHARDQYLGVLNQETPLPDVTLVGAGASIRFLRRPALALHVEVDNVADDRTLVDGYGNPLPGRTWMVTLRAASSQERTR

SEQ ID NO: 13734 - protein, 456 aa, Haemophilus influenzae
MKKFNQSILATAMLLAAGGANAAAFQLAEVSTSGLGRAYAGEAAIADNASVVATNPALMSLFKTAQFSTGGVYIDSRINMNGDVDSSAIISNMIKATKDGSASERNVVPGAFVPNLYFVAPVNDKFALGAGMNVNFGLKSEYDDSYDAGVFGGKTDLTAINLNLSGAYRVTEGLSLGLGVNAVYAKAQVERNAGIIADSVKDNQVKTALTVQQEPLKFLDKYLPSKDTSVVSLQDRAAWGFGWNAGVMYQFNEANRIGLAYHSKVDIDFTDRTATSVEANVIKAGKKGDLTLTLPDYLELSGFHQLTDKLAVHYSYKYTHWSRLTKLNASFEDGKKAFDKELQYSNNSRVALGASYNLDEKLTLRAGIAYDQAASRHQRSAAIPDTDRTWYSLGATYKFTPNLSVDLGYAYLKGKKVHFKEVKTIGDERSLTLNTTANYTSQAHANLYGLNLNYSF

SEQ ID NO: 13735 - protein, 199 aa, Wolbachia endosymbiont
GPISGEVTSYYVRLQYNGEILPFYTKVDGITNAKDKEKDSPLTRSFIAGGGAFGYKMDDIRVDVEGLYSQLAKDKAVVDTSETNVADSLTAFSGLVNVYNDIAIEDMPITPYVGVGVGAAYISNPSKADAVKDQKGFGFAYQAKVGASYDVTPEIKLFAGARYFGSYGASFDKAAKDDTGIKNVVYSTVGAEAGVAFNF

SEQ ID NO: 13736 - protein, 190 aa, Wolbachia endosymbiont
  misc_feature (30)..(30): Xaa can be any naturally occurring amino acid
  misc_feature (32)..(32): Xaa can be any naturally occurring amino acid
  misc_feature (35)..(35): Xaa can be any naturally occurring amino acid
  misc_feature (38)..(38): Xaa can be any naturally occurring amino acid
  misc_feature (47)..(47): Xaa can be any naturally occurring amino acid
  misc_feature (57)..(57): Xaa can be any naturally occurring amino acid
  misc_feature (60)..(60): Xaa can be any naturally occurring amino acid
  misc_feature (71)..(71): Xaa can be any naturally occurring amino acid
  misc_feature (76)..(77): Xaa can be any naturally occurring amino acid
  misc_feature (82)..(82): Xaa can be any naturally occurring amino acid
  misc_feature (86)..(86): Xaa can be any naturally occurring amino acid
DEETSYYVRLQYNGEFLPLFTKVDGMTFKXGXSDXSPXKASFIAGGXAFGYKMDDIXVDXEGVYSHLNKNXVTDAXXTPDTXADSXTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAK

SEQ ID NO: 13737 - protein, 360 aa, Haemophilus influenzae
MKKTLAALIVGAFAASAANAAVVYNNEGTNVELGGRLSVIAEQSNSTRKDQKQQHGELRNAGSRFHIKATHNFGDGFYAQGYLETRLVSDYQSSSDNFGNIITKYAYVTLGNKGFGEVKLGRAKTISDGITSAEDKEYGVLENKEYIPKDGNSVGYTFKGIDGLVLGANYLLAQKREAYKTATATPGEVIAQVISNGVQVGAKYDANNIIAGIAYGRTNYREDLATQDKSGKKQQVNGALSTLGYRFSDLGLLVSLDSGYAKTKNYKDKHEKRYFVSPGFQYELMEDTNVYGNFKYERNSVDQGKKAREHAVLFGVDHKLHKQVLTYIEGAYARTRTNDKGKTEKTEKEKSVGVGLRVYF

SEQ ID NO: 13738 - protein, 357 aa, Haemophilus influenzae
MKKTLAALIVVAFAASAANAAVVYNNEGTKVELGGRLTIIAEQSSNTLDDQKQQHGALRNQGSRFHIKATHNFGDGFYAQGYLETRFVSKYKDNADHFDSITTKYAYVTLGNKALGEVKLGRAKTIADGITSAEDKEYGVLNNSKYIPTNGNTVGYTFEGIDGLVLGANYLLAQQRNAHGSTAGEVVAQVISNGVQVGAKYDANNIIAGIAYGRTNYREDLAAQGDSDKKQQVNGALSTLGYRFSDLGLLVSLDSGYAKTKNYKDKHEKRYFVSPGFQYELMEDTNVYGNFKYERNSVDQGKKAREHAVLFGVDHKLHKQVLTYIEGAYARTRTNDKGKTEKTEKEKSVGVGLRVYF

SEQ ID NO: 13739 - protein, 390 aa, Haemophilus influenzae
MKKTLAALIVVAFAASAANAAVVYNNEGTKVELGGRLSVIAEQSSSTEDNQEQQHGALRNQGSRFHIKATHNFGDGFYAQGYLETRFVSKASKEKADQFADIVNKYAYLTLGNNTFGEVKLGRAKTIADEITTAEDKEYGLLNSKKYIPTNGNTVGYTFNGIDGLVLGANYLLAQERDLRTLDSRTNPTKSGEVTVGEVSNGIQVGAKYDANNIIVAIAYGRTNYKDSNHSYTQKIPKANAADADTDTTIIYPHHGKKQEVNGALASLGYRFSDLGLLVSLDSGYAKTKNYKAKHEKSYFVSPGFQYELMEDTNVYGNFKYERNSVDQGEKEREQALLFGIDHKLHKQVLTYIEGAYSRTRTTSVGDKQVASKVKTEKEKSVGVGLRVYF

SEQ ID NO: 13740 - protein, 721 aa, Solibacter usitatus
MRRHGKTAMGRLLWQGTALGALAIAGAAGAQDAPVTLDEVVIEGSSPSAFVAKRARGAAKTDTRLVETPQAVNVVSTREIETRGARTVAQALRYTPGLHPEPNGYDIRYDWLYVRGFNAYGTSWLNGLVLPGDPSNYATPSVNPYALERVEVIKGPASVLYGRSEPGGLVNQVMKRPEDAARREVELGLTSFGGAQFGYDFTGPLSDQFSYRIVGQVRDNGTQVDTERDRQFMLAPSLTWRPGDATELTLYAYYQKDDPKNFNPRFYPAVGTLIRNPLGQIPRDIHLGDPALNQFNRSFRAVGYEFSHELNDTWTLRQNLRYGKARQDMLLVLVNPAFAYGAPGTVLNRASAISDDYVTSFAVDSQIEGRFATGAVEHRILAGIDHVRADSSTNFGNGVAGVPPLDYRDPVYGTVGIPVPAVTRSALQEQRQTGLYVQDQLRYGNWIGTLGLRHDWSRIETRDRMSDARYANKDSQTSVRAGVTYLMDSGLAPYASYSTGFLPLLGLDASGEPFEAQKTRQFEIGMKYEPRDGRGLIALSLYDLTVRNALTPSAENPLLNVQSGKQRVRGAEVEAKYVLDPEWTLAAAYAYSDSKVLRSGREGEEGREMLTLPRHQLTLWADYSPAAVPGLRLSAGLRAMSDYQTDVSYNPDLRIPGRGLVDIAAAYELGEVRPEWQGAAVQLNVTNLFDRTYVSHCRNATGGSCNYGAAREATLSVKYRW

SEQ ID NO: 13741 - protein, 271 aa, Solibacter usitatus
MLGLHAEENTAQENTTEENMIKENTSKDAPILLEEKRAQTLELNEEKKEVAKSVDEKSLLEEIHKKKRQLYMLKGELHEKNESLLFQQMAKNKSGFFIGVILGDIGVSAHSYEKFELLSNIQASPLLYGLRSGYQKYFANGISALRFYGEYLGGAMKGFKSDSLASYQTASLNIDLLMDKPIDKEKRFALGIFGGVGVGWNGMYQNLKEIKGYSQPNAFGLVLNLGVSMTLNLKHRFELALKMPPLKEASQTFLYYFKSTNIYYISYNYLL

SEQ ID NO: 13742 - protein, 361 aa, Solibacter usitatus
MKTSISSALKTTLKATACAALLASASSAFAQSSVQLYGQVDEWVGAQKFPGGKTAVQVSGGGMSTSYWGLKGAEDLGNGYKAIFALEGFFLAQNGQYGRFTGDTMFSRNAYVGIESPYGTVTAGRLTTPLFVSTILFNPFVDSYQFSPMVWHTYLGLGTFPTYSTDQGVTGDSGWSNAVSYSSPNFNGLSATAMYALGNTTENGAKKWSGQVLYFHGPFAATAVYQYVNFNNVPSDLGSFGTSGVPGLKSQSVAQVGASYDLKFVKFFGQYMYTYNNQQVTSWHVNTAQGGATVPFGPGSVMASYAYSRDGGGFDQTRQTAALGYDYPLSKRTDIYAAYMYDHISNLSSGNTYGVGLRAKF

SEQ ID NO: 13743 - protein, 682 aa, Solibacter usitatus
MFLNRIAALLFSVTTFTCFSQNTAVIKDTLTLHTLDEIVVTATRTMRQLSTVPMPVILISKKQIQNTGTTRLKEILLEQTGINFATDQSGFTGVQMQGLSSEYVMVMIDGVPVIGRSSGNLDLNRITVNNIKQIEVVKGPTSSLYGSEALGGVINIITEHLEKDTSKGDIRYFTRVGSRNELDLNTNFLFRKDKLSLVAGINLNSSGGFDLSPETVVKTTEAYQNYTGNLKVSYDFSKKLTLVASQRYFYEEQAERNFQRDWNSNIELRHKMNNIWDFEYTFYTTKFKTESQFNSEVAVFNQTLTRPEIRATANFKNSTVISGIGINFDALGRTFFGKKETFNSKYIFSQFDFHPIERMNVVVGARFDSHNKYKSAFSPKIASTYKINDWIQAKASVGYGFKAPDFRQLFFNFNNAAGGYVVLGTQTLHNLYGSAPNVQATSKDLKPENAIGYNFGLEIKPIANLKIHTNIFRNDIKDLINTVALPGGVADLGPTTAVFYYENRDQVFTQGIEFDINYKFSENVRFTGGYQYLEAKDKEDIRKIEAGTIFLRRTPNSPSEILKKEAYFGLSNRSKHTANAKLFYTNLKHNFSANIRAIYRSKYALFDTNNSQNIIDRYDDFVAGNTQVNVSIQKTFFGIMNLQFGIDNIGNEKGLKNKNKFQNTDAVLFLGRSFYTSVRFNL

SEQ ID NO: 13744 - protein, 1108 aa, Solibacter usitatus
MRSFVHRTSLAGLFLAALLLAPSFVLAQGLGTIVGTVTDPSGGVVPNAKVTIINEGTAATRDTVTDAQGYYVFPSLRPSTYVLKVEVPGFATFSRRGITLQADESATVNVPLGLAQAGQEVTVEANQSLVNTTTSTLSEVVDTRRIVDLPLDGRNAASLALVTAGTLLAPNANGADQGNTKTFPGAVLVNSNGARSNQTNYRLDGASNTDIYTNVNQPFPNPDALQEFSVQTSSYSAKYGGNAGGVVNIVTKSGTNDVHGTAFEFVRNADFNARNFFAIKRDPLKRNQFGGTLGGPVAIPRLYDGKNKTFFFVSYQGTRIHTVGNTSSEYVPTTAEMNGDFSAYLTASNPANALGKATQIIDPLTGTPFPNNQIPTSRFDPASVAFTKYLPIAPTGSGLTFYTLPTIQDFDEATVRLDHAIGSNDHLSGRYFYDRFNNVGFLDIANYPAQSADAIINAHNFMLNETHVFSQSFLSDFHASVIREVAARGPAGGSIDATQLGSKIWQAPGDHIIEGLSVSSFFSVGQSDPAAFTRDQYGLNEDLSLVHGKHSMSFGASALRAWVLIRNQFHQPGNFGFTADVTNLSMASYFLGYLRTFLQGNGEFKDNRLNTFGLYFQDDWHASRKLTLNMGVRYDPFYPWKETKGRVEIFSPSAYAAGVTSSVFTNAPPGLLFPGDPGVPQYGNKPNYKNFQPRFGFAYDVEGNAKTSIRGGFGMFYDSLQNGIYNNRFVDTSPFSVQVNLNPVNPNPPISSYVTFSNPYQGITNPFPAPYPPPKNIAFPLPDLAASYDLGHGGVYQTPVTYQWNVSIERQLPGNWMVRGAYVGSHSSHGMENVELSPNVYPTGKHLYPQYSDIAMVMNDINANYNSLQLTAQKRFSKGFTILANYTWAKATDDWPYGQDITTVVAGGNSPIPWNMPGRHQYDRGPADFDRTQRLVASFVYQTPALKRSSAVLRYLAGGWGVNGIFTAQTGSPFTPTYGKDASGTALSTDRPVLLDSNVYGSGACGSQAPCVDWLATSAFGAPAVGTYGNIGKGALRGPNSITYNGGLTKDFPLTRERMKLQFRAEFFNLFNRVNLNNPASSLTGAGFGRITGAGDPRIGQLALKFLF

SEQ ID NO: 13745 - protein, 870 aa, Solibacter usitatus
MSKPILKKRQRTTLAALLLCTAAATHAATQSPALAFDLPAQPLDAALRAYARQAGVALSFDAREAARKQAPALRATMTAQAALQHLLRGSGLTWRAAGANRYAVVRAADAAAAWPLEPVRVYGDATRERVYTEQEIAATPASNRDLSALIATHPAIRESGTAEDGANRGTLNVEDISIHGASPYQNLFLIDGVGATSRVDPANKSRNFTDVPSNPQAYFLDTALLGEVRVFDNSIPVEYGAFNGGVVDARLRRPSGENHVKLDYRWNGSNLTRQKIAPGNAEDWLQGTPDFTPSWRKRFHTASADIALGERAGLVLGLSRRISRIERWRLGAVGHLDRPERDDSLDRVDNLLGKFSLRLDADTITDLSLKYADRREHLVSNFFRDTDWRNRHGAQGAVWNIEHTLRGGKLSAQLGWDRFDSHRNSAHTEFVQHDFVDGRPGFASGGYGKDEKGQRNLTLATRLDLAPIQTGPVSHASYVGLQVEHTGARFKRYNQSYSYRAVHREDGTEKHFSKVRHLPGSVTLDYTRLGLYASDELTWRRWTLNAGLRYDRDNFLHHRTLAPRARLDWDVLGSDDTVLSAGWSRYYGGHVLKIAMQEEFSRLSEQVLDHHGDPVPNGRKITRVNYDGLRSPYDDEWAFSLAQRAYGIRGVLTFVHRNGRDQVTRRGDSRVGYRYTNEGNSRTDGWNLTLANEEAWRLGETLWHAQASWGYQRNKRNLNLAEGYESSPVERADYVYYNGKRIPAANLPPSSFNLPHKVSLDLTGHWPRHGLTWSNTVNWHGRRKEIAFVDTGPAPEYLDMYESLSAPSYWSWDTRLIWQPPFARQVTLALDVLNVLNRIAALTTNPRDSLIDARRYRTGREIWLQVGYRY

SEQ ID NO: 13746 - protein, 697 aa, Solibacter usitatus
MQRRMLATLLLASSLPLQTAYAQEETNKTTAQKDEDVAELNAVQVQGAEVSGPEITTEKLLKVPGAGNDPLKAIEALPGVVLGGFGPFSIPAIRGSSPRDNIYITDFIPVGYVFHNDGNSTYNANLVENFSLKAGAWGPEYSNAIGAVLATKLRDPYREPLTTTLDLSFLRAGAMIEGALSEDSAFYLSYRRSLLEFYVESFIDEDELTFTEVPRNSDYQFKYHWQPTATTNVRLIATGAEDSVGIEFGPENDALETEPALAGGLDADTYYHSQGILVDTLFDNGTSSMFSLSRKEEKTDFVVGTLFDLDAVNYEYRFKNYYNTPLDNGDTLRYGFDLSQTDIDYTAAGLYSPCNDEIGETCDPASLGEPFGPLGEVLTINGAYSFIAYDWFATPLWEITLGLGNSYNDFNEQNIVQPRLSTRYELNPAWTLTAAVGRHSQFIREFRFIADELGNPELEQPDAMHYVVGFEHEIDESLSSKLEVYYKDIDKLVATNPAYTYDPNNTNNPEQPYLNEATGEAYGIEFLLNKNLTDKWYGWFSLAYSQTKRTNEITGKEIDFELDRPWIVNLVASYQKDERTTYGFKWRYQSGSLITPVEGAIPFDEDGNVIAGNPDPETVYIYDPIEGEPNSERLPAYHRLDFRMDYKLSARSDFYFEIINLYNRANVSDYSYNKDYSEREKVESLPTIFSVGAKLVF

SEQ ID NO: 13747 - protein, 825 aa, Solibacter usitatus
MRHTRGEGVSPKTRRTVISVAVAAGVFHGAAWAQEAGTADAAAAVAAPASSAVAPASSASAAPDGKVQVQDRVVITGSRTETRASKSLTPIDVIGGDQLRATGQTNLRDALVKLSPSITKTSYSGDTGVLTDTLSLHGLTPDHVLVLVNGKRRHTTANITLDPGLNQGSTGVDIDTIPVGLIDHIEVLRDGASAQYGSDAIAGVINIILKRNTHGGELATTNGQTYSGDGFKTSESATIGLNIADKGFLDLSAGFDRQNHTIRTGPDDYFGRFPQGQGYYNPILGDPSSSRETVGFNAGYYLGDDVELYGFGTYAHRNGDAYQNYRPPSVLPQVYPNGFVPVETINENDYSVTAGVKGKNLFGWAWDLSTTYGGDYSVFGMRNSANTGLYAASGFTPTTFHLSTVSNTQLTNNLDLSRAFNVPLLPAPLNVAVGVEQRRETYTIRNGEQASWIDGGSAALPGLAPVSASDISRNVIGTYVDLSTYLTPKWQVNLAGRYEHYNDVGDTTNGKVSTRYQFSPAIAVRGSVSSGFRAPSLAQESYTSVTTSPASVGGILATTSPGARLIGAQALKPEQSTSYNFGLVLNPVRNLQLTIDAYQINIRNRIVLGGTASGAAAIAALEGAGLSVPGSVPASAVSASYFTNGANTRTRGIDLAGTYHTGFGRYGQVDWDFGVNLNTTSVTHVANGSNGKPSLNGQQIASLSTTTPKNKIIIGGTWRLDKWAVTLHETRYGKTSGEGTYFVGPNAFSTSQFVHYEEAARYVTDLEVRYDVTKQFQIAAGAQNLFDVRPSKLPFETQLEGIQYSGGSTIGVNGGFYYLRARYLF

SEQ ID NO: 13748 - protein, 871 aa, Solibacter usitatus
MRLLIVRCLFISALFLASTALLAGDSAPGDPQSSGGNTGAIEGTVADPTGAVIPNATVTIKNPVTGYTAKAATGNDGSYIFRNVPFNNYHVTAEAKGFTAAVADAEVRSGVPFAMNLTLPIAAAATTVDVQGDAGDLVETDPVSHTDVDRGLIDKLPVEGSSSQLSSVITLSTPGITADSNGQFHPLGEHADTSFSLDNQPMTDQQSKVFSNQISTDAIQSMEVISGVAPAEFGDKNSLVVRVATRSGLGLKQPTGSISTTYGSFGTSTTSFNILQGNDKLGNFFSVSGLNSGRFLDTPEFMPLHARGNSQSGFDRADWQAGTADVLHLNLGFTRSWFQIPNSYDQQFAQETPQDQRQEIKSLNVSPGWTHTFNNNTLLATTAWFRQDQVGYYPSDDILADQPATLSQSRRLTNTGIKTDVSYVKGIHNFKAGVQFEHTILGESFGFGLTDPLYNALCVDSSGLPVVAAGVMNPGACAGFSTGYAPNPGFDPNLLPYDLTRSGMLFNFVGHADVKEESIYAQDAITLGKWVLNLGVRGDNYNGISSGHLLQPRLGVAYNVNKTHTVLRASFGRFFETPYNENLVLSSATGAGGLAQGGEAIPIQPGHRTQYDAGLQQAIGKWAVVDAEYFWKFTKNAYDFDTLFNTPLAFPIEWKQAKIDGFSARVTFPTYKGVTAYTVLSHTRARFFPPENGGLIFNSDLSTTPFRIDHDQAFGASTNVQYQPKKDAPWISFTWRYDSGEVAGAIPDFATALTLTGDEQAQMGLFCGDVFAAPGAPIRSCAAGIGATRVVIPAAGTYDADKNPARIASRNVLDMGIGWDNIFHADRYKTAVSFTVANLTNKDGLYNFLSTFSGTHFIPPRSYTGQVSWHF

SEQ ID NO: 13749 - protein, 741 aa, Solibacter usitatus
MRHHVKCALLAGAAWGVLAGASTAQDAEAAAQAANAGQANMVEDIVVTARRRDEQLKDVPVAVSALSAERLEQTGATNITALQQQTPNATVQIARGSNSTLISFIRGVGQQDPLWGFEPGVGLYIDDVYVARPQGAVLDIFDISRIEVLRGPQGTLYGRNTIGGAIKYVTKRLGDDPSLTARAEVGSYNERNFLLSGSVPVGDTFAIGGAVATYQHDGYGENLNTGQDQYDKDVTAYRASAEWTPNDSLFFRLAWDRVEDDSSPRHGHREVNSTTGGYTPPANEYDTYAGITGEQKVVTEGVSLTGEYRVNDMLTLKSITAYRSGDTETIIDFDQTPLPTLDVPAIYSDDQFTQEFQALFTGDRWSGVAGVFYLDGTSSGAFDTIAGNLGLAIAAAGSVDTKSFSVFGDFSYDISDRLHVSLGGRYTKDDKDASVLRLFYLGATPTPYTGGVARPIFATRTDYTASDSFEKFTPRASISYDFSEEITGYASVSQGFKSGGWDMRGDAALVPQTVNGYQPETVTTYELGLKGSAFDRRMNFASAVFYSDYKDQQITTQQVATAPAVGIASVVDNAGASTIYGFELEGSAFLTDDITANFSLGYLKNEFDEFITRITGTPVDISDTREPQNSPEWSAYYGMTWRGDIMGGEIRVTPSLSYRSDYHLFDTPDPILDQDGYVLADASVVWIAPSKQWEVGLFGRNLTDVRYKVGGYSFPGATYNNSISAFYGPPTTYSARLTYRF

SEQ ID NO: 13750 - protein, 178 aa, Solibacter usitatus
MLRDKFIHYFQQWRERQLSRGEHWLAQHLAGRSPREKGMLLAAVVFLFSVGYYVLIWQPLSERIEQQETILQQLVAMNTRLKNAAPDIIAARKSATTTPAQVSRVISDSASAHSVVIRRIADRGENIQVWIEPVVFNDLLKWLNALDEKYALRVTQIDVSAAEKPGMVNVQRLEFGRG

SEQ ID NO: 13751 - protein, 382 aa, Solibacter usitatus
MTNRKSLAMVIPMLLAASNGVNALEVFHKHGNKLELYGSINPNHKLNHSFLANKITSHKDDTNAILGLSGEVNIADELFSYATIEYGIDLSVPEQLLDKQQPNNLRLGYAGFKYGNWGSIDYGRNYGVLHDVQALTNRSPYINKDSIFSYNDNYMTGRSNSLLTYKNDDIFGLIDGMSFILQYQDQSENRAQNQTNGPGWGISIKYETDVGLTAIGSCFSSQRFQSDKSNQDNKLTPSVGAYGLGFKYDANDIYIAAFYGEGRNLTPSLNILSDNNASKDQPYINKTQNIEAIAEYNFHSGFHPSLSYLDSKGQNLNIKDATTVPKNLELAKQINISTRYEFNKNISTYMNYTINLLKSDNVIKEQNIPTDNTIGAGIVYHF

SEQ ID NO: 13752 - protein, 360 aa, Solibacter usitatus
MVAAAVSTALLSAGANAYVLGTENTGNVEVYGVVAVSAYGHTGDDVNVTDYKIENETRIGFRGSKQMTDGINVIFQVESGYTDVDDWAGGGLGFRDTFVGIEGDYGKITVGRQLTPMYEVVDWPFTNPGLGRVFDPAATGDIAYMYDRTESIRYFVPAMGNLNINVATGRAGSGENAHWFGGAAKYKAFDAITLHATFEYGNNRKVSDAVTAGFEFDPTTGDKKVVAAKDGVVTDTFTYLVGFEAPIASTGISIAAAYKYGQAENVATKNVDSQGSYSVVAQYWNGPLGIKLGYAATEDVESDDNSNVSKGASVTSLQVMGVVNGFVPYVRIGMTDQLGWGADPLEDQEIFARVGLEYGF

SEQ ID NO: 13753 - protein, 400 aa, Solibacter usitatus
MTQYSSLLRGLAAGSAFLFLFAPTAFAAEQTVEAPSVDARAWILMDYASGKVLAEGNADEKLDPASLTKIMTSYVVGQALKADKIKLTDMVTVGKDAWATGNPALRGSSVMFLKPGDQVSVADLNKGVIIQSGNDACIALADYVAGSQESFIGLMNGYAKKLGLTNTTFQTVHGLDAPGQFSTARDMALLGKALIHDVPEEYAIHKEKEFTFNKIRQPNRNRLLWSSNLNVDGMKTGTTAGAGYNLVASATQGDMRLISVVLGAKTDRIRFNESEKLLTWGFRFFETVTPIKPDATFVTQRVWFGDKSEVNLGAGEAGSVTIPRGQLKNLKASYTLTEPQLTAPLKKGQVVGTIDFQLNGKSIEQRPLIVMENVEEGGFFGRVWDFVMMKFHQWFGSWFS

SEQ ID NO: 13754 - protein, 718 aa, Solibacter usitatus
MRIGIISGVLGLTVVLPAHAQKSDSIKSLLLPDVVVTESYQQRQAKKSALAVDVVDQDFLRKHFTGNFMQAMENIPGVQTMDIGSGFSKPMIRGMGFNRIAVLENGIKQEGQQWGADHGLELDAFNIGTVNVLKGPSSLLYGSDAMGGVIDITSPPVPSVDMLFGDVTLLGKSVNGTLGGSFMLGIKKSFWYAQVRYSEQHFGDYRIPTDTIVYLTQKMPVYGRKLKNTAGIERNIGFFAQYQRQRYKANYSVSNVYQKTGFFPGAHGIPDVSRVEDDGDSRNMELPYSKVNHLKVTTLQQYAWEKLVLSGDFGFQNNHREEWSVFHTHYGSQPVPEKDPDKELAFNLNTLSASVKVRFIGSSSWEHALGWDGQHQRNDISGYSFLLPEYYRSTTGLLWLTTYKPNNVISVSGGMRYDYGYIHISSHEDAYLADYLRKQGYDEEQVEHYKWNSHAVKKKFGDYSFSLGLVWTPSERHMVKANVGRSFRLPGANELAANGVHHGTFRHEQGDTNLKSEQGWQMDASYNLRYNGFSISVSPFVSWFSNYIFLRPTGEWSVLPHAGQIYRYTGAEALFAGTEATIDIHFLRSFNYRISGEYVYTYNCDEHIPLSFSPPFSMRNTLTWQRKQVMLYAEWQSIARQNRVDRNEDRTPGANLFHLGGSLNIPIRGNQAIEITLTARNIFNTRYYNHLSFYRKVEIPEPGRNFQLLIKIPFKKLL

SEQ ID NO: 13755 - protein, 1073 aa, Solibacter usitatus
MGTANRLSAGGGRNSFTTRLKYGASMLALGALVVGAPAMAQTAKSENQTVDEVIVTSIKQSLKSSQQLKQSSEIIGDSITAEDIGALPDRSVTEALQRVPGVAINRFAASVDPDHFSVEGSGVVVRGLNFIRSELNGRDTFTANNGRILSFADVPAELMGGVDVFKSPSADMIEGGISGTVNLRTRLPFDSNKRILSMSAEASYGDLVKAWKPTYSFLYSDRFETNIGQVGVLASFVHSELSSRNDAIQISNFGCRTNLGQAVSNCGNGTRGVWFPRGAAMRSTENDRKRQGQALALQWKSNDGTMQAAFQYLNSKSQTRWTERAIEIATDNVAGNGDSRPAAGTTFSFDEDGVFTKGVITGTTGWRSDQFTSDPRTPIDGLQSNNIRRDENNTNQTTDYGFNFRWTPNEHWGVQFDAQHVDSKVDALSMGIWGSSFQNAAITLNGNKLPDVNFTAPGNGTTPSNCAPFNNNCPSYARGANGNLAAAYNSFWRSAMDHFEKSDGTEDAAKIDVEYKFHNDTWFDSVKAGVRWSERDQTTRFSSYNWGALSEIWGNNGPVWFDDPINGNPAVAGGDTSVGRVELYGFDNFMRGKIASPVGDGRLFFSRNTADNYDLVSKFALSVGDEWRARLAGNCPQNWVPSAQRCGVIAGTPFRPQEINPVNEVTKSAYLMTRFKGESGDLQISGNVGLRYTKTTRQSDGFLAFPIATGLSTDQECVAQFTEWQGRPEPKAPFVPSSFCSLTPQVRAAARAWQNGATVPSSVKTSFEYWLPSLNLKVMAPHGLQYRLGLSKTMTPPDIGLTRNYYNLALNTNFDGITNGQPTGNVTVGNPYLKPTTSKNVDASVEWYFAPVGSLTLALFYKELNDVAANTTVRLPFTNNGATFSALVTTPGNSDQTGKIKGFEVGYQQFYDFLPKPFDGLGVNANFSYIESKGVPQSTLSATDPDVGAGRVTTVDTSKLPLQGLSKYNANLAVIYEKNKVSARLAYSWRSDFLLTVRDVIIPYAPIMNEATGQLDGSFFYTVNDKMKIGVQGVNLLNETTRATQVLNSDLLKTGRSWFMNDRRYTFVLRASF

SEQ ID NO: 13756 - protein, 494 aa, Solibacter usitatus
MSHFTRSRTWVSLAVFAACAPAYAEQETLVITSQQSQLPEVATATRTATPAKLVPQTIDSLSAEELTAFGAPSLSEALAGVPGVNANGDTRFDGINIRGFSASNDFYLDGFRDDMQYTRDLGNIERIEVLKGPAAVLYGRGSTGGIVNRVSKVPHAGDAASVSARIGSHDYQRLAADLNGEVNQQVQVRLNIAQEDYGSFRHGVEGKRTLLAPSLNWDINDDVSWLIQYEQHSHNRVPDRGIPAVNGSPAEVPASSVYSDTSRDFIDDDVATTRSRITWAFHPEWQLRQQLSYTKLDSQFDNTYVARVSGDQVTRQRFQQDLQANNLISNTETEGTFNTGPIAHRILIGLEQGWQERSPKLYRNANSIPSGNLYQPESLPTYNGPMSVFSDATHKVRSYGIYVQDQLQWGDWIVLAGLRHDDFTVTTHRHDTNKEETISSNSLSPRLGVVWTPVQEHALYASYSQTYSPVGGGVIGITPGDKHNHLDPEHSRLY

SEQ ID NO: 13757 - protein, 400 aa, Solibacter usitatus
MKIRTWIAAGVAVAAVAPARAQSSVTLYGTVDTGIIYSTNQQFTRADGSVSGAHAWQMGGGNLVPSRWGLQGVEALGGGLKAVFTLEQQFLSASGQALQGGAAFSRQAWVGLRHDAYGTLGVGRQYDSYTDTLGAYASSNSWATPYGAHFGDVDNLNAAFNFNNEIKFTSADFDGLTFGGTFSFGGQAGDFSARRGYSVAAAYNRAPISFGIGYLNLRQPLDAALGGASGYIGDFACSNAGAMYCQLQDAASMQAFGVGGSIALGDATIALAYTHTRLDDSAYFVTAAHPQRASIAFDIAELNATYAFTPMLRGGIAYIFNNAKADSRGTTRFHQFNVGANYSLSKRTALYAVAIGQIASGRGLGGDANGDPVNYAQIPVLANSHSGRQLAMMAGVKVDF

SEQ ID NO: 13758 - protein, 773 aa, Solibacter usitatus
MKSSNYSKLSLGAQAVAAALVFSSPALYAADTKNETCDKDILAKCKPAQTDESIERIRVHGVQNSVYMFNNSADKRRMAALVDTPQVITVLTQDQIQESGNTDLKDILSAQAGVTLGTGENGNAFGDRYIIRGHEARSDVFVDGLRDPGMTTRESFATERVEITKGPSSTFAGRGSSGGAINSVTKKASVAYDFGRVDLGIGTDDHTRLTVDYNLPISDKVAVRLNGLTAEEDKPGREGITSERQGVQLSGVYEATDALSFTADGYYLDAKDVPDLGSYFDRDTRKPLEDIPVYAQDGDFLNSKVTTFTLRTEYELNDSITLYNATRVGHTENGYITTGMGGTTRADTDPTAPGASTLTLSTHQGNQDVDYVSTQFNLFWNTQALGFDHKLVFGLEYTDENVDNGVYSITNNNDGNCLTEGRRGVSEAYCIIDGNGNTVDNIGQLMNRSYVDGGSDAIYDIETVSAYMMDTVELTDQLALFFGFRQDSFDYSNNTTGRDGEVDYAYSDTMYNGNIGLVYDLSEDANIYANYSTATNINGGESDLGANCGYGGICGTQEQAAEADAEIVENLELGTKWMLFDDKMMFSASIFQITKSDVMESVGDSYSTLGTLNTGKNRVKGIEFGMVGNITDKLSIQFSAAKMDSEILESYNPANIGLVLSNFADESAYLQLRYELTESFVFGGSYTYQSEMYGGQPDTAAGYDSDNSRYSIVVPNYQVVDLFASYNATEDLTFRINVGNILNEEYWTAAYRSGSFMYLGDARNAKLSMTYEF

SEQ ID NO: 13759 - protein, 884 aa, Solibacter usitatus
MRTFAVARLSRTGLSLSISALLASGAAMAQSTTTDAGGGSSSSSAAAIAPKQLDQVVVRGEYIPEPMLQTSEVASFVTREDMERTGDSSAAVALTRVTGLSLSRGKYVYVRGLGERYSSALFNGSPLPSPEPMQRVVPLDLFPSDVLQSVTVQKTYSADYPGEFGGGVIDLQSMAVPEKPFFSLTVGGGANSVSTGEKGLTYYGSGDDEWGFDDGARKQPGALRDAIATGRRVDLGSFSREDIRRIGRSMNNANLYVLQEKDSIDPDVNVGASAGYSMDIGEAKLGILAVASYDNEWRTRTGKQQDGIFTGNTVEFNSNYDFATTRNNVRSNGMLGLGWEYGRHTIGWTTLYVHDTLKVARSRAGRDELAGFDVRDDNTEWYERQLINNQLRGTHAFGEYDDLKIEWRAALANASRDVPYETGIRYELLDGYWAHDASRVQNYTRFSKVDDKVASGGVDVTWRLPIEHDLTVKGGLAYLDNDRTAWNREFRFLALDGPLPFYNQYQRVDYLISDYNLSNDFLRLRETTGSFGAAAYDATLKVKAAYLQMEGEIVPTLRATVGLRYEDATQAVHPYDIFSGTRQDSVAPLENSYALPSATVTWNFAENQQLRFGASKTIARPQFREMAPQQYLDPDIDRQFFGNPFLVDSELVNLDARYEWFFEPGEYVTAGLFYKQIDKPIEAIVNDAPGGGIVQSFINAPEATLYGIELEAKKYLDLPIAANWWGDNRMFVSGNYTRTKSEVSASDGDTVQPFGFAAPVQATLFVRDGSTLQGQSDDIANLQIGVESESTNSQATLIANYVGERISARGRPGQPDYIDKPGTQLDLVIKKGLVWSGNKLSLNFAARNLLKTKYQEYQSRGGNRVDLYEYQPGITYDISVTARF

SEQ ID NO: 13760 - protein, 692 aa, Solibacter usitatus
MKSLQTVAGKRAKVYLSGIWLLPLCGLSNLAMADSADNIERLEVRGRQINTLGHSTSASEGIVGAAEIESRPLLRTGEILEFVPGMIVTQHSGSGKANQYFLRGFNLDHGTDFNTRVEGMPVNMRTHGHGQGYTDLNFLIPELLGEIRYAKGAYYPEVADFSGAGAAQIQLADELAYRQVGVTLGEYGYQRLVATQDMKTEVGRFILGTELQTYDGPWSDIKEDISKINVVGRYLTKLNGGDFSLTMMAYDNNWNSADQIPARAVESGLIDFYGSLDTDVGGEASRYSISANYDAGNWQANAYAIRSTMDLFSNFTYFLNAPINGDEFEQVDERTIWGGDIKRDWQMSLAGTQINYSLGADVRYDDIGAVGLYNTKARERLSTVRLDEVQELSTGLFGKLEWLPADQWRLNVGLRYDYFDVQVDSDNPLNSGDASDGMLSLKAGASYLVSDNLELYMNAGQGLHSNDARGATIKVDPVTGDPVEKVDLLVRSNGGEFGVKYYDRDFINFSAALWYLELDSELLFVGDAGNTEPSRASERYGVEVTAYYWLNDDLSLDMELAWTRARFTENELDEGKYVDGAVPFVGSAGITYRPDGDGWYTSVRLRYLGERILDSFDEHKADDTTLVNLALGYQLSGFDTKLELLNIFDSKDHDIDYFYESRLAGEPAEGVEDLHYHPVEPRMVRVSVSYRF

SEQ ID NO: 13761 - protein, 1088 aa, Solibacter usitatus
MSKKSLLSYTTTVAIIVFSTHFNAYAKSLSAGKGEKKIAPPQESYENIYAFDGGKIYGKDLKITGLPIQEGSIIKDISSAKAENPGSMIELEGDTTIKNVAIGLWAKESSTIKMTDGSIHVKKLNIHTPIGIEAKSNGAIALYNVKIKASDQDQSTKTINENEIGDGIGASLKNGGTLKMIGGSIKANHLGVVLEESNSDKNELKNVTIDLMDLTNTATESIGISAIKTSKIVLKNVTVKHARTSIYASDNSQITISGGSIQGNHTGINVEKESVITLKDNVEVLSNGHGLSANGLQSKITMIGGTLNTAGLQPAVLAGSGGQINLTDVVVHTDDNGTQMQEPEMKDALLTTQGLQAQYMQSKITMIRGSITTTGLNPAVLAGSGGKIDLTDVSMNAYNVGLQAQGEQSKITMIGGTLNTTGLQPAVLAGSGGQIHLADVSIKTNDIGLQAQNDQSKIIMKRGTLIKTGPRSAIFATRGGQISLLSAQVHTDSVGLAIRGKQSKITLKDSKVLANIVLVGRPNEGDPGEANVIADHSLLEGGARNSKKNPTQTIFSLINGTTWYLKASTKNDIRQQADLIKKLHSEVFMLNLNNSTIVFKKPREDHYQTLHISSQTPNIINDNTTNKTVYTATGDARIYFNTAWSNGLPKDQQKTDRLLVHGDVSGSTTIHFSNLSKSEPSNIENTIPLNMRGLSLVQVSGKANENAFKLANGYATIGGLPYKYTLNAYGPTSSHGKASLEQSLVGEEQNFWDFRLQSATLDREAKIKALVPQVASYLVMPNALFSAGFTDVNNQNALLNDMQTALFAPESHKKSGIFLSSYGNKITLSSNRNPLQYGYGADVQHTALQAGIALAGLEKQNITTSLGLLGTYGKLAFTPKDIEGAEKSTIDKWSFTVYGNIQHNNGIYLDTLFSYGTLKGNITTAFIGNTTQLNKTKTLSASATVSQKLGTGVEGLVFEPQAQFVYQRLMFEKLSDIDGFEVNMGKPHQWLLRFGGCLIQTVMPVERNHAVSFYGKVNFIKAFSDNGTIKIGDTFHRDSMGSSLEGGFGVNAQLSQNIALHAGVNYQHKLQKAGISAINFSGGIHYGF

SEQ ID NO: 13762 - protein, 1199 aa, Solibacter usitatus
MKFSTILTFLSGTTFVYPAAFAQSIIASGNILPGIPAPPLALWQPANLRVGVNAAGTLSITDGGMVAGPGQALLGSAVGSSGTVMVSGNDSLFSTVLQMHVGSSGTGTLKIEDRGTANIGTFLYIGRFIGSDGLVTVSGAGSRLTNGNMMQVGSEGTGALIIEDGATVNSTNVTRIGWSSTGIGTAIVQGSGSSWTTNNSMSVGFGGSGRLLIVDGGAVSNVEGFVGRETGSTGEVTVSGAGSSWSNSAALEIGSFGMGELMVEDGGALSNTDGRIGREAGAIGTVTIKDAGSTWSNTGTLYIGDLGKGTLTVADGGKANIVASFVIGRQAGAEGLVTLSGAGSSLINTSSTQVGGAGKGTLIVENGGVGQSNNLSVGVSSGSTGSVAVRGADSRWIAGSILTIGASGHGTLTIEDGGSVTSTLTTIGSNTSGLGEATVSGADSTWTNSGALIVGALGNGTLTVSDGGMVSNATAGIGVGTGRQGVALVSGAGARWINSGDLTVGTNGSATLTVADGGHVSVGGGNGIVHVAEAATANGVVNIGAAAGSAPVGAGTLGAAEVRFGDGTGRLNFNHTDSAYLFSPVITGNGALNHYSGTTILTGDNTYSGSTMIAGGVLQLGNGGTSGSVTSDIQIDSTGTLRIDRSNDWTYAGILSGTGVFDQLGTGTTMLTGNSAAFNGTTTVTNGRLIVGMGGAGTLGGMVNVLDGATLGGSGTVGSAGADVTILGGGVHAPGNSVGVQTIAGNYVNYGTLRIDGTPAGTDMLIVQGGVDITGATLDLQLSPPVASGWNIINGPFTIIDKQSAGAVAGSFGAVNNNLLFLDPYVNYAGGDGNDITLDFVRNDVAFASVALTPNQIATGRGIGTLPYGHPIWNTIALMSDEVAVRRSFDFLSGEIHATASSVLLEESRFPRRAVNDRLRSAFDTNTDTAFWAHGYGAWAGWQSDGNAASLKRDTGGLLLGLDGQLGNWRTGVMTGRSWTGVTVADRASTAEAGTWYAGLYGGTQWGDLGLRLGLLHGEHDIDTRRTVAVPGLSGTLRSTHGASTTQAFGELAHTLHFGIVRYEPFANLAHIHTRSNRFTETGGSMALAGRRSTMSATVMTLGQRIEAAHVFRGTGIRTVGMIGWQHVWGDVIPRSTHRFSMGDPFTIAGTPLARNNLLVEGGFELSLGRRAAIGASYTGRFAHNGHDHAATAVLRIGF

SEQ ID NO: 13763 - protein, 694 aa, Solibacter usitatus
MTPRRKCPGPDMSRALLFAATAAAALAAGAAAAQDRGGEREVREVVVTAAPYAVTLDSATTSVDILKRDELDQAPSGGLGDVLAGVAGVRSSAFGPGASRPVIRGLSGPRVLVLSNGLGQVDASALSPDHAVATDPQEAERIEVLRGPSALAYGGSAIGGVVNIIDDRIADAPVPGVEGRLLASGSTVDEGWTASGALRAGVGNWILSLDGVRRQTDDYDVPTSPESRRQVEAEGEAWGGPVGSTVENTFTELSAYGAGLSYVGERGYLGVSVKRTETTYGVPGHAHEHEHEGEEPEDDGDEHGHEEGAVAIDLEQTRYDLRGEYALDLGPFEKVRFAGGYADYTHQELEGEAVGTTFSSEGWEGRLELIQPDRGGWQGAVGVQALRRDFEAEGEEAFVPPTRTTELGVFTLQRYDRDRWGVEGGLRLETRELDSTVGKRDFTAVSASLGGFVRPADGWFFALSGSRTERAPSQEELFADGPHPATRAYERGDVGLDSEVSYTLDFTGHYGRGRWDVDAHLFAARYDGFIDLLPTGETDEDSELPVHQFVQTDATFYGAEIEGSYRLWEEGARSFRLEAAADYVRGKTDLGPPARIPPWSVAGRGVFEGGWWTGRIEVRRVGDQDRVAALELPTDGYTMLNAGLTFRPLKDPGFKVFVEGRNLTDVEAREHASFLKDIAPLPGRNLRVGVGYRF

SEQ ID NO: 13764 - protein, 431 aa, Solibacter usitatus
MRHYILMTVMLAASAGAQSTGQRWNLYWQATSIGQYHPGFDALYSGVNSLAPHSEAEASLTSTLFLGLRFSPNTQFYFDPELAGGRGFSGVTGIADAPNGELPRVASAAPKPYVARLFVTHDFGFGADRETVEADANSLGGTRPMTRYSVTVGRFTVTDFFDNNRYSHDPRTQFMTWGTMYNGAWDYPADTRGYTWGWVHEFHTRHWSARYASVGMPRVANGLRFDRRILVNRGDVAEIELRRETSGHPGAVRTLAYLNHARAGTYRDALQMALPDVTASRRDGTRKFGFGMTADQEITKDIGVFGRLGWNDGKTESFCFTAIDRLASAGVSVIGQPWKRPHDTFATAVTVAGLSAVHAEYLARGGLDFLIGDGALTYGKEIVSETYYAAQVFSGGFVTLDLQHVTNPAYNRDRGPVWIGSLRLHLEWGKR

SEQ ID NO: 13765 - protein, 600 aa, Solibacter usitatus
MQLIFMVLALMAVVPAWGDQAEDELTKLGFFTEKISDAPAPSPRPASRIAENVTVITAEQIESLNVHTLAEVLNTVPGIQLEQVRTPGSWSFFNIQGAISKHIQVLIDGVPQNDLVENAPDLGMISVQHIERVEIIKGAASAAWGQALGGVINIVTKSPEADKAVAGSVFSSYGQKSTSDMRGELSGTINRFGYYLSGGNLHSSGLVADNQINGNNAYGKITYDFPAKGYLTLGFDYRGAVRGLFSSSEFDVKDSDSSSYGYSFLNFVYPFHNRLKLDLLVRESRKTHEYFAHTYAGVLLGDFSYTARERTRGTSAKVTWGDSWRNLVVGVDYQHDTVSQRVTLLQADLDERVMDRWGIYTNGAYTIGDLTILPGIRFDDTGIDSNLFSYTLGATYQLTEKTVLRCYGAKGYSLPNALRVKPPEQVWTAQVGAESSQLPYVWLKGTFFYNHLWDIDNAYIPDLKQAVRQGGELEVRTVPLYGLFFTAGYTFTDARNRETNERIKTVPVHSAKLSLQYDDSHTGLRGVLTGNYVRWNAVPENGARDASVLWDLSLTKSISLREYAPELFFTVHNVFDNSQYQLFMLENTGRWLEGGMRFKF

SEQ ID NO: 13766 - protein, 1011 aa, Solibacter usitatus
MQMKSWRSMMLGTTVLCALGAGPALAQTADDATVEELVVVGSQIEGSKITAPVPVTVVGEDQIRAIGATSGDDLFRSIPQMGDVNFNSAYLPNSSNSARGDVGSVNLRSLGVGNTLVLLNGRRVVAHPTSRADENLVPVLTYNTNAIPVGGLKRLEVLRDGAAALYGSDAVAGVVNTVLQDDFDGLQIDAQYGEAEGTNLSETEFNVLAGKNWDRGNLTLFLNYTDRSSLRAWDQEYTASSDRRPLFVGTRFEGAGSLDSRITQTPWGSLQTLGNVGVRQNGTLVTSSAGAFHTQPTGWDGCRVSLGSYCIDDAAPATSGADRDLRYNQATYNTSVIPEVERFNSFVAGNWDLTDDIELFGEMGYYNAVSHSVQGPTTTLTSLPITVPASNYYNPFGPSVFANGQANPNRLAGINAPAAGLPVVIRSYAFVDVGPNEVDVNLTQTRSLLGLRGEKLGFRWEGAFVYSRAKAKDVSDGISATLLQQQLALSTPDAYNPFNGGDPANPSIGDATPSSQAAIDAISIRTKRVSTSSLALADFKVSKPDLFALPGGDVGFAAGVEWRRETQKDDRDDRLDGTIVFTDMVTGAVYGNDLIGSSPSPDTKGSRKVTSAFAELAIPVVSPDMEIPFVHAIEVQLAGRFEDFSDVGSVAKPKIAAAWDIFDGLRIRGSWAEGFKAPNLEQINATLVTRSNTRTDWVRCEADLRAGRINAFSDCSRSQSTTARRSGNQDLKPEESENFGLGVVFQPRFLPPELGNVTVTADYWRIKQKGIVGLFGEGNALIADYLARVNGGSNPAVVRADPTADDIAAFEGTGLAPVGSVLYVSDQYQNLLPQEARGLDIGVIWNLPTDRFGDFDFAFNAAHLIKFYRQPSPAIAELLEARAAGEINAGTTITGGGDLIRQDGRPEWKWSASATWRYNQFTVGAFTQYIGDVEDLDLTDSTGSNWVIDSQITANLYAQYEFTDGWTSDTRLRVGVRNLTDEKPPLAESGYFAELYQPYSRYWYVSVRKSF

SEQ ID NO: 13767 - protein, 394 aa, Solibacter usitatus
MAQTGGASGAGGDAQAGKEGFRVVSGDGAFALRLRGDLYADARFFSGTTEPAGAERFFLRRARPRLQGRVYDRFAFSLRSDFGIGGPEIDDAFVEARFAPALRLRMGRFNVPVGLEVLSSSTGLMHVERGFPSGLVPERDVGVMLAGDVGAGRLHYALGLFNGAPGASEPGGDVDDAKEAAGRVFVVPFAGTNGMWKGLGVGLAGTVGTVTGTAGTPALTGLRTTGRQSFFGYRDEARADGRRWRLAPQARLYAGPVELLGTYTVTTETARRGPDQETLTHRAWQASAAVVLTGEDAREGEVVPDDPFGAERGTGAIELGGRVHGVTFDDEAFPAFAAPTAASGATAWGLTLSWYPNAMVRVMLGMERTGFEAVGAGPARDPETLLLTRMQISF

SEQ ID NO: 13768 - protein, 75 aa, Solibacter usitatus
MLVEGDGKTDFAWGLGGSVGIGLTQNVSFDVGYRYMDLGKFEAGTLSRCIDKEFTQGIDSNYSTQEIILGIRYTF

SEQ ID NO: 13769 - protein, 242 aa, Solibacter usitatus
MKIRYLTSALLLTLTSTAASAASINIRHEFQPDHGDKAGAKHADRIAVSHRFKNGVGFEVEAKWCSNNETGEHNQDPFSEFAGNGQQANISYLYRINESFTLTPQYKWESNDTKMGNQFNLTLGYKVNDDWSTSFRHRYHYETRPNVDQSSHYNRWTFGASYRGIENWGLGATVDYTWKQEGEVVYKDGNAGVSEVNFTFEYQGFDSGWRPFGEIGATPSKKDTDEVDSYRPRFRVGMKYNF

SEQ ID NO: 13770 - protein, 359 aa, Solibacter usitatus
MQKKLIALAVAGLVSAPVFAQSNVTVYGIADAFFGYGKMDDNKFTGVESGGWAGSRLGFKGSEDLGNGLKAVFTLEYGIELDDNEGVGSGASRSRQQFVGLQGGFGFIGLGRQYNPGYYVFKYDAINVIPFSPQFILAANQGSNIVAGTPARVSNAINYKSPDFGGLTLNAIYGFNEANQDNNRQAGDTAAVGAEYANGPLAIGLIYSQVKQDAGAIPTEKFNGVADDTKKEAYLGAAYDFGMFKLMGSYQIIKDATAAEDDNKVWQVGSVVPVSSAGKVHLSYGRTDADADDSDAAAWSLMYSHSLSKRTLAYVGYTQVDNDDNTAYSVLAKRTDETTGAPLFDEDSRNFLIGVNHSF

SEQ ID NO: 13771 - protein, 278 aa, Solibacter usitatus
MTSNPRFLALLAVLALAAAPASAQQAGGARATAAAAEPPFQAFSSTNVQLLQGYNFDDPLYYTDGRMTTVTLNHFSTWEYGDNFAFADFYAGHFRNGFSPSHEDAGEYKLYAEWHPRLFLNRVLGQKEPLFGFIKNWGLAGELNQSEGFGAYLAGVGFDLTLPGFAVAGLNLYYRYDSVLDSIDEGNQWQVSPFWTVPFSIGKVPFLFTGFVDVNGTHDFAADESFVEIWAQPQLLVDALAPFGGKPNRLWVGTEWFYHRHPVETASAPQIMVQWTVY

SEQ ID NO: 13772 - protein, 681 aa, Solibacter usitatus
MLCSPLRLSPLAVALWLASSPSQAVELEPQIITANPLGNRELAAPSTVLEGDELLQQQHGSLGETLNKQPGVASTWFGPGASRPVIRGLDGDRIRILRNGVGALDASALSYDHAVPLDPVTVERVEIVRGPAALLYGGNAIGGVVNTFDNRIPDAPIEGIHGAGELRYGGADTTRSSAGKLEAGDGTFALHLDANSRQFNDLRIPGYARSSKVRDADEPGSKHRLENSDGRQDGGAVGGSYHWDHGYAGLSYSRYDSNYGSVAESGVRLDMKQDHYGFASELRDLEGPFSSVKVDAGYTDYEHSEIEEGEVHTTFKNKGYEARIEARHQPIGPLEGVIGAQVSRNEFSALGEEAFVPHTDTDSLALFMLEQWQATERLNLSLGARLEHTRVDPDAKGNENFVDADSASSFNALSLSSGAVYQLDPVWALAANVGYTERAPTFYELYANGAHVATGAYEVGDASLNKEKAISADLALRFDNGTHKGSVGVFYSHFRNYIGLIGTGNMREGHDHDHGDDDHDHDHDDGGFPEYQYQGVRARFYGIEAQDRWQLVENRYGSFALELSGDYTRAKNLDSGEPLPRIAPLRLNSGLVWELDRWQARVDVQHAASQHRKPANETSTDGYTTLGASVGYRFDIGQSQWLAFVRGENLTDQTVRYASSILRDIAPAPGRSVEVGLRTTF

SEQ ID NO: 13773 - protein, 278 aa, Solibacter usitatus
MRIVVMKTLASAVSLLIASSLSTFAADLSARYTKAPPPAAIYNWTGGYFGGNIGYGWGRSNLGTTLDQTSSWATEPVPFQNQFVAISNNRLNPSGVVGGLQAGYNWQAGPSVFGIEADINGSGVNKRVVYTGVNVPTTRTFNESIRNDWFMTLRGRAGYAIDTTLLYVTGGLAVGNVKGSWDLTSGNGYNKTGSADQTRAGWTIGAGVEHAFAPNWTVKAEYLYTDLGSINYTSGYVPGSTFAPPGFNYVERLSQDFTFHTVRIGVNYKLGSPVAARY

SEQ ID NO: 13774 - protein, 746 aa, Solibacter usitatus
MNFRALCLNTIGLSSLLSGMGTAFLSSSAWAENATSQSRNNALLFSSKASDLKKEETVPATTKQEDLIVTASRNNRMYVSSGGDLGALGNKKGLDVPFNIRSYNSSLILNQQAQTLGEVLLNDPTVRTTTGYGNYAQLFQIRGFTLYGDDVAIDGLYGVTPRQLVSPQLYDSVQVLNGASAFLNGAAPGGSAIGGNINLVPKRATSTDITRVTGDYTSNGQGGGAVDISRRFGQDRAYGFRFNAAGMNGRTAIKGERRDDIAIAGAFDWHNEDTRIDMNMNYQKQQVFGGRSSIIVSSLGTDMPVPKTTSPSKNWGQKWAYTDLSYLFGTLNIEHDFGDHITLYGKFGAQSGQEIGNYATTTLKNSYTGDGSVGAMATAYNVLNKSTQAGVRAHFKTGFIKHEINAGGSAIWEESYAAYAMSLVGQAGNIYNPIQFTPNETYASGNMKNPGRVSMNKLYSLFFSDTMNFWDDRISLTGGFRYQNILSNSYAYGTGKLQSQYESGVISPVVGLVVHPIKHFAVYFNRIQGLSAGTTVGASYVNAGQTFAPYQSTQYEVGAKYDIGRFSASVSFYQTAMPYGMVESYGNTGLLIYTQDGKQRNRGMELTFNGKIWRGLRFNGGLTLIDAKQIRSSGGSYDGKTVIGVPDYTINGNLEYDIPFVKGLTFVGRVVSTGKQQFNNANTAHLPAWSRFDLGARYTFLVRNKPLTARIEIDNVGNQRYWDSVYQSNLIMGVPQTFKFSITADL

SEQ ID NO: 13775 - protein, 750 aa, Solibacter usitatus
MRRVATALVVAGIVAAQAAHAQVTLNFVNADIDQVAKAIGAATGKTIIVDPRVKGQLNLVAERPVPEDQALKTLQSALRMQGFALVQDHGVLKVVPEADAKLQGVPTYIGNAPQARGDQVVTQVFELRNESANNLLPVLRPLISPNNTITAYPANNTIVVTDYADNVRRIAQIIAGVDSAAGSQVAVVPLKNANAIDIAAQLTKLLDPGAIGNTDATLKVTVQADPRTNALLLRASNAQRLATAKKIAQQLDAPSGVPGNMHVVPLRNAEAVKLAKTLRGMLGKGGGESGSSASSNDANAFNQGGSQSGSNFSTGASGTPPLPSGLSSNSSGGAGGTTGGGGLGNAGLLGGDKDKGDDNQPGGMIQADAASNSLIITASDPVYRNLRAVIDQLDARRAQVYIEALVVELQATTSANLGIQWQVANNALYAGTNLVTGQTGLGNSIVNLTAGAVTNPGGTLGSLGSITNGLNIGWLHNMFGVQGLGALLQFFAGSSDANVLSTPNLVTLDNEEAKIVVGQNVPIPTGSYSNLTSGTTANAFNTYDRRDVGLTLHVKPQITEGGILKLQLYTEDSAVVPGTNTTSANSPGPTFTKRSIQSTVLADNGEIIVLGGLMQDNYQVSNTKVPLLGDIPWIGQLFRSEGKTRQKTNLMVFLRPVIINDRETAQAVTSNRYDYIQGVTGAYKSDNNVIRDKDDPIVPPMPLGPSQGGSPAMNLFDLDKMRRQQLAPPAPASAPAAASDAGTASPGARP

SEQ ID NO: 13776 - protein, 736 aa, Solibacter usitatus
MTRSPHSTRHTRPALSTLGAALACTLHALPAHAADAAQDSSEALLAPVVITASQPGAGPDLWRATAAIDSVEGAVLRDGQMQINLSESLARVPGLVVLNRQNFAQDLQISVRGFGARSTFGVRGLRLYVDGIPAGAPDGQGQAANFTLGNAARLDVVRGPAAVLYGNSAGGALLLYTEDGEEPGLWRSGMAVGPDGLWRLSTQLRGTIGGGKPDQADGGSAPWRYAIHIERFATDGMRPQSAADRSTAHMKLSRKQGDDQWLLQYQEQRASAQDPLGLTRAEFEADPGQTTASALRFNTRKSVRQRQLGAAWQHQFGAGQRLELMAYAGTRSVLQYQAIPVATQAPPSHSGGVIDLDRDYAGMNLRWRSTHEDVAGGRLDWSAGLAYDWQGETRRGYENFIGSQLGVQGRLRRDERNQARSADPYLQAEWSTQSLALSAGLRQARVRYRSEDHYIVAGNGDDSGSMAWRGWLPSLGLRVNLLPDLVAHASVGRGMETPTLNEVAYRPGGQNGMNSGLNTGLAASAHNTVEVGLRGRHGNAGWNLTLFETHTQRELTVLSNTGGRATYQNAGRTLRRGLEFSGNAQWGPLTASTALTLLQARYRDSFLTCEATPCTTPTAPVDAGARLAGTAPRRLWSELAWQLSPQWTWTVDMLHSGPVAVNDRNTDRAAGYTVWGSSLRWSRQWQQWSAQTFVRLDNLFDRRFAGSVIVNEGNQRFFEPGAGRGLSAGVTVSRTF

SEQ ID NO: 13777 - protein, 715 aa, Solibacter usitatus
MKRLRYSYLALILGSALPLSAYADGYLSNDNIRQFDARFNFFLANPLPAPIAKADGRGEAIENLVVKYASDYLNDIYLKEDVIRFRRWQWQDLYTSLDLKTKQKPDYLNTYRLQAEAYFINKQYQEALSQLDQILRRNPNDVHAMAMSVVASRVLENPNTEAERLLALYQISPSIAQKVQQYLHFTDTMLAASYGSEPQTTMIPDTIAVFGQSPNPDGTPSKGLLQRLEKTKEMAEKFPNAKIILSGGPVRYIYAEADVMKKWLIENGVDESRLLLDDVARDTPGNAVGIIDFMKEYGGRKVLGIGTILHLPRAMSVLKSYADSIGYELEIDSAGGGSPPNEKNKKGEALYTFVNVARAMGLFTLGDFENLLAKEQAEKEQREALEKAQQNYLEKLVAERDQAVKNAENSANELEVARQALETAKQAHQQAEEELNKELSKTQEQLKQSTEALSRLIIKQNNPFSEHYVVQLNLMEQATYDLYRRLAEIEHTQDWNLWLSDSLSKYRLKNRSTEDYHLLHIGLDHQVSHNWSIGGVFGISQGQIENRTHKVKGTSAGIYAGYRPTSGLFWTNFFNYSHFTNQSGVTKRDNNAYSLSSEIGRNIVMSHQWQITPKLQLGWAKAGSARMFWAGTGLRLGKVIELNAIKLKPYADISYRFRNRHIDTLDSLSDRHRNVISIGIQAVGNRHYFAIEGSMLHGDALKRSYGLHANYHYQW

SEQ ID NO: 13778 - protein, 709 aa, Solibacter usitatus
MALNPLLVLAEEPSTPDLQDQNIEKITVMGKYTVSKTIDTATGLGLSLMETPQSVSILTAERIQDQALNTVVDVVNNAVGLSSSKTDNVRNGFNARGFSVQNYQIDGVPLSWSLGGDAGETVSDVSLYERVEVVRGATGLLTGAGDPSASINLVRKHADSSDLKGYVDVATGSWDKKQLTADVSNGLNESGSVRGRMVAKYVNSDSYQELYQDRKTILYGVIDTDITDNTMLRVGGSYNNNNPKGAMWGALQAVYSDGTPTDWDVSATTAADWSRWETTNVNYFANLNHYFNNGWQLVANYNRMEYETTTKMIYMSGLLDKETGAGLSGQRYHSHGESNSDNFDLQLKGDYQLFNREHEFVVGALYSKQKSYTDTFEPIRDETNLYDNKPVDNFYEWQNNAFVEPEWSTDANRQLKMDTEQKGFYAATRFTITEALKIIAGGRISSWNREGVSYGTDTNFGDDGVFVPYVGALYDISEQHRAYASYTEIFNPQNVTNAYGEYLDPLKGKAYEIGLKSAYLDDRLHTTVALFKIDQDNLATPDGTVIIDGKPVTNYKAAQGTESTGFELEVVGEFIDGWNITAGYSQFTAEDVEGNRMATTSPRKQFKLFTTYQFVDYLPELTVGGGINWQNDSYSEGGTVKIDQEAYSLVNLMARYNLADNMVLQLNVENLLDEKYYAYMSVSSSMSEAYSVYHYGTPRNVTLSFNYRF

SEQ ID NO: 13779 - protein, 687 aa, Solibacter usitatus
MRLLAFAILVACVQSVCAQSILKDPKELSVLLNEVVVTGTGTEHYLKDAPVQTEVITGKALDSYQGRSMQDILEGLNASITFNPSDMGSGIQMNGLGNDYILILINGKRINGDTGGQNDLSIINPANIERIEIVKGAASSLYGSDAIAGVINIITKKNRDKVSLSNTTRVGSYGDILESVQIGIGHKRVNSTTSLSTTHTDGWRNTTQEWDHHEVMNGTVTRTVNRSTNFTLRENLTYKVNDRLSLSADGSFYQKWNYRPHGAFKYYTYDQFYRNFDVAGGAKYALGGLNFLSVDLTYGNYSYFYNYHHKDVTNFFDPETDLRITRYPGEHILETSQQRFLGQAKSVFHLGENNILSAGLEYQYDHLKSPRRIENGKASVFTASAYVQDEWNPTDRLNVTVGGRFVVHQEFGATFTPKVSAMYKLGDFNIRATYSNGFKAPTLKELHDDYITQIGGGPWKHYYGNKDLKPQKSNYYSASVEYHASNLQITVTGFYNRIKNMIALTEIPTSAEDRLDEIEASMQHKNLSKARSFGGDISLTYQILSSLAIGGGYSYTDAKAQYTDDPADSNYMLYTPINGTSFHNANWKLAWNHAWKKYKLDVTLFGRYQSTRFYITDGDGKSYQLWRLNTRHNVLKKKKWNLDINVGIDNIFDYVDRTPFGRHRGTTSPGRTWYASFIVKFQNKHKL

SEQ ID NO: 13780 - protein, 583 aa, Solibacter usitatus
MKTKSGEELLNDLSQFNLSETEKKEALNLIKNLKESQDFKNLINKEKELKTKLDEINKLEKDSNYQKLHFQEIIGKIESDFSGLSNKVYSLYPNAKDLEKQFEIDLKREDTYTLVKKAVLLADRNPELKAKLDSIKNELKTKLNDTRELLKKDLATIKELKAKYPNSKFGDIEKTIETILSGDNLEKTVLSSRDYNKNSDLAALVSDFKKLVSDISLQLKEKENIVKALEENDASIEQPRYADYHRLKSKIFYTMREEEVLSELKNMLTQLSDRNIYSKLNKISKNEISTYTTIPFEVTHALTDKKNIARGGFISNRTVQDNFKGNIYTAYGLYETTANSNTKYGVLFGGANTKHNEVYQRNLTTVATESEIKGVSAYVGGYFNKPVINNLNWITGIGTQYGRYKVKREMRNNYQDLHSEGKVNTASLNTYSGFIINYPIQEDVFVQLKGLLAYTMVKQSKVNESGDLPLDINGKTYHYVDGEAGISFNKIFYGEDLKSSISAGAYGILGLSGYKNSNLEGKIDGSSSSFGIKGDKVKRDAIKIHLDYNVQTDVGYTYGLEGTYITNSKENNVKIGIKGGYVF

SEQ ID NO: 13781 - protein, 187 aa, Solibacter usitatus
MLVGKGIMKKIALAGLAGMLLVSASVNAMSISGQAGKEYTNIGVGFGTETTGLALSGNWTHNDDDGDVAGVGLGLNLPLGPLMATVGGKGVYTNPNYGDEGYAAAVGGGLQWKIGNSFRLFGEYYYSPDSLSSGIQSYEEANAGARYTIMRPVSIEAGYRYLNLSGKDGNRDNAVADGPYVGVNASF

SEQ ID NO: 13782 - protein, 195 aa, Solibacter usitatus
MLWTAGFNDKICALNTFEYDRDGNNVSGILTRWRQFGKRYFWPHLLLGMVAASLGLPALSNAAEPNAPAKATTRNHEPSAKVNFGQLALLEANTRRPNSNYSVDYWHQHAIRTVIRHLSFAMAPQTLPVAEESLPLQAQHLALLDTLSALLTQEGTPSEKGYRIDYAHFTPQAKFSTPVWISQAQGIRAGPQRLT

SEQ ID NO: 13783 - protein, 628 aa, Solibacter usitatus
MLRTAITMALTVAATMASSFSVSANSATSIEKSVKKVSEKDVEKINIEGSATANESPVGTFNSPISNLEYDPRVDLQSRNMAEAQADVTIRGGIFENTGFSVGSATLVDPQTGHYVAEIPIAPEMLTAPAILTGVDNSLYGANSSVGSVAYKWRPIQTAGSVSLGAGRNNFNMQRVHNAISWSVDDSSQWKAGGEGEYSRSESDGTIDKGDHRFERASGRVQLISDTSQTDLFFGYQQKFFGWPNLYTPFNVNETEDLETRLLIFNHQQQYAQESTVEVSAYYRQQNDHYVFSRENPEAFQAFHETKVKSVAVSGRHMTDSKLALNYAAQFTADEIESTTLENNFTSRDYYKFSVVPEYAVALQDNEQLTFRVGAAFDDTNRDDSRVSVISDIVWLKTNADKSTRTVNFSYSEATQVAGYTAIGGSTSSGLFRSNDTLERETSKNLELGVSLDKASWRVDSAVFYRWDNELTDWTYRFDSTSARVANPVDIETIGVELMAIARLESADVVTSYTYLDKSEDYRDENIDASFYALNYPPHRFTLGVIWYPAEALELKVDNEWRKQEDNLLRNGGDSAFFTHISLTYSPPQIDGFNVVVAVDNLWDESFEEIPGTPGRSDQLSVTASYFW

SEQ ID NO: 13784 - protein, 1129 aa, Solibacter usitatus
MRLRFSVLGIALFVFGFSWVGADERCASPVAQIVSLQGRVEVTPVDERRWRSVGLREKFCAGDRIRIEAYSRALVQLQDNTLLHLDGGTLVTFSGIEPNKPSWFELLKGAIHLISRFPHRLEVKTPFVNAAVEGTEFAIRVEPEKALLWVFEGRVLFHNPTGQLTVTSGEAAVAEAGQAPRRRLVIQPREAVQWALYYPPLIDLRPSVYPSGPEAQGIHVALRAYRDGDLLTALGRLEQVPIGAREASYFTLQAALLLVVGRIDEARPNIQRALQLDPDHGTAYALQAIIALAQNRKEDALRLARQGAKLDPQSSIPQIALSYVYQGRFNIEQALQHAQQATELFPGEALAWARVAELQLSLGDLDGAAKAAQQAVALDPDLARTQTVRGFAELTAIDIEEAKASFQRAIELDPADPLSRLGLGLAKIRQGDLKAGTEEIEIAASLDPNNSLIRSYLGKAYYDQKRGEAAATELAIAKELDPNDPTPWFYDAIRKQTTNRPVEALHDMQKAIELNDNRAVYRSRLLMDQDLAARSASLGRIYNDLGFQQRGLLEGWKSVNTDPSNYSAHRLLADNYAALPRHEIARVSELLQSQLLQPLNLTPVQPSLAESNLLLLEGAGPSGLAFNEFNPLFTRNRLALQASGVFGSNDTLGDEVTQSGLWKNFSYSVGQFHSETDGFRENSDFARNTYNVFTQGALSPNTNLQAEFRHDERIQGDLALRFDPNFSKVLRETSRVNTYRLGARHAFSPNSQIIASLSYQNVNVKQKTQTQRTISIPTPLGPLETEILIPTEATINRNGFIGELQHFYTNEKATVISGFGHINNDVIQNVTFPENKPPLTEVITHPDIRKVNIYNYSQIRAFDKLTAILGLSIDSLEIRGQLDKTQVNPKFGLIWMLHSSTTLRLAGFRSMSTTRTANQTIEQTQVAGFNQFFDDVNGTDAWRYGAAVDHVFSKYFYGGVEYSERKLDVPVLISQGSKAQFVNWKEKTSRTYFYLTPNSNFAASIEYFFERFDRRSNPLRTGIVDVATHRVPVGLSFFHPLGFSANLKATYVNQSGFFQRRNSDDIFNDQSGFIVVDMSLNYRLPKRFGIIRVGSKNLFNERFKYQDMDPNMPLFFPERFLYTQLTLAF

SEQ ID NO: 13785 - protein, 691 aa, Solibacter usitatus
MGVSTLRGLLLAGSTLGAVGAAGAQDSATAAEPADVAQLAPVVVTGTKLDASGQTADSATSVASGARLQAAGVARTDELGKLFPELTVTPRSSRAYTLFGMRGTPSSDFYSPAVTVYVDGVPQDMAYFTQPLPDVEQVEVLRGPQGTLYGRAAQGGVINIVTTKPNNRFGAQASVDVNNLTRRTDLSVRGPLVKDLLYGDVSAYFDDRPGTLKNPATGADQLDSGREALGRARLRWTPRDTDLDATLSVSHDRYRSHEEYFQAYDLKDRHAIASSPFDLTEPSLTRTVTQAALSVDYYLRGWKLSSVSAYQDRRLERVLTTGNADPENQKTFSQELRVATSGDVKRPVDGVFGLYYEKQAFERDRGIAVPGVSAFLFPGPSRSESNLRSMAAFGEGVWHATERLDLTAGLRYGIDSADIHYNRTGAAALSFAGDKTFRSLTPKVSVGYQAAPGWRVYGLYSEGYKAGGFNRIADNSAGSIPYSAERLRNVEVGFQADLLGKRLRLDGALFHSRTSNLQAQVVSGLFQMLSNVGDARATGVELNGTWLATPDLTLRAGGAWTTSKIYSYSAPQGNLDLTGKRVPYVVPLSLRASGEYRFRPQGMRGRLRWNVGMTYSGDMWFDAANTLRQPAYALLDTSLSWDINKHLTVVGYVDNLTDRAVRTYAFSLGTFGTFAQYGQGRTIGLRLQARL

SEQ ID NO: 13786 - protein, 407 aa, Solibacter usitatus
MPRSHRRCAMSKARMAVRDLRHATTTRPRMQFDWTTSAARRAAGLASHWSHNCHRRDRDVRRRHRTDFKSKYNCCHGCYVRTTGALAGACTPCSRSLTAPDRRSRRRVSPARAGPMKKRNLATTLCALSASGSTLAAELELYVDRKTKQIFAEPAPGRDKLGTFVQVDENGKLPASAMPAAPARPLPPAPGAATPADTAIAQATPAAATPVAAPAPAKSGDTAKKWYDKLCLRGYTQIRYKQGIGGDAQDLRAPGDRFIGDDQSLGIRRARLVLSGDLNEHVSLYFQPDFASTPTGSTTSNFAQLRDAYADIFFNKKREYRVRVGQSKMPYGWENLQSSQNRLSLDRADALNSGLRDERDIGAVFFTAPPWPRAGSRTWSSGIEGFGRLRRDRCRCVQWPGRQPRRA

SEQ ID NO: 13787 - protein, 877 aa, Solibacter usitatus
MTIRNRKKFGFNALSFAVSMALAGTLASSAASAADDKDKLEDVEKIAVVGSRATPRSIGDSTVPIDIISGDDIRKSGNSDMLEILKGAVPSLNVHSNPISDAASLVRPANLRGLSADSTLILLNGKRRHRSSVIAFLGGGINDGAHGPDISVIPSIALKQVEVLRDGAAAQYGSDAIAGVMNFVLKDNAEGGSLEVKTGEYYEGDGATTELSGNIGMPLTEDGFVNLSFQYKNADPTSRSVQRPDAQAFADAGLDVANPAQIWGSPEIKDDITLFANLGLDLDDHSEAYLFGNYSERDVKGGFYYRNPHNRPGVYSNDDGATLLVGDLTPGPVGQVNDGLGLGDGIDCPVINITSADVTQQQDYIDNVQNNPNCFAFNEMNGLAGGFTPNFGGNIVDTSLVAGTKGEFQMDFLEGILYDFSGSYGSNESSYKIVNTLNASMGPDSPRDFNPGKYIQTEWNFNADFVKFVDWGLADDVSIATGLEWHDETFEVVAGDEASFKVGPLFSQGFGIGSNGFPGFQPSAAGEYTRKNKAIYLDTSMPIFDSLVAEFAVRYEDYDSFGSTVNYKLAANWNIIDELAVRGSFNTGFRAPTVGQANVSNVQTNLSGGVLVDSALLPPTNPISAQLGGTELTPEESKSFTFGTVYTQGDFFLTVDYYNIKVDDRISQSEKIELTDADKATLKAAGVPNVDGLSQVSFFTNDFDTTTQGVDIVANYSAELFSGDSTFALAYNWNKTEVDRYTDITGDFKVSRLENDLPNHRATFTWGQSWDQFNLFTRVNYFGEYQGVHVDYDATINTGEAAVTVDMELSYFINDSFSVALGAQNLFDQDATEIDFTPAGAAECGGCTNNQWGGIYYETSPFGFNGGYYYLKGTYTF

SEQ ID NO: 13788 - protein, 650 aa, Solibacter usitatus
MRKHFSLLPLAILVATAVQAEELDIINVVSENTGAKSKTNVITTESVNRSTETELKGLLKEEPALNFGGGRGTSQWFTIRGMGQDQVDVKIDDAYTDAQLFHHQGRFVFDPSLFKKVSVQKGTGSASAGIGATSGTIVAETVSAKDLLKEEQDFGFKVNAGVSSNSGWSKGATIYSKVGAFDALISGNWVKERDYKAGNGYKIKNSALGQRGLLAKIGVDLNEDHRIELSRRQERHYGVRALREEFDFAQDGRESVNAPRYRVTTNDTGKIEWTGKNIGFISTAKANVWRTVISREEPTERSKIHLVANGANLNLDSQIGESHLIKYGVNYRDQEGRPNSLTVQNGVQIRNQKKRDVGVYAEGIWGLGAFTLTTGLRYDHFSFRAMDGRKSNKGNLNPSFGLIYEVTKDLSFSASLNYATRSPRFREILLSSGTTRGNPAVYSIAGNIKPEKSRNTEVGFNYKLADSLSLNGSYFWQTIQDTHAFTQIRPGYFEIQNAGKLRNSGYELGAAYKYEGLTLRAGVAYSKPELDGRTVDSTVTAIPIGRTWTTGVSYRFEQPDVEIGWRGRFVQHTSYDTSTNNRGGGSTTTKRPGYGVNDFYVTWKPVENINVNLALNNAFNKYYRSHSQRAGVSTLPEPGRDVRLNVNYTF

SEQ ID NO: 13789 - protein, 289 aa, Solibacter usitatus
MRTGPGWLLAAAALPFFACAQEATIDKVHDTPAVRGSIIANMLQEHDNPFTLYPYESNYLLYTYTSDLNKKAIESYNWSDNANKDEVKFQLSLAFPLWRGILGDNSLLGASYTQRSWWQLSNTGESAPFRETNYEPQLFLGFATDYSVGDWTLRDAEFGYNHQSNGRSDPTSRSWNRLYSRLMAQNGNWLVEVKPWYVIGDTSDNKNITKYMGYYQLKIGYQLGEAVLSAKGQYNWNTGYGGAELGVSYPITKHVRFYTQVYSGYGESLIDYDFNQTRVGMGVMLNDLF

SEQ ID NO: 13790 - protein, 203 aa, Solibacter usitatus
MKKLVPISLMLALTSPFVAAHEEGDFFVRGGLASVMPNESSDNVLNTGELELSDNTQLGLTLTYMLTDNWGMELLAATPFTHNVRTDGLGKIAEVTHLPPTFMGQYYFGESDSQYRPYVGAGLNYTTFFEEEGFGTLDGTNVELDDSFGLAVQVGLDVEVTEDWFVNASFWYMDIDTEVETTVGTFDAEIDPYVVMVGMGYTF

SEQ ID NO: 13791 - protein, 1092 aa, Solibacter usitatus
MRQLNTTIFYCFTVLLIVFAANPFYGQDANMVVRGTILDSSNNQPIPGATIAEQDAENRTVTGVIADFDGNFAIRIKNRNNKLVISTLGYTSQTIPLTGKSSYTINLTPSVDELDEVMISVEKPTESGLLDISERNMTTSTVTVKAADVENTQAASIDEALQGRVPGVDITANSGDPGAGMQIRIRGTSSITGSSDPLVVVDGMPYETSIPEDFNFGSADEQGYAALLNIAPSDIESITILKDAAATAMWGARAASGVLVINTKRGSIGAPKIGYTFRGTYMQLPQTIPMLSGDQYSQLIPEEFMNRNGTPLNTLTVKEFQYDPQEVYFFKNYGNNTNWVDAISQTGLTGEHNLSLQGGGEKARYYTSVGYYDSKGVTKGTAFQRINGRLNLDYVVSDRIRFKADIAYTHTVTDRNYVNGTGNGDRLRSVAYTKMPNMSIFEYDDVGDLTPNYFSPAQNIQGAYSRTYNPVAMAEYASNEQTGERIVPHFNLKVDLIPSRLISTFDLQFDFNSTKAKAFLPQNATGRPFTETVVNQASDADVDIASVTSKTNFIYTPDIGKDHSLQTLLSIQTNDFRYESHQALTSNTASSLLTDPSVPSRTQNAELQLYNNNSQSRNVAALVNAQYSLLDRYILNVGVRGDGNSKFGPGNRYALFPSASARWRVSGEPFMQDFDFVDDFSFRASYGQSGRAPRYDYRYFNIYGNFNSEYLGMSGVYPQNIELENLRWETLTGQNIGLNLQLFDRRIMLDVDVYKNRTEDLLFQNVDLTTVSGYNNLSDQNVGTLDNQGWEVGLYTTPVKTDKWKVDFNFNIARNQNIIREISEFYPNERGNVDRNGEFKRFLQTDNPFGSFYGYRFKGVYPDLESTQARDANGNVITGPNGQTVYMRFNYPNTDYVFQPGDAIYEDINKDGNIDSRDVVYLGNSNPKFTGGFGPSVTFNDQFKLLLFFTYRLDYDIVNGTDMLTTNMYTYDNQSTAVLSRWRNPGDQTDMPRAIYGAGYNWLGSDRYVEDASFVRFRSATFSYNFTKPFLKKWKLDDLRVYVTADNLLTFTNYRGQDPEVNMRGGDPFGMAIDYSRTPPTRRFTLGIQTRF

SEQ ID NO: 13792 - protein, 462 aa, Solibacter usitatus
MKGTRWSARTLAALTVVLLAIGLAPAHAQNAGESQPASGAAPGNATADPMEDRFAFHGQATYIWQRKPSFGAAYSGEHSLGTERAKSYSFTSTLDLGLRLWQGAEFHFNPEVSQGVPFSGLHGLGGLTNGELAKSSGTNPTFYRARAFVRQTWGLGGGEEKLDADFNQFARTVDKQRVVLTAGNFGVLDVFDLNPYGSDPRTQFMNWSSLTHGSFDYPADARGYNWGVSLEYVGDGWSARFGHFLQPLESNGLKLDTRMFEHYGDILELEKRYTLAGRPGAARLLLWRNKAKMGKFSDAIAFGQANNVTPDVADVRAEHAKVGVGITLLQEVNDSLGVFFRANMSDDKTETYAFTEIGKQIAGGGTLKGTSWGRPNDELGVAMAVNMLRSPHRDYLAAGGLGAFLGDGALRYGPEQVLEIYYSLALLKYFSVSPNFQYIRNPGYNRDRGPATFYGVRFHAEF

SEQ ID NO: 13793 - protein, 1068 aa, Solibacter usitatus
MFRTNRLAKAVRTSIIFGAAAVAYNAYAAEEPKLNSDAAVEASLEEEEVQERVVVTGSRIRKAEFSEASPIQVISGDISRELGLFDAGQMLQTTNQASGIQIDNTFGGYVLDNGPGAATIGFRGLGAERTLVLVNGRRMAPAGVGGAPTSPDLNLIPGVMIQRVENLFDGASTVYGSDAVAGVANVILKKDVEGFEFNAAYSQPKGEGGEETQLSGMWGTTMDNGFISVGVEYNKQESQSFGGNDFTKGCEERFFYTEDGRVINRYSGIGPTQNGEDTCNIFPLTNRITTQYFWGSLYHTPGYSNTGIPNFSESTIPNQYIGLLPSWIAADSNGDGINDVGIVDGNGDGFLDFDFQDPMYAYQQSEYYKSGDYKSGQERVSAMVNGEYNFQDSSDSTFYYEGLYAKRETDIFNPGAQIFEWVPASNPFNPCGVNGIDCLAMLGAPVGPQRVRPIINIRGDRDLTKVEVEQYRVVAGVTGNLPVFEAIGLDNWYYDFYVSHSASKGTDKRVGINEERLLNSLYTSVMDADGNVTCGDGSDGCVPVNLFASNIFQAGGGTLTEAEANYLFMDRTMETKVDQTVISGFVGGDLFNLPWNNEPVSTVFGMEWREDSIESNPNAAAADGLLWGYFADQGADGSRRLKEAFAELDFPLVRGMPGVEELTLTASGRISDESFYDAATTYSLKAVYRPVEWVTVRGTQGTSYRAPNLRERFLNGTSGFNTVSDPCVVPVDARISDPLNPNAPISYDPTNDDRDASVLQACRNAGVDPTALGLGGDGSAPYTSNYSAEVVTGGSTGLAEETSTAKTYGLIVEQPFSDDFNLTLSATRFDIEVTNSIAEPSSAYSINQCYSADGNEAFCSRIDRGSNGQIDLVDASFINIGLLTSKGWDYNLFYSQEFVVMENSFDVSLDIQATQMTESLYDVLGTVDDNLGEPDVPEWRASALLRLEYQDFSFNWQTRFIGSGVEDYDPETDGDKFVEDTVACTGMTNADGSPLLCRPVDYTEDYWVHNLSLAYTMDNYEFSVGVRNVFNDAPPKVDPDGSFSNTNIPLGVGYAQPRTVFVNFGAKF

SEQ ID NO: 13794 - protein, 1057 aa, Solibacter usitatus
MKLSVTETRVTISMLITFGLLFLNVQQSFGQATNASIKGIIQDNKGEPLMGATIIVKNISTGFTSGSTTNETGKYKIQQLPLGGPYSITAKYLGFKASVHTGFRLNLSDVIVVDFTLQESETSLDEIVISSNSISRRIQQIGASTKIGEAQIKNLPSEGRNFTRLTSLSPLQGAGSLNLGGQRRTSTNVTIDGVNFRNTLTAGEIGRGPYTISQEAIREFEVSTNDYDATQGRQGGGAITSVTKSGTNKFEGSIFFYHRADNLQSQYTIQGEDRKADFYNSQYGLSLGGPILKDKLHFFLVYERQDAGDPQFIANIQNDNDANRLGISEDSLQRFLQIGRDQYGVSNSQQIGQFDRVTEANNLFLRLDWQINKKHRLTFRNLYNKWENPLSVSDNSNIEIAESYSDFTSHENSMFLSLRSVFSSRITNEFKLQYQRAERLFSPNSELPSQNIPRAIVQVESLLPNGKNSTRSVQLGGQRFTPETNLENQIQISNTLYLTSGKFNFTFGTDNLITSLKTQLSNEQNGRFFFDSLDDFENLNAARYAREVPLKGATLVKQTVVDLSLFSQVALDLHPSLNLTAGIRYDATVFMDAAEFNPRVFQELGIRTDEKPADFNNIQPRFQLTWNIKGKDADILKIGGGVFTSQPHYYAQVNNIQNSGTLLGAIDITGADVPIPDFIGYRNDPSSVPGVPSGVAPFSTINAMSPDFEVPTIYKANVNYTHFFGNRYRLGVNAVFSHTKNNYVYQETNLVAAPYFITPQGRAVFVPANTIAENGRTDWRASRVSNLIGRTLVLSSDGILDNLALVLEGAAKIGADGYVNASFTINQSKDNSSYNCCVANTATFLPVSGDPRDLNYGYSDNHFDTKIVVNGASPTWRGFTLGATVVGTGGTRYSLKSGGNRSANGDFNLSNEIAYVFDPSDVNTPQYIKDSYREILNDPETAQGFKDYLRKSFGGFAKRNGGKNPFNAIVDLRLQKSFNLSNDHHTFALSADVFNFMNLLNKEWGRSYNFGNRDLMNINGFDQATKSYQYNVQKGAGTKPINGIPWRLQVGVRYSFN

SEQ ID NO: 13795 - protein, 163 aa, Solibacter usitatus
MRRILSVLLENESGALSRVIGLFSQRGYNIESLTVAPTDDPTLSRMTIQTVGDEKVLEQIEKQLHKLVDVLRVSELGQGAHVEREIMLVKIQASGYGRDEVKRNTEIFRGQIIDVTPSLYTVQLAGTSGKLDAFLASIRDVAKIVEVARSGVVGLSRGDKIMR

SEQ ID NO: 13796 - protein, 998 aa, Solibacter usitatus
MLLKQFKKSRLSVALAVVLGSGSAPFAMAEESNESEKETNIEVIEVKGIQGSLYRSMDLKRGSSGVVDAISAEELGKFPDTNLAESLQRITGVTVSRANGEGSQITVRGFGPQYNLITLNGRQMPGTGYSRSYSLENLSSEAVKSLEVIKTAKADMPTGGLGATVNIVTRKPLNDPGQSFSFSAKGIYDESNVEGDDVTPEISGIYNQTFLDDSLGFVISASHQERDFQQQVANSQGWIAQTDNKTLAKADGSTFIDGRIRNEAGNILSHFTDEDGVPVAPSFFPRDMNYSVNDVQRERTNAMATLQYAPTEDLVLTADYVVTRALTGINGFGWGIWNSSTSGAPVVAYELDENGTALYSDIRGGDGSFTANRSTTEVNAQSVGLNIDWTLNDEWTLSLDYHDSSNEIDNGADKGLGGAGQVILGSDQLTSKIYDYRGGDVPHATINWNNGSTQLDPGAIDSNFSQFIHSPGESEIQQAQLNANWYPDFLDNLTKVDFGGSYTKQTLSGTTAWSGLRGGPGFNPSYTEIFPDSMFHLQSTAGLLDELAGGGAGLLPSYFYSFDFDEAVARQLAFINQDVAGENYYSADPYFDGIDSSNLIEEETSSLYITSAWEFDIADITVDVNLGLRYEKTEVSSTVKQKVEQQVVWASATEWVTLYEAGGDDNFFTQTGEYDVWLPMVDISAEVYEDLLVRVSASKTLGRPLLGDMVAGRSLSGSPKVGSRTGGIGNPGLLPLESVNFDVSFEYYYGDASYASIGLFSKDVSNFVSRSTNQITIDGLHDVYNSPRYLEAVSQLEAAGTSVTENSIFDQMIANGHGNASGQIEALSSDPLIVWDVTSPVNSDKKSVEGIELAVQHIFGESGFGFGANATFVSGDVKFDSYSLAQQQPLEGLGDSANFQAFYENDELSVKFTYAWRDSYLIGVGQSQGSADAPPQFAKEYGQLDASINYDINENITIFLEGININNETEEGYGRFEEQFLFARQYGSRYMLGGRVSF

SEQ ID NO: 13797 - protein, 1099 aa, Solibacter usitatus
MTKLLAVSLIACAAFAQSDTASLSGAVTDSGAAAVAGAKITLRNVATHNQRTALSDIQGLYRFSLLIPGNYEITIDSPGMKQFHSAELTLNVAQAGRLDVQLEVGSNLEIMEVRTQQLLLNAETASQGTVIGEEKIKSLPLNGRQFLQLALLVPGANAGGRAVQQNLNRQGAIGGLSVSGGRTNNTAFLLDGGINLDPDYNSLNYNPSIDAIAEFQVQTGLFPAEFGRASGGQINVVTKSGGNTFHGSAFEFLRNNALDARPFNLPVPQLPEYRRNQFGATAGGPIKPNKVFWFFSYDALRLRQAGAGLTTVTVPTTLQLDGNFSATKGGIFDPDTLQNGVRTPFPGNIIPSQRINASALAAAKAMPLPNLGTSGFVNANGLLKQTNNNYSGRVDYLVTSSLNLFGRYSMANEDAIIPATVTGRDNVNNVRPQNFVVGLTKTIKPTLVTELRVAFSRFRQVNGLPELDFNVGSTTTHLPQFLVSGYPTMGGAGSFTGTTAGGIVMVRDNTYQVYDNVLWEHGRHAVKFGGEAVQVQYNRYEAPSSLANFQFTNGFTTRTAATDGTGDALASFYLALPAVSNRSVGPSRIDGRQWLYSAYVQDDFRVLPSLTLNFGLRYELAPPVYDARQQMASIDYSNVPSPQAIFASGKTAFYKPQLFICGQGNTPRGCAHTDYNNFAPRAGIVWSANPKTVIRAGAGVYYAASDFNPLFRLAAGLPDNLIQTLTSNNFVPQFRGFDIFGPAVVGASQIQQAGIDINQRTSYSLQWTFTIQRELPRKIVVEAGYMASLGLKLEQNVQPNNAQPGLGAIDPRRPYVALDYAPGTTFPSYVNVQGSSVPVGFINYLPHSAQSNYHALNMRLEKPFKDGLSWLTSYTFSKSITNAPQFRNAGGVNGSENSPAQDAFNLQAERGLAAYDVRHRLVNTVVFQLPFGRTQKYLRYGLGSKILGGWELSGIVSAQSGFPYTINLRGDTAGVGAGTGGIFVRPNAVPGVSYQLPSSQMSTSRYFNTAAFTAPATGAFGNVGRNTLIGPAFANADAVVSRHFRIKEREDLQFRAEFFNALNHPNFTLVGRILNDPTFGQVLSQADPRELQFGFKFTF

SEQ ID NO: 13798 - protein, 735 aa, Solibacter usitatus
MTTSTPVCTTRIKPLALAILTIATQGLIISPWAQAAQSADDGTGNKAVMPTVVVEAMSEQDPSKSYINYKQASVTRNGLDVKDTPQTIDTIDVQKYKLYGVNDLSVMLTGTPGVNTQYDMRGDGIMIRGFSADSSDIYRDGIRESGQVRRSTSNVERIEILKGPASLLYGRSAGGGVVNMVSKYANFESFSNAGLYLGSWGNRGFTLDINQVNSENLAVRVTAEAGDSESFRDGISNEINMVSPSFTYNNRAGLEWTVQYTYDKLTRVPDRGPAYDSLPSGTSIRTGFAQEGDYVEDILNSVRSDVRYQLTDNWNLHWVIAHREAEQNFDHFFAGTWCNDLGKTLAGANCTWNGYVRQNYAWQETINKTNSHIIELSGQFNTGSLEHRLLVGIDSAWEVREPELFSNSGSNSIYGYINPFNNEDRYNELATKGHPAASQHNFHQAEAHAAFIQDVITPVPDVKLIVGARYDWYEFESTNRLLAPGAANRQRGYSDGNVSPSVGLTWQPVPAHSLYVSYNESFAPYGGRGMLSVSPSSTAVYDDEPQFQNQYELGIKSDWLDGRLNTQFALFSIEKNNIRYRPDPDNDPFTWAVQGEQRSRGAEFSFIGRVIDTVYVRGGFGWLDATVEEDVVSPLLVGNYLANTSKESGNLFIRYVPSDRWYGEVGVTHAGDQWTNIANTSKLDGYQRIDAALGYSLNNINITLALSNLTDEEYWRSSSMPGSPRSLLLRANYQF

SEQ ID NO: 13799 - protein, 700 aa, Solibacter usitatus
MRNIRPSQLGQYIRRALRLHFIPVVLVAAPSVMANTNQETEQLETLVVTASALKVETPAQETPKALSIVTQEEIVARAPQKLDEALRYTSGVTAQPYGADNDTDWLKVRGFDAATYQDGSRLFRDGYYTWLIEPYALERIEVLKGPASILYGEAPLGGVVNAVQKKPTDIPQGEVGLQVGNDALRTLTLDISITRIKTVPVRYRLVALMKENDWAVERYAKPARNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPNYGNFTPIDESSAADRTITKEQASLYAQYQIKLDQQWIGLIGGRMDWVDTENESQKNAQRKSRSDAEFSFNAGLMYLASNGVSPYLSYSQSFDVLSTIDSAKGELYKPLKGEQTEVGVKYQPEFYDGYINLAWFDITQQNALVTNPTTFVATQTGEMTAQGIEVESVGYVTDSLKLTASYTFTDAKTDETGGKGTQQAGLIPKHQASAWLDYDAAHIGLQGWTFGSGVRYIGESKDNPRSSDRTVPSVTLVDLMAGYEITENWQVQLNINNLFDREFVSGCDYWCYYGQSRSAVLSANYRW

SEQ ID NO: 13800 - protein, 1057 aa, Solibacter usitatus
MGYSQTSVSGTITSAQDQEPIPFANIIIKGTTQGTTADIDGNFSLIAPPSGTIFICSAIGYTTLEYTYTNQSSIFITLPVSQESLDEVVITALGIKRQEKELGYAVQALKAEEINEVKAVNFLDNLSGKLAGVSISQGATGVGSSSKITIRGEASFSNNNPLFVIDGTPINNQTVFNFTNEAAAGFQEIDFGNGAMEVNPDDIKSVTVLKGASAAALYGTRASNGVIVIETKDGANNKGIGISINTSLFIDSAFKLPDFQNEYGQGNSGQFEYVDGLGGGVNDNITYSWGPRLDQGLLIPQFDSPVLLPDGSVVRGGDTSLYSGLPITPTAFNSHPDNLKDFYQTGVTTINNASITNGFGNGNYRLSFTDLRSESIIPGVNLDRQTAAAKLHFEPSEKTTINSSINYVNSSSDNRPSNGYGSENVNYSLVAWGPRSLDINSLRDYWQPGLEGVQQNSFNYTFFDNPFFILNENRNSFSRDRLFGNMSLKHQFSSEFSITLRTGMDYSSEKRQLRRAFSSNRFQNGGYAEHDVVYREINTDFLLNYKKQLEDFSFDISAGGNSLSQTASTKQLQTVNLAQPGIFNLNNAASPIEAFQYESDKKINSFYGIAKLAYKNFLYVDITGRNDWSSALATPTSTDNASFFYPSISTSFILSNVIKLPDAISFAKLRASVAQVGNDTNPYQTSGAFISQTPFNGQPTFSNQNSIPNSNLRPEQITNYEVGFDLRFFKDRLNFDVSYYNAITKDQIISLPIAISSGYNEQVVNGGEVSAKGLEVVAGFVPVVNDNFRWNSTFNFSTSKATVKDLPQNDGRLTLAYSRIYDSANQTVWFQVEEGGQIGDFYGTGYLRNENGDFIIDDSGNFIADNELQKLGNYNPDFMLGWSNDFNYKNWNVNFLLDWRQGGEIVSRTSALGNVGGQLAETSNRPDGGIVAEGVVNTGTTENPNYVPNTTAISAESYYRQFYDRNHEENNVYDASYLKLRQFSIGYSFATNKGFLGLEEGADVNVSLLGRNLFAITENPHFDPEQLAVQGTGFVSGVEDMSYATSRSIGFKLGIDF

SEQ ID NO: 13801 - protein, 288 aa, Solibacter usitatus
MTKLLASLTAFTALTAAASAADLPRRAAPPPVFTPVPVFTWTGFYVGVNAGYGFDANSRNTTSYALPGGSLINSPGTAGVVSVSNRNNNDGFSGGAQIGYNYQFTPGSGVVIGFEADAQYVDFARRANATQNYSFLGFPGVAFSNPPAFVATSGNGLDYFGTVRGRLGYAFDRTLVYGTGGFAYGSGQDDQNFAGNRFRDSFRTGWAAGGGVEYALPTDSFLNFFRSSAVTLKVEGLYVSLDRQKNSAGGVFYGNLLPPNGIAYLNGAAAKTEFAVVRAGLNYKFGSY

SEQ ID NO: 13802 - protein, 683 aa, Solibacter usitatus
MRTLLLLRGAQASGKSTWVTENNLEPYTLNADKIRLNIANPILHEDGSIEISQKNNKLTWELLYKYLEMRMENGDFTIIDATHSDIKLMNKYRDLANIYKYTIYYLEFDTPLEECLKRNKERVGYKYVPEKVIERTWETIKNNEKLPSVLKKINSIDEIINFYTADVNEYKKVIIIGDIHSCAEPLKEVLKDFSEENLYIFVGDYFDRGIQAVETFKIMLDLLEKPNVILIEGNHENDSVKKFINNEEKYTKSFDETTLQPLLKEFELEYIKTGLKKIYKRLRQCFTFEFRGKKFLCTHGGLPLVPKLALVSAKEMIKGVGRYETEIGEVYSENYKKGLCQDFIQVHGHRGINDGEYSYCLEGRVEFGEELKVLTIDNDGNIEKSGIKNDVYNRGLIITTRDNSEKIKKFQTENELINEMIASSFINVKECDYNLISLNFNRDAFNRKKWNDLTIKARGLFVDRDSGEVKIRSYNKFFNYGERNINLRYLYKYATYPIRVFKKYNGFLGLASVINGDVVLTSKSVTSGKYKDIFQSIWDKVESEVKELLKQTMIENNCTVVFEVVSPEYDPHIIKYDKEHLYLLDFIENKLDLDTHNIDLEFSEKLMKKVKFSSTILTKKEELRRLENYDELYNFLHEKTMSLEEFEGYVLCDNSGLMFKFKLPYYMLWKGRRTWLESIVQPY

SEQ ID NO: 13803 - protein, 889 aa, Solibacter usitatus
MRKLYILIFALSLFTGTAFGQMVKGHVYDAETHEPLPGVNITYKKINGDTNGTISDADGAYEIALPDGGIDLLFSYIGYENEQLPLILRKGDTKTKDVYMNIKTNLLGDVVVSAGRFEQKLSDVTVSMDLLKAGDIAKQAPTDLSSTLNTMPGVDINDKQPSIRGGNGWTYGVGSRSLVLVDGMSALSSGNGVINWNIVPLENIEQVEVMKGASSVLYGSSALNGVINIRTKRPGLTPTTSARAYVGVYDHPVHDEYEGADVSHARRIGNFDVSGGLNLFSDDGYRDQGYNRRLRLGGNMTYHHPMKEGKLLNYGFNFNYLADKYADFFIWRSPVEVYQPSSIANMGRKGNTFYIDPFFNFTNPTNNTSHKIKTRFYYRGDNIIDGSSSHKSLDDILGNMGSDAVTVNAYIDNIKNGDYSPFFPLIQPILQGDLNGIVDGAVNILNGVFPTATTADYCDLISWVMNNNKENVPKGTDKNYTYYVDYQFNKKWDSGSQITAGATYEHMKSVSKTTGTHDSDNAALFVQYDQRFFDRLSVSAGMRAEYYRVDGYLREADTKLFGTKIPVKPIFRAGLNYQLADYSFIRASFGQGYRYPSLTEKYARKDIGGVGVYPNKEVNAEKGVNAELGFKQGYKFGNLTGFFDLAGFYTQYTDMIEFRFGIFNNTTFQYINGVRDLLSMITQGQMPGFGAQFYNVSKARIYGAEVSTNGVYTFNPNTTLSYNLGYVFIEPEDADYKKKNEEEATYDDPMQMKEKSNTSKYLKYRQKHTVKAILDFQWKRLTLGTNIVWKSKTLAVDYLMVDERAKEQPEIMDYVRDILFGNVNGQTLHSYWAKNNTPYCVVDLRAGVKIMKGLSFQFMVNNLFNKEYSTRPMLVSAPRTYVMQLSANF

SEQ ID NO: 13804 - protein, 388 aa, Solibacter usitatus
MSMFPHKLSLVLIACMPLSSYAFNGVYNTGSGQVSSGMGGVSLAQGMDRTSIQDNPANLSFQNSGADAQLSLLNIRAKATLLNQPEGFHSDKVIPIPSLALVQHYNDRLSWGLSLTGAGAAVDYDEPAIHGFPSDKAKDNLAIVKASPTVSYKVLPNLSLGASLDLGIQQFRAKGVLAGVDGQGTPIFLESHGNQWAYGVGASIGSTWEFQPNWWLGASYSTEMKFSKLDDYKNDLLARSEGRINLPERYGIGIKHKINQKLTLAADIVRFNWQDADGLGKKGSFNWQNQTVYRAGVDYQLTPHDHLRFGYSHADSVVDAQDTLVNFYANAVANQSWTIGYGHDLGFATLNLSYEYAVNKTLNGTGNSTGTNLSNQNHVITLGISKDF

SEQ ID NO: 13805 - protein, 823 aa, Solibacter usitatus
MKVQGKEQSFSNTYLAVAIRITIFGFCAISVGLNAYAEQYNQVSTIQEYHIAPSTLGKALSNFALQSGVALSFDPLLLKGINSSGLNGQYRVDEGFQELLKNTKYQIKQTSSGYALEEKPQNNKRVESVKLTPLLSKANQDLHSSGASSDALLPTISLKAEDRRASLQQKSGISALGNKSILDTPFSIAVVTSEEIEKRGAKSLGQIFANDPSVYTPTTSMTTDWWGTQIRGLGVRNYYVDDIPLSLAWGGDFPVEAADQVIALKGLTGFMYGFGSPGGAISYQTKRPTSSPQTSLQVDYRNKNLFSAYLDKSDYLSSIDLGYRFTLGGDTGQAYNDTKNKRVVSSFALDKQFNDQLSWDANVIYEYNDRKQEPIQFYLDQYEIGNTNVKLPRVNYNYSNLNIDDSYYKTETLVSSSSLKWKLNEQWNTKYQFGYSRKKHFSNKIFATLDNSQGDYIGNLYNFAGLSQYFFNQIMMNGKFKTSWIDHDLVMGAGYIKNYDTYSDFFWGDFFQGNLYTKPDYQITHPKNFDLISKGSPETQKYAFMSDTLSFGPKWQAILGTRYTKYELESQDNTSNNYRANKATPTIALLYKPIPESTVYASYVEALEPGKRVEAPYQNIGTILNATISKQYELGFKYEIDKLSLTSALFRVERAELMDSFRNGLRYLTQDGLTNYQGLEFDSKYKLTDRLKVGLGFIHLDSEIKHVSEDNQSIKGNSPAFTAKWQGVINSEYSFERIEGLSIHGNIRYNGSSFITNNNLIKVPAYTIMNLGTSYKFRLNGYDATLNTNLNNVFNKKYWAGGGYNAGTIGEERNGSISIKVNW

SEQ ID NO: 13806 - protein, 727 aa, Solibacter usitatus
MVRISPFIRWPNLVCHYTFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDNLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNKLQAGAFNYSLNRDSDESWYLRSENAYRAEVPLYASMLTQAMDYDRILAGSRSHQTGVSGENNSVRLSIQGGHLGHDNNGGIARGATPESSGSYGFVRLEGDLLRTEVAGMSVTAGVYGAAGHSSVDVKDDDGSRAGTVRDDAGSLGGYLNLIHNASGLWADIVAQGTRHSMKASSDNNDFRARGWGWLGSLETGLPFSITDNLMLEPQLQYTWQGLSLDDGQDNAGYVKFGHGSAQHVRAGFRLGSHNDMNFGKGTSSRDTLRGSAKHSVRELPVNWWVQPSVIRTFSSRGDMSMGTAAAGSNMTFSPSQNGTSLDLQAGLEARVRENITLGVQAGYIHSVSGSSAEGYNGQATLNVTF

SEQ ID NO: 13807 - protein, 856 aa, Solibacter usitatus
MRVVIKINLVRQIKFSLCDPAILKINFWATISILTLGAMCFPAHAQNSIFTGNEISNGPFSSHQQFFYDRSELNASVANTISGGSQYFYDASVLNASVTNAISGGSQYFYDTSVLNASVTNAISGGSQYFYNASVLNVSAAHAIRDGIQRFYGASVLNASADNAISGGGQGFHGSSVLNASGAHAIRGGYQSFSDTSALNASGAHAIRGGVQVFYNASVLNASAANAIRGGIQYFYDASVLNVLVNDALTSNTNIRFGIWLTGRPGGTLKLNGYSTLIGAINNISAGAGIIENGGATDSVLTVDTSVLGNSSFSGLLRDGGTGKFSLVKTGAGTLQLSGISNYTGSTTVTGGTLQAGVRNVFSSASDFTVTTGMLDANGFDQTVASLSNAGTTATNLKGGAVGTTLTVTGDYTGNGGTVLLNTELNDDRSRTDRLRIRGNTTGLSKLAINNVGGLGAQTVEGIRVIQVDGNSGGQFVLSNGDYAIGGQQALVVGAYAYTLQKNGISTPNDGDWYMRSRLKDLIPSPDDPERPLYQAGVPLYETYPQALLALNSVPTMQQRIGNRLWRTGAESNADISTRSDPNTGSWARLEGTAEHFVPTRSGSMARYDIDRYKMQVGLDGLLGETSAGRLFGGLNLYSSNGRTKVSSSHGNGSIHTDGVGFGGTLSWVGDNGFYIDNQAQVTFYDSKLLSAVAGRALVDGNDGYGYTWSTEVGRRFVLSPGWSVTPQLQLMYSKVSFDSFTGAFDTAVALDSGKSVRGRLGLSLDHENAWQAKHLRVYGIVNLYNEFMQGSKVYVAGAPVSSANERLWGGIGVGGSYTWADGKYMVYGEGSANTSLNRFGDSYVIAGIVGIKIAF

SEQ ID NO: 13808 - protein, 666 aa, Solibacter usitatus
MRTLFTMLVLCVPLTAQLEPLKTTIVITADPVQPGIDRRDSEVFTRTLFSRDDQIFHVLDAGINAGQHEGGGKSLEIRRFGFNLDHGGFNGGLKVLVDNVQQNQGTQGHGQGYLGSLKSLSPELVEGVDIVNGPFNAEYGDFSGLGVVHIRTRDSMPDVWTVRLQAGSFGSERGFFSFSPELRNGDALFAYEGSHTDGPFLSALRYTRHNFTGSVTRRLSAQRSVGFKYNAGLNEFFSSGQIPLDEVAAGQLDRFGYIDPSDGGRVRSGTASAYLRQEDSHGGVLKVDAFATRSLFDLYSDFTFFLKDPVHADGIQQHDSRLIEGANAQYQLVHKLAGTQALLTIGGNFSDNQINVGLYPSERRVPLGVDTRDHAHVTNAATYAQESVTLLGGRILAGAGLRVDEFRFEVAGRDPVRSTLAQPKLSFSYRPTLSLPVTLYANYGRGVSTADARGVVQQRGQPAVSTTDFYQAGSSQHFGRISTSIDGFWIDRSHEQVYIPDDGTFEFKGPSRAYGLEAKASVELTHHLSFNGGVTKVMNAYYRGDPRVYVDSAPHFTANAALTLAGWRQWSASLRMGAINHYRLDGSDSSIVAAGHTVFDMGISRRVGRTVELSLALDNFTDRDYYETQNYFESQLRGEAPLWRIHGTPGYPLTATAGITFRLKGK

SEQ ID NO: 13809 - protein, 843 aa, Solibacter usitatus
MSMKSRSLAALLVGTAALLSPEGAQAMQAPRQSYDIPAQDLGDALRRAAALADIELYVSAQDIEGKRAPAVRGQLTPREAIEALLAGSGLTARFESRSVIILSDAAVPAIPAGEPEVIIVTGSRIAGAPAAAPVIDISAEDIRNAGHADLGEVARNLPQNFGGGQNPGIGSGQGVANENGNVNGASTFNLRGIGPSATLTLLNGNRFAYSGTQSAIDVSAIPAAAVERIEIVTDGASAIYGADAVAGVVNILLRKDYEGITTSARLGGSTDGGNFQQQYGLLGGAKWSGGGFLAAYDYFENSAILARNRSYAASSNPASTLYPELKRHSFLLSAHQQVVAGVQLKTDAIYKRGDMTSVRGLIVDRPITTRGTIVTNEFETFGIAPTLEAEIGGSWNARISAFYGSDDTYGETQNFTNGVATRPIRIFNNRSVSVEAGVEGAIFALPAGDVRLAAGGGWRRNRLVAEVNGRGFTGRRDNLYAYGELFLPLASPAQDLAFLHRASITAALRFEDYSDAGSIVIPKLGFVYAPAAELSIGLSWGRSFKMPTLNQQFSGYTPVLLPVTGYGTMFPAGSTYIYLGGRNPDVGPERSENITLSATFRPSPRLQIVTSLFRIDYRDRVAPPFGSPLGTLSNPLYADFITFNPSAVLQAEAIAGAADPLGNGTSGPYSPATVIAIIDGRDRNIAAQRYEGADLAIRYRAPLGKQTVTLTANATWLDSRQRLLPGLPNIDLAGTIFNSPHFRARGGATFGDERFTLAAFANFTGGVTDRRRAVPVSVSPVTMFDLSARVKLGRLAEISVNALNILNAKPDMTAVASASDTPFDTTNYSAVGRFLGVTISRDW

SEQ ID NO: 13810 - protein, 612 aa, Solibacter usitatus
MRGQGDKSNIAVKVMIDGRAINVLDNSHGVTPLDSINLDNVERIEIIPGGGSVLYGSGTRGGVINIITKKQKSDAFAINLKSSAYDHGGLGGNLGINGAKQINENLAFSFDIQSFNLDGYQEGYNEKGYFINTKTYIDINDNSDLTLGYNYFKSKNTSSGYLTKAQAQSNPTQKGNSDNITQINRPEISLDYHYYFDDIWEFNLEAFWQNQKINYLKDVSTMSYRGMSLPVYQNGSGFEDTLTGISLKNKLNYANNSYFIFGYEFTNHDAKRTSIIHYDVSTNMSHTMTTLMDMDKQSHSIFALDSHEFNDIFSISGGARYEYNLYDTNRNYTSNMIILGRPNIKTELFSTDDTSHNFAFEITPNFKYSDTGKLYIKYERGFISPSPAQFVNKDKNLQKYYSANLNPEIFDTFELGIDDFWWDFYGFNLTLFYTLSKDEISYLGNPHATGGGFWQYYNIDQTRRLGVELSLSQNFLDDDLIFRESLTYLDAKISKGVNDGIRIPYVSKIKATAGLEYAWNKNFSNFIDLTYFSRAKDGGTIDGNTGKMSKNSWIRDYFLTDIGMKYNYKKLQILAGIRNLFDKRYYTYQDSINDQYLVGNGRNYYVEIKYAF

SEQ ID NO: 13811 - protein, 733 aa, Solibacter usitatus
MRHVSAARPARQRLLHASITAAFGTAAVLSTPLAGAQDASAGSTTLPTVTVTGGAEESATGRVNGYTARRSATATKTDTPLIETPQSISVIPADLMEAQGARTVKDALSYSPGVIPTRFGADSRYDWISLRGFDAYSPGFYLDGMPLRNNGNWGIWPVESYGAERIELLRGPASVLYGMSGPGGLVNAVSKRPTAEPLREVQVQIGDHGRRQIAADVSGPLREDGKLLYRLTALTRDAELPAGDMKDDRTFIAPAFTWKPSGDTSLTVLSQFGRTRAGVYSRTRPAVGSLVPTAIGTTIPSDLFAGEPGYNRFDMDTAMIGYLFEHRIDDAFTVRQNARYGRLEVDYTAVQGRNFITVNPANPRDPANFSTLRRTVSGSNERIHALNLDNQLEARLRSGDVQHTVLAGLEYQRTRIDQVSYSGGSASPLDIYNPVYGGAVQLPAPWYDGVATLAQTGFYLQDQIKWRDRWVLTLGARYDRATSDADSRLDGSRTRVSEHKATKRAGLTYLAESGWAPYVSYTESFVPTAMRNPATGQPFKPETGRQYEAGVRYQPEGGRQRYSAAIFDLRRKNYLTADDNFVPRQTGEIQVRGLELEASAELMPRLNVVGSYTYTPTAKITASSTAREIGKPLTAVSRNAAALWVDYRFANRIKVGLGARYTGSNHGDLDAAPAKVPSFTVFDAMIGYDIDRWSFALNVRNLGDKTYIGNCDQYGNCYYGDPRRVVATATYRW

SEQ ID NO: 13812 - protein, 693 aa, Solibacter usitatus
MHKTLLATLISGLLFASSLYAEETESDANIEVISIKGSRLDKAATATGLPLTLRDTPQSVTIIDQEFIQSFSLNNVADLMFLTPGISAQKIETNRYFFSARGNPITNFQFDGVPVNYSSFFNDASTDTVIFDRVEVVRGATGLLTGAGEPSAAINLIRKRPKSSPGGYLSAKLGSWDSYRVEGDSSVDITDDGDVQARFAAAYEKSDSFTDLAEDENLQIYGVVTARLSDSTLFTLGADYSDRDPKGSTWGALPLFYADGSLANDLPRSTTTAASWSSWKRHGTNVFSTLEHSFENNWELKLDIEHREDKMDGHLLFLYGAPDKTTGLGMGASPMIYQSTRKQDAARLFASGPFELFGREHKLTTGLLYSKQDISADSYYTTDVLSVGNFFEWDGSIAEPNYPSTPTTQETEEIQKGAYIATQLSLHDQLTLLLGSRISQYKIDPGYEHNDVITPYAGLVYDITDSVSLYTSYTEIFQPQDAKDANNKRLDPTTGNNIELGSKADFFDERLTASVAVFKVQKENVAERDPNFKDPLPDGSFPMRAVDGTSNRGFEMELTGRPTEDWDLYFSYTYSESEKANGEAFGTHLPKNLVRLSTLYHFNGALEDLTLGGNLSWQSKIYVENAGPNGASSEQDSYFIANLMASYQITDDAIVRLNIRNVFDEKYYSSIDFYDQGFFGEPRNVELSLSYNF

SEQ ID NO: 13813 - protein, 444 aa, Solibacter usitatus
MRKISLISIAMLIVSIPTFAGGLLTNTNQHPAFLRMLSRGANTTSVDAALSNPAGLAFLPKDGFYTSLSIQSAFQTRNIDASCEALGLDKYYEGKASAPVIPSVFAAYKKGDWTISGFFGITGGGGKASFDDGLSMFDAMVIGGLLQQGIPGKAYTLNSYMDGKQYIYSVQLGLTYKITDWLSAFAGGRMNYFTGGYKGALNASAAVDLPLPTGGAIPVGTELIGIDLDCSQTGWGFTPVIGLDAKFGKLTIGAKYEFKANLNIENNTKINSLRMIGAPESELEDYKHGVNTPNDIPAMLSVAAAYEFLPVLRASVEYHFYDDKNAGMAGGKQKFLTKGTNEYLAGIEWDVIKRLTLSGGVQFTDYGLSDDYQSDTSFSCDSYSLGVGAKLQLSERADLNVGYMWTNYEDYTKTGQNYQGTNLPGTNVYSRTNKVFGLSIDYRF

SEQ ID NO: 13814 - protein, 921 aa, Solibacter usitatus
MKPKTKLSALSLAISMAALTPTTLFAAEAADKSDAKKEMEKIEVTGSRIKRADFEGVLPVTVITADDIANSGLNSISEVLQSSVANTGGSLNGESDGYTDSASSVNLRGMGANRTLVLINSRRQASFPSAAGGTSNFVDVSDIPAAAVERIEILTGGASAIYGSDAVGGVVNIILKKEYEGAKVSAKYNDPTQGGGEELDLSYLQGFNTDKSQTLLILEYKKAESIQTYQRDGLYSPAYYENEDGDLTWGAGPYGDAAPSSWSSRITDYSKVYHEDKYVNLSEQQCGELFGDKGIYRPTYKYDCYYDKYADRGLKSAYDRFNLVLNSTYDLNDDWQLYGMVNASYKESTKYKDEKGFGTSIYQDEATGALSYDKYEFEDDNRFYLARRMEEYPGPRTYDTQNTKASLSFGADGNIGEYELDLSWSSSYNKYEKQNHHMVKADALLDIVTFDPNDADPSKWYPNSQMTTEQANMLIADSTKNSDSSLHQFQAVFAGDLMELPAGTAGFATTAEWARESYEDTLDDVTSSGGLIGMGGTGGKGDRDRVAVAGELQIPLLANITGIRSLDLSAALRYDQYLDDSDVGGATTPQVGLSYRPIDEVMVRANWGKSFRAPDMHRLYAGRTIGFGGTDYPHPTIPDEIYEDDYRSITQGNLNLEEEKGEYWNFGIVANITDNADITVDWWNIELDGAVKTISTDEMLADPSYYQTGNYTSCEEMDRVGYLTEYDDDGIENIACMRKGPINSAYEASEGIDTSFNYQFPETAIGDFKFKVAASYLIKKEYQERIDSEIEEQTETDYFPKWKGNASLSWNYEDFSATVAYYYTGEAQGVDLFEYQDENGDDVESMETDTLDAYQIVNITLSYYAPWEGKFTAGVKNLTDEMPPLYDERNDKHNDWPFYEDDNSSYSNTGRSLFIGYSQKF

SEQ ID NO: 13815 - protein, 478 aa, Solibacter usitatus
MRSFLPLSVTAPTRFRVPFLTAALLAIPATGAWAASPDGSPIAAPATAAADGDAPPEPRVALHAQTTYVWQRKPAFDAAYTGPNSLVPTRERSYSFTATADLAVRPWEGGQLHFNPEAARGVPLSHLAGAGGLSNGELARSSGSQLKAYRARLFWLQRWNAGGETEKIDADFNEMGGTATARRWTLVLGNVSLLDYFDPNPYAKDPREQFFNWSFLAPGPWDYAADARGYTWAGILEYRTPQWAVRGGRGLQPRESNGPKLDRAWQRRYGDQIEAESDLPVALPAGPLRGRVLWFRNRAVMGAFDDAVALGQAAGTVPDVGAVRRLQTKTGWAVTLEAPLGEDAGVFVRAGRSGGRQETFAFTEIDRQLSVGGQWSGAAWGRPADRMGAALAVNGLSGGHRDYLAAGGQGAFLGDGALNYGRERVWEVYYRAVMPPVPTAAGALHSAVSLGAQRIRNPGYNRDRGPVDIVSVRLHAEF

SEQ ID NO: 13816 - protein, 2210 aa, Solibacter usitatus
MSACIALALSGQGWAADITEVETTTGEKKNTNVTCPADPGKLSPEELKRLPSECSPLVEQNLMPWLATGAAALITALAVVELNDDDDHHHRNNSPLPPTPPDDESDDTPVPPSPGGDEIIPDDPDDTPTPPKPISFNNDVILDKAEKTLTIRDSVFTYTENADGTISLQDSNGRKATINLWQIDEANNTVALEGVSADGATKWQYNHKGELVITGDNATVNNNGKTTVDGKDSTGTEINDNNGKVIQDGDLDVSGGGHGIDITGDSATVDNKGTMTVTDPESIGIQIDGDKAVVNNEGESTITNGGTGTQINGDDATANNSGKTTVDGKDSTGTEINGNNGKVIQDGDLDVSGGGHGIDITGDSATVDNKGTMTVTDPESIGIQIDGDKAVVNNEGESTITNGGTGTQINGDDATANNSGKTTVDGKDSTGTEINGNNGKVIQDGDLDVSGGGHGIDITGDSATVDNKGTMTVTDPESIGIQIDGDKAVVNNEGESTITNGGTGTQINGDDATANNTGKTTVDGKDSTGTEINGNNGNVIQDGDLDVSGGGHGIDITGDSATVDNKGTMTVTDPESIGIQVDGDQAVVNNEGESAITNGGTGTQINGDDATANNNGKTTVDGKDSTGTEIAGNNGKVIQDGDLDVSGGGHGIDITGDSATVDNKGTMTVTDPESIGIQIDGDQAIVNNEGESTITNGGTGTQINGNDATANNSGKTTVDGKDSTGTKIAGNIGIVNLDSSLTVTGGAHGVENIGDNGTVNNKGDIVVSDTGSIGVLINGEGATVSNTGDVNVSNEATGFSITTNSGKVSLAGSMQVGDFSTGVDLNGNNNSVTLAAKDLKVVGQKATGINVSGDANTVNITGNVLVDKDKTADNAAEYFFDPSVGINVYGSDNNVTLDGKLTVVSDSEVTSRQSNLFDGSAEKTSGLVVIGDGNTVNMNGGLELIGEKNALADGSQVASLRTGYSYTSVIVVSGESSVYLNGDTTISGEFPLGFAGVIRVQDKALLEIGSGATLTMQDIDSFEHHGTRTPELTYADSGAKIVNKGTVEIQNLGFAFVTGENTTGINSGTISLLQNGKDPAPSPIVLLATNGGSATNAGTITGKVTEQHSVFNKYSTGTSNSFIFNNDVSSITGLVAQSNSTIINTDSGIIDLYGRGSVGMLAIADSTAENQGKITLDSMWVDANDTTAMRDIASNSAIDFGTGVGVGTDSYSGAGKNATAINQLGGVITIYNAGAGMAAYGASNTVINQGTINLEKNGNYDDSLAANTLVGMAVYEHGTAINDQTGVININVGTGQAFYNDGTGTIVNYGTICTFGVCQSGNEYNNTDDFTSLIYTGGDTITRSGETVTLNKSAAVTDKLAGNVVNSGTLSGDQITVSSGLLENTSGGIINNLVKLDKGAVIKNAGVMTNNVDVSGGILNNAGEMTAQITMNAGADSSLVNNTGTINKIVQNAGVFNNSGSVTGRMMSAGGVFNNQTDGAIMRGAALTGTAVANNEGTWNLGSSSEGNNTGMLEVNNNSAFNNRGEFILDNDKNAVHINQSGTLYNTGHMNISNSSHNGAVNMWGGNGRFINDGTIDVSAKSLVVSANNAGDQNAFFWNQDNGVINFDHDSASAVKVTHSNFIAQNDGIMNISGTGAVAMEGDKNAQLVNNGTINLGTAGTTDTGMIGMQLDANATADAVIENNGTINIFANDSFAFSVLGTVGHVVNNGTVVIADGVTGSGLIKQGDSINVEGMNGNNGNSSEVHYGDYTLPDVPKPNTVSVTSGSDEAGGSMNNLNGYVVGTNVNGSAGKLKVNNASMNGVEINTGFTAGTADTTVSFDNVVEGSNLTDADAITSTSVVWTAKGSTDASGNVDVTMSKNAYTDVATDASVNDIAKALDAGYTNNELFTSLNVGTTAELNSALKQVSGSQATTVFREARVLSNRFSMLADAAPKVGNGLAFNVVAKGDPRAELGNNTEYDMLALRKTIDLSESQTMSLEYGIARLDGDGAQKAGDNGVTGGYSQFFGLKHQMSFDNGMNWNNALRYDVHNLDSSRSIAFGNTNKTADTDVKQQYLEFRSEGAKTFEPSEGLKVTPYAGVKLRHTLEGGYQERNAGDFNLNMNSGSETAVDSIVGLKLDYAGKDGWSASATLEGGPNLSYAKSQRTASLAGAGSQHFNVDDGQKGGGINSLTSVGVKYSSKESSLNLDAYNWKEDGISDKGVMLNFKKTF

SEQ ID NO: 13817 - protein, 729 aa, Solibacter usitatus
MARSKTAQPKHSLRKIAVVVATAVSGMSVYAQAAVEPKEDTITVTAAPAPQESPWGPAATIAAKHSATATKTDTPIEKTPQSISVVTNEEMQMHQFQSVKEALGYTPGVTVSSRGASNTYDFVIIRGFSSVGLNQNNYLDGLKLQGNFYNDAVIDPYMLERVELMRGPTSVLYGKSNPGGIISMVSKRPTTEPLKEIQFKMGTDNLFQTGFDFSDALDDNGEFSYRLTGLARSTNEQQKNSESQRYTIAPSFSWRPDDKTNFTFLSYFQNEPETGYYGWLPKEGTVEPLPNGKRLPTDFNEGASNNTYSRNQKMVGYSFEHGFNDTFTVRQNLRFSEMKTSQKSVYGTGIAGDGHTLNRGTVVDNERLQNFSVDTQLESKFATGDVEHTLLTGVDFMRMRNDINASFGSAPSIDLYNKYHPEYFAFGSAEPYQMNESKQTGIYVQDQAEWNKWVFTLGGRYDWSKQATTVRENSYTPTEGYIERNDHQFTWRGGVNYLFDNGISPYFSYSQSFEPSAFDLWSNPRISYKPSKGEQYEAGVKYVPNDMPVVVTGAVYQLTKTNNLTADPTNPLAQVPAGEIRARGVELEAKAALNANINLTASYTYTDAEYTKDTNLKGKTPEQVPEHMASLWGDYTFNEGPLSGLTLGTGGRFIGSSYGDPANTFKVGSAAVMDAVVKYDLARFGMAGSSLAVNVNNLLDREYVASCFQTYGCFWGAERQVVATATFRF

SEQ ID NO: 13818 - protein, 799 aa, Solibacter usitatus
MKFVPFFARNQSNRRGRGAWCLLLSTALTGLSAAHAADPTPAAKPRATQHTAQPAPRRAAPAARPVQPASPPQPESIVVFGQGSTRQMTSVTTSMMRQSVPGTSPLKVLDQLPGVLYQSADPFGAYEYSSQVFMRGFSQNQLGFTLDDIPLGDQQFNNYNGLTITRALTSDNIAGVDVSQGAGGIDVASSSNLGGAIQFHSIDPSHTRGGTVEQTFGSNATFRTFVRLNSGDLNPTGTRFFVSYARTDMNLWKGQGYDYSDQVNAKLVQPLARDSSLKVFFDWSSTQQFDYQDMTPNYLRTIGPGLANYYPDYTAAYRAAQGIYPAQYTKSNDPFDAAYYAGTANRVDYLGGVTLDENFNSHLNWKTTVYGHGDSGYSTWSTPYMHSPNRAPLSQRVQNPGITRAGFLSAVTYTVARNTINAGVWYEYDQFTENRAFAEAPLLGTGTLGNPTGGYPGNVFAAPWQEVFNTNTFAFHLQDTYHVTHNLTLNAGFKSMIVSAGNHVPGQVPALNGGNLIAQGSLTASNAFLPQLSANWRFLPHHELFFDVSHNMRSYPEDGYGTNVSATPWTANQTAFQASKASLRPETDWVYEGGYRYTSPLVSGLVSLYRINFSNRLQLISSNAGINPITAVQNVGGVTTNGAEVSATVRPVDGLSIYNSFSYAHSTYDQNVMTATGLEPTRGKLVPNYPTFMYKGSIAYTIRNFNVHVDGNYISSRQLTYTNDLHVPGYFLANFGMRYNFGDVRFLKGVTASFNIYNLANKTYVATTNELGNNFTDTGYNYFLLGAPRQFFGSVSANF

SEQ ID NO: 13819 - protein, 749 aa, Solibacter usitatus
MKTQLTRKILGSCILFSGIHSLVFAAETEKTVQFSSLKVSSAQKQTPEQKALSKPGAYSAIGEINNLSSVEQALRSTPGTYTQMDASQPGVGVNIRGLSGFGRVNMMIDGVTQTMYSTSPSQYAHGGQPYNQFNSMIDPNFIVQIDISRGQQDGENSINALAGSANFKTIGIDDVLFSNHRWGIRSKAARGTNGLGYNGMVAIAGKQPILNHDGYIGAIFAISGHNIESSYKNGAGFNSHEFATTKDFNQKPHSELAKISFKPNDSHEIELSGRFYNNKFNRRTIESQDYYAKYRYTPLNDLFDSEILLSRSQASQKFAGDSLMSLRNGHAKNISNALVAKNTSRFNYHELDMALTLGTKLMSIDYNREVTAPSSDPWQSQNMIEYNVFAPQGKNDISSLFSQIKFEYDIYTLALNLNYTDYHIKGYKPACDPKAACFPEGAMNVNRHEKAWEPGALFSAQIIPEFEPFISYAHTTRAPNPQEIFFANEGGASMNPFLRSEKADTFQIGFNSYRPDLIVAGDSFRLKALWYHTKVKNYISSDSYNVCKGGKRCKIDGTFTDDDYSGMEYDGNIYLYTNSLDPVTMRGYELQVNYDADVFYTTLSYSNERTSQPTSLAMGDFGQSPASELPKYYATIDAGVRLFDDRSLELGTIIQITGKSRKASAEGFDFDTGTIPMVEQEKIPTVINAYANYQMNKNVSLKFAVHNLMNKNYSNALDRSNSAPIMDEQGQNKQTARGRSFLFGGEIRF

SEQ ID NO: 13820 - protein, 434 aa, Solibacter usitatus
MSFNTIIDWNSCTAEQQRQLLMRPAISASESITRTVNDILDNVKARGDEALREYSAKFDKTTVTALKVSAEEIAAASERLSDELKQAMAVAVKNIETFHTAQKLPPVDVETQPGVRCQQVTRPVASVGLYIPGGSAPLFSTVLMLATPASIAGCKKVVLCSPPPIADEILYAAQLCGVQDVFNVGGAQAIAALAFGTESVPKVDKIFGPGNAFVTEAKRQVSQRLDGAAIDMPAGPSEVLVIADSGATPDFVASDLLSQAEHGPDSQVILLTPAADMARRVAEAVERQLAELPRAETARQALNASRLIVTKDLAQCVEISNQYGPEHLIIQTRNARELVDSITSAGSVFLGDWSPESAGDYASGTNHVLPTYGYTATCSSLGLADFQKRMTVQELSKEGFSALASTIETLAAAERLTAHKNAVTLRVNALKEQA

SEQ ID NO: 13821 - protein, 589 aa, Solibacter usitatus
MRKVKMWKLFSQCLKMTSGVAALSVIVAQSAIAVPDENQINATQGDLVSPEEALGILQNRPTLQTPLNRDTSKQFRDGTADSGMSQVTSISELRDVSPTDWAYEALRSLVERYGCIVGYPDRTFRGNRATSRWEFAAGLNACLNTMERLIQENVAVLREDIEKLKRLAQEFEQELIALGARVENLEERVAFLEDHQFSTTTKLSGEVLFTVSSASGERALDSRQTDAIENFGADLPGATRRIDDNATLGFRTRLNFDTSFTGKDRLRTRIETGNLVRYDRATGTVMARLGHDIFNDADVAIGDLYYRFSVGDLTTWVGASSLDIDDIFDVGTPFLASSGTGALSRFIRRNPLVFRGPEGIGGGFAYSMFNDVVAVRGLYLSANGNSPDLGEGLFNGEYSAGGQLGIYPTDNLDFTFTYLLSYFPEGDVNTSSSNGSRVASDPFLEAPTLRDSYGIQGDWRINDMFHLTAWGGYALARAQGQDEDGIDRSGYGADLWTWSAALSVIDIFKEGAVFSVAGGQFVTAERIDAFPGDLRVPDKDTPYIIEAQYQYPLNDNILLTPGFYVVINPEGDEFNNSIWVGALRTTFKF

SEQ ID NO: 13822 - protein, 791 aa, Solibacter usitatus
MKIHRTSRRDLVVAVSLVSIAMASAGVSAQQDAGSEASLEEVFVTAKSVSFGNNTVTDSMKAQQSPITSVNALIDNLPGVSIQEGDTYGFDDWSTTISVRGFQNTLDTQQIGSTIDGMPNGNSNYGGGAKANRYIDSANIETVSVSQGTADIASRSLEALGGTIDYVTSDPTEESRFRAQGSVGEFDARRYYLRYDTGMLGESTRAWVSVSQQEASDWVNGAAENERDHIAAKLVSQVGIAEIKAYISYDDTHEDNYQRLFSPEEFVANAESDRLTETWTGIPYQDQVYRRGWSTLRENLLGYVTADLAFTETLNLKVGAYYHDNEGRGDWLPPYLVNVVDDMGGPESEFTGNAGTNGGPFLGQIFFVDANGATLSPADGCVSSITFPYGGAGPQYDPACYADGAIPVGSFRNTNYEKERAGLMVDGDWTADLAGFTNTLRGGIWYEDQTRDETRTWHKITDSRVEFAADPEPYWTQYNRSYPQEVFKWYVEDTVDIGAFSLTAGVKQFLVDVAREDNFQETTDVSIDSDSDVLLSAGVVWQTPIDGLEVFAGYSENFKAVSDNILERPDSDLSVLEPETAENQELGLRYRGDRLFLTATYYQIDFSNRIIFLGAESVAGPNYLIGDTGTYFNAGGIDSTGFEVTADLRLTDSLSLYSAYSLSDSTYIGTGDPLVDAGLGVVPGNDVTGIPDQQLVMSLDWSWERFSAGISAKYTGERPVRLDNSWIADSYTTADAYLTVTGGSRGDFLQGWNISLLVNNAFDEDYLGGISGQGAWIGAPRTVSASFTVDF

SEQ ID NO: 13823 - protein, 562 aa, Solibacter usitatus
MQRNKLPLYFLAGAAMAPLANAAAPVANNDSAALQMNGFTNIDVLANDSDPDGDSIRLVSFVQPGHGTVTTTDGPWLRYIPDEDFVGQDTFTYKIIDIVECTPDDDYGGDYGGDYGGDYGGEFVLPPSEVKPPQARCEEPIEVQGTVTITVTKAPTSELLPLTDNENDRQVSKVLDAICGSIPEDATGEAEKLAQRCATLYELATDDPTKVASIINQLAPEETLSLLRVASETSQAHTNRIFKRMTSLRQDNENIQVTVNGRTWGQQAMTGGAAGDVQTSPFGVFLSLHRESVEHDKTERESAYEYDNDGFTLGSDYRVSQNLLVGAALGWGQNDLSFSESGGGVDADAYNLTGYGSYYIGNFGLDMQVGYGAGDYNTKRRINYTESGSEFSATAKGETDSKQLNVALQASVMFNSGALSVQPFLRLNYSNTEIDSFDETGGEGWSVHVGEQNLDQMTTSAGFEATYPVSYNWGVLQPSFQASAVSESSTNFGPVKFHFIGDSDATKFELSPDGEDSLYYIFNLGAVAVMKNGVSAFIDYQQNVSYDNSSAFQINTGLRYEL

SEQ ID NO: 13824 - protein, 771 aa, Solibacter usitatus
MLRRKYNKRTTGSLRYDAAVLQCGRESGRFALNAGAMKLLPFSLISALATGFAHAQEPTAAPSAASSTTAATPFAASQAATATTVSATAATSTTLPEVTVTAERHVTDLKKTPVSVGVLGADRFTTGGVAQPGDLNAATASLVAGGPSQRTAGSGGIYIRGIGTGSPTYSSAVALYVDDVYIPRSLGNGLYMAFPDVERVEVLRGPQGTLYGMNSSAGARKVISLDPTDNSAWIQGTAGSYGALGVKAYVSHEIKPGLLYFSLAYGRYKDDGYTNDPVIGRSIDSTNTEVLRGKVRLTPTADTEALFSYDIERDRSDTYSYIAPNYPGSGIRTSYENTDPSIDRDISGVSLRLTKKFGDHLSLRSITAHRWISDGRYPLTQDGVPTDLYGWLLNIDQHQTSQEFQFNGDYDRFSFTTGAVYFSEDVTDFRPSWTSGVYKGIVSQIENKSYAAYAQGHYKITPQFGVTAGIRVNRDEQNYQNTGFASNAALQVLGTTFQTGQLTQNVNSVTPKIGIDYQWNPNIFSYASITKGEKSGGYNPVAASLAISQIAVSPERVLTYELGNKLTFWGGRAQLNTALFYNDFDDYQAAIGNAIINGQLINGSVTVNAGKARTYGAEFELTARPVSDLNVNTWLTVQQAEFQQFVNPTGAPTGNYVGNQLPYASHIIAGVHATYRLPLHVPGTTRIGATVRFLSHSYIDIANQQPLGAQTYIDAMAEYTSPSSNWTATFEVRNLLNRAYVLGYNVTPSIGLNAYNYSPPRTFMVSLRRDF

SEQ ID NO: 13825 - protein, 805 aa, Solibacter usitatus
MSIRSQRATPSMAALSLFFAASIAQAAPSPQNASPGAESDASPATQSRYGGAKEDATSSASAEDSGYGEDADEREITVHVDPVHDYRDASAVDRRTMQTRLPRSAPDALRYEPGVFVQQSGHGQASPYVRGLTGQQTLIAFDGIRLNNATFRQGPNQYFFTVDSRTIAHLEVVRGSASTRWGSDALGGALLTTPLEPNLGRPAPRRSGNGNGGEHAAAEGRRPTGWVVHPRLAMTARTADGEAGARAQVDLGWGGKIGLLTGVGYRVVGPLRTGGPVLSPATGEPWREPRFDSDQRTQLGTGFRELSADTRLVWQFNPRMRLTAAYYDYRQKDAPRTDKCPPAEAPESECLRYLDQFRTLTYLAFDSERGPAPMERARVSVSYQRQHERTQLLRDNGIPEIDGGTESNGRDRVHTLGLRATASTASWSVGDSGVSTVGVDYGADLYFDQLESLAWLRFTDVDPVITDVLSRGQYVDGSRYLSSGAWVEPYVWAGPRVRVRAGGRAALVHADSPGDEDSGTRVIERTWGAVVGNAGLMVLATEWLSWHLDFDQGFRAPNLDDLTSRQQTGPGFQYENADLEPERSLSLDTGFRVRHERVEASLFAWHAFIRQLIGRAPREIDDCPDDGVVNPTGCGASRTRFQLVNLDGWALLRGVDASVRVFLPLGLAVRTTASWTWGEGPNPVPPPEAGTTSNYRARLPLSRIPPLNGSVELMWNHRTGVWLGSALRWATAQTRLALADESDTRIPLGGTPGYAVWDLRAGYRFDPNVLVSAVFENVLDAAYRYHGSSVNGATRSLNLNLELGF

SEQ ID NO: 13826 - protein, 258 aa, Solibacter usitatus
MLIQKSLIAIGVAVAFPPAAHAEKFFGGTSISILQSNQYQGVEFDAGGNGGKEFEATFFTFENATAHNWGSTFFFIDRDQGQGNEEGTDNLYGEFAPNLSGNWLTGSDLSFGPVKDVFLAAQYEFGDDGSNPINNYMGGFGLAWDVPGFLYFNTSFNYVDNEQISNDLQLTVTWGAPFNVGSALFLIDGYIDWSTAESDHESEFQFVPQIKLDVSNFWGEPGVLYAGVEYQYWNNKFGLGDNLMDTQSSVSALVKYHF

SEQ ID NO: 13827 - protein, 358 aa, Solibacter usitatus
MKVGNTRRSHAMALAGVLAGASCGVTQQAQAQSVSTSISVYGLIDTMVRYSDNNRGDERLAELSEGYFSGSRWGARGNEALGAGWSALFNLESGFDLASGTSLQGTAASNYGQVGTQGTGRLFGRQSYLGIEHQAWGKLTFGRQFTTAYDATFRFQPYGHPNLDAVAILNGYTGPRQDNMAKYAGRWGAFSAAAHYTFGEVPGDAAASSSRGLALAWTTARIDIGALFQSTNALATEEKRTIWGIGGSSQLGRVKLALGYLDNRYHLSPTRNHVLTGGATVQATPALAVSLAAGYDRQSAASGHRLMLTSVAEYSLSRRTSVYAEADFNRISGSYALPAFMGVRGNKFGGGVGLRHRL

SEQ ID NO: 13828 - protein, 737 aa, Solibacter usitatus
MRTLAPVALAAAMACQLPAAYAQSETPSAPADANATVTLPPITVKASADASAQGLSPAFPGGQVARGGRAGILGTKDNLDTPFSITSYTNELIQDRQARSVGDVLQNDPGVRVARGFGNFQESYFIRGFILGSDDVAYNGLYNLLPRQYIATELFERVEVLRGASAFLSGATPSGGGLGGSINLLPKRASNEDLNRVTVGAASGPQGSAAVDISRRFGPDRSTGLRLNAAYRDGDTAVDEEKTRLGLVSLGADWRSRDVRLSGDIGFQDNRLKRTRSSVTLGDFLTPVTAMPAVPDNETNASQPWSYSNEKDVFGTLRGEVDLGADVTAWAAYGLRRSDEANSLANFTLLDPVSGDGYTYRFDNTREDRVDTGELGLRGKLRTGSVGHEWVVSASYFRLETKNAYLFDFGNQQATNLYRPVRSPEPAFSAGAGGGNDLASPALTARTRLTSLALGDTLSFDGDRFLLTLGARHQNLRIENYAYTTGVAAPVYDDSRVSPLVGAVYKATKQLSLYANYIEGLSKGDTAPATANNPNAMLAPYVSKQKEIGAKYEADRLGLGAALFSTDKPRAVGGTTGTTFTAGGEDRHRGVELTAYGEAVRGLRVLGGLTWLDAKQKETGSAATEGKRTLGIPRTQANLGVEWDVTGVQGLALDARVVRTGSVYADSANTLRVPGWTRVDVGARYLLDVQDRLVTLRARIDNLTDRDYWASVGGYPDAGYLNIGAPRTFVLSASVDF

SEQ ID NO: 13829 - protein, 799 aa, Solibacter usitatus
MRLSSGVRHTDRVMQLSLMALLLSTSCLIPAAAYAQTVSAGEVSASSALSLPGVTTAPSQKKVFKSGNTTRVLNRKLLEAAGPVAGAAQMLSYAPGVQITGYGNTGASKYTVTLNGVQQGWGGFGGFTGDGAIGVTLDGVPVVDPGSDLWQSNMIPQSGMIQSVTTTYGPGNAADRWYNNLAGTIEFTPVQPTAKPGGDINLTYGSYGQKNIEFDLRTGNYHGWSTVIAGGAGDGNSFRKSPDGFQSPSNDYSIYLKTVKNFSAGNFAFGGYFARSAGYRVPVIPTSPIPGVTISGNAGAPLYSQQTSGFYSAPPYNYYEKFDTDALWMVFARENIELDDSTTLHNLTYYENFTRTHSRLYDFGSVGPQRYEYNNPYTNVIGDKLWLTEKLPFNTLNFGGYYIHTLYNSRNNFYNTVLGGNKGVVNAGGKIRSSYFNVDNFAMFLQDDIHPVRALHIIPGIRFVSFQTTYSDSALQDFAFAPGVGLSTHCVLDGSTATSGTTQATDQGSSCGSHVSRNGVEPSISANLQVMPWMALYGSYGEALRTPSVGGGGGLFQKINPTTGYQLELGQYYDIGAKFHVENGRFLHHFVAGVDYFHLRYAKQSLSTQLANGNALFASGSSIYQGVNMFADDNPLYNLYVFGNASFIDAKYQTYITGGTSYGGRHVPYVPSVNFNIGAYYDIPIGSMLLEPRMWYQYTGSQYMFNNNTGAPSNRKMPGYGTLNMSAKLTVPVTLPYVGHKSMDVSLTALNITNNQYNAYEYIGTGGYFNYSGTVPASGFTYAYPGAPFTIYGSVGFHF

SEQ ID NO: 13830 - protein, 891 aa, Solibacter usitatus
MRYIIIFLLFTQTIFSQKTISGTILSKETSTSLSGVFVRDTKTENWTISDKDGNFTITLPYFQDIELNFSILGKKEINQSLKDGQNSITVYLEDNTLHLKEVMVTANKERKYSELTLGTNAINNVQAFSLDDVLQQLPGQKTADFTLNEYKNIVFRTASDGNSSKGSKAFGTSFVINDIPISNNENMQALSPNTPTLAGNDYGIRNKVFNNPNVGVDLREIPTNTIEEIKVIQGIPSAKYGDLTSGLVLITTKVGNSPYRVSASIRDATSELNLTKGIKLDSRNSMNFGINYLDSKADPRDNLLNYQRISGSFAWKTTDKLSKIKNTLNLSVRSNLDDAKHDPDNITADVVKNEKQGFSISNNLMWKPSNIWLDGININSGFSYDRQFSRKERWINRSLTAATDSKEEGIHEAFVIPSQYTSMSTVEGIPISTFVNLETTKTLTTTTNWVHSISFGLSGRSSSNKGEGRKSSATGLINFYVLAEGGDSKLGYRDYDFNRTRTETQFSGYLEDRVYKKFEKDKILNIDYGIRYENQSGNVSLQPRINSSYSLNKTFRVRGGFGLSSKAPSLNQLYTGERYLDRLLGSGIYSYPGVYQKAWILTVVSPGDNLNLKPSKSLKTEGGIDIDLPFANINLTGYYNKLTNGFTGQQVPVSKEIPQANVITNGTEIPTYEIVGTAKLYYLTNSIQNNTNSEDMGIETIINFRKIKALNLDVSMNASYVKTNDNSKSINYYASTNLLSAEKYGVFPSMPTTNENFTASFNFSYHIPKAGLLLSLRSEHTILRTSYIPTSEFPNGYLDATLTYHEIPQEERSDLQKYGHIIRTIKGTQTKLEDVLHNFHLRISKDFLNGFSVSFYSTNFLNLKPYYDKDNLRTMYDIANFSFGTRLNYQF

SEQ ID NO: 13831 - protein, 652 aa, Solibacter usitatus
MSIIPEKGSLARFNITTLNVMYRNSLKRTFLFLYVLSIAFYLPTPLYAQPDEPEEELKVLQMFYKEKDLVETATRYPKPIAQVAENITVVTAAEIEAINAHTLTDILNYIPGVQVDSRGGSGSIANIFVQGSEFRHVLVMIDGVTLNNLSDNAADFGSLPVQEIEKVEIIKGPASSSWGSSLGGVINVITKSPDEMRVFGGTASASIGDRNTGDYRGEASGKSGDLGYYLSTGKLLSDGLTPSTSFDGNNVYTKLRWEPTDKTGLLFTLGYIYGTRGAGESQVYDFSIRNDFEHLFTTLALDHALSDNLDLHLSARGLKQHDDFFRSRFSTGAPVTKMSGDEATIGGSAKLVWRQGMHNLLVGADYDNRELDSTNRDLQSDTMSNGKQRLEKWALFTNDTIAIDKFSFTPGIRYDQTSTNGNFFSPSFGVTYTPAESTILRASVARGFSIPPLFATFGTGLFSLPNPGLKMEKVWSYQVGLESAPVRYLWLKTTLFRHDVTDVLAFETTGNDSIRIINNGRQRKQGGEVELKSLPLYNMSLLAGFAFVDLRDRDTGERVTGAGRITYDIGLQYDDQRSFSGNLRGHYIGWDADTAHNAFIWDLYLAKKIFTGDGRTVETFFSARNLFNSSQFYFSEFRTPGRWFEGGVRFRF

SEQ ID NO: 13832 - protein, 684 aa, Solibacter usitatus
MFGKTKNYKKHPLSLHITAAMPLFALVAFNGHAAEQHQHDVAVKTNDGDVITVTAPLYSPMTIVTSPKTPRQPVPASDGSDYLKTIPGFSQIRNGGTNGDPVFRGMFGSRLKILTDGGEMLGACPARMDAPTSYISPESYDLLTITKGPQTVLWGPGSSAGTVRFERERPRFEQPGIKGNASVLAGSNGRWDENIDASLGGEQGYLRLMGNKSRSNDYKDGNGDRVPSRWDKWNGDLALGWTPDSDTLLEVTMGRGNGEARYAGRSMDGSQFKRESLGMRFEKSNIGEVLDKLEAQVYYNYANHIMDNVTLRSPGQGGMAMGHMGMGHMNMGMTMQLDRRTVGGRVMGTWLWQDFKLESGMDTQTNTHRNRQGDGWQKDAQFHNYGAFGELTWTATEQSKVISGARLDRSLVDNYQSANERERSDTLPSGFTRIEHTLAGMPLMVYAGIGYTERFPDYWELFSPTLGPNGSKSPFDSVKSEKTTQIDIGAQYTDKRFNSWVSAYLGHVNDFILFKYDPHHARISQADNVNATIMGGEMGMGYQLAEHWKTDASLAYAWGKNTTDHQPLPQIPPLEARLGLTYERGDWSSTGLWRLVSSQHRVAINQGNVVGKDFADSPGFGVLSANVAYKVTPQVKLSTGLDNIFNKTYSEHLNLAGNSTFGYSSNTSVNEPGRTLWAKVNVTF

SEQ ID NO: 13833 - protein, 353 aa, Solibacter usitatus
MKKLTVVALALTAAFQAQAVEVYKNDTTMVDLYGRIYAGHFFGDKKEGVDTANPNGTHDYSAKQGANQFVRFGAKVDSQINSQLKALAQYEVQMYINDSEKTISDNSDNLRTRLAFAGVGADWGNITFGRQKGAPGFLADWTDVSLSDGYGNEALGAKTDTFATNRAGSVLKYSGLFNGFQIDTSYKFDGGDTEETTSKDSDAAYGAAVAYTFPFDLALGTAYNVGIRDKSGEEDAKLWLISAKYDNKAVYAALSYADGTDFLATGTDHTGWEAALGYNFENGFGLMALWNKQEQDKAGTKKDNLDYYTLGAQYKFNKNLRVIGEYRINNLDSVAGKATANKDDFQLAARYDF

SEQ ID NO: 13834 - protein, 847 aa, Solibacter usitatus
MITVLSVSNALILMPSFRVDFHQDEGEPCRCVGSGNSKNAKNTREEIMTIVSSRGRARALFGASALSSLLGAGLVALPSVATAQQADPNAIAEIIVTATKRDATIQDIPFSINAQTEKDIQRSGAVTLEDLSRNVAGLTIQNLGPGQSQVSVRGVSAGQVVRDQPGVKEQVGVYLDESVISLSLFTPDVDLFDLNRVETLRGPQGTLFGSGSVGGTIRYITNQPKLGVSEGTFEANANLVDGDAFGGHVKGAVNIPISDKIAMRAVGYLTQYGGFIDARKEGGKVDKNVNDGTRRGGRLSFYIEPNEQVNFTPRVVYQEIRAGGFNRQETFNLFANNNTTTRPKIQLGEREQYLLLDERFSDNTLLADMTANLKFDAATLTSVTSFISRDITVSRDASALTGSVSVDLGYPAAAVLLPSNLRDTTDLEQFTQELRLASTTDGPLQWVIGGFYSKVDRVYNQRLPTTGYDTYTDAVLGAGTSAAVANGFGKDSPYNAYLPYDIKQKALFGELNYTVGKLTATAGGRYYDFSETRQFKSGGLFANGDNRTDKTSSDGFTPRFLLSYEASDTVTFNAQASKGFRLGGVNDPLNIPLCSAQDRAIFGGYQNYDDETLWNYEGGVKSRFGRVTLNAAAFYTDIKNLQTTLDAGSCSSRVVFNVPKAHTKGVEAELTARLANGLDIGLSGSLLEAEFDSTVKDGTGAVIGGIREGNRLPSVPKFQVSFDVTYSKEVRPGVNGYLKASLQHVGNRFTQASDQENNPRLFVSNLAFGGATGRVPTAVNLALPSYEIVNLSAGLEMQDGVDLTLYVNNLFDENALLSFDRERGGRARLGYAVGQPRTMGVTVRKSF

SEQ ID NO: 13835 - protein, 705 aa, Solibacter usitatus
MKISRAVYAPLAFLLPVAFSHAQAAATNEQTMIVTAAPGGISELDTPASVSVVNGDDLRHAAPQVNLSENLGSVPGLQIQNRQNFAQDLQLSMRGFGSRSTYGVRGIRMYVDGIPATMPDGQGYTSNFDLNSIESVDVLRGPFSALYGNASGGVINVKTETGEQPAKIEAGTYYGSYGSVRYGLKATGATGDGTQAGDVDYTVSTTRFTTHGYRDHSGARKNLANAKLGVRLDEASKLTLLFNSVDIKANDPGGLTRDEWRENPRQSPRGDEFNTRKTTKQTQAGLRYERALTENDDISVMAYAGERETTQFQSFKQGFQAAPTNPGGVIDLTRHYQGIDSRWTHRDALLSLPVSFTLGLDYENMSEDRKGFENYRLVNGAPQYGEKGNLRRNERNLMWNVDPYLQTTWQLADKLSLDAGMRYSNIWFDSNDFYVVPGNGDDSGEANYHKWLPAGSLKYALTDAWNVYASYGRGFETPTINELSYRSNGQSGLNFALKPSTSDTVEIGSKTRIGNGLLTAALFRTDTDNEIVVDQSVGSGRSSYKNAGKTRRQGAELALDQQFGDAWKLKAAWTYLDATYRTNVCRTGDCNGNRMPGIARNMLYTSFGYEPETGWYAGGDVRYMSSIMANDANTDKAPSYTTVGLNTGYKFQRGNWLLDVFGRVDNLFDKSYVGSVIVNESNGRYYEPAPGRNYGVGASVSYRFE

SEQ ID NO: 13836 - protein, 253 aa, Solibacter usitatus
MKTLFSVYLFLSLNPLFLEAKEITWSQFLENFKNKNEDDKPKPLTLDKNNEKQKILDKNQQILKRALEKSLKFFFIFGYNYSQAAYSTTNQNLTILANSIGFNTATGLEHFLRNHPKVGFRIFSVYNYFHSVSLSQPQILMVQNYGGALDFSWIFVDKKTYRFRSYLGIALEQGVLLVDTIKSGAITTIIPRSKKTFFQAPFRFGFIVDFIGYLSLQFGIEMPLVRNVFYTYNNHQERFKPRFNANLSLIVSF

SEQ ID NO: 13837 - protein, 376 aa, Solibacter usitatus
MNTRTTSLLLMIQGACLAAQAQAEGFPTLARIAPGFGYYGVDQGFDDKLKVYGTVDAFASYHDSQHHSGFKLAGGGAWTNKLGLYARKGLTPDTVVELDVEEGFNVNGKALEGTWDTLGTLRLATVALRSRTLGKLEFGKTYSMGTPTYADPFLATYGSPYTYLALPAAGKGAFYLDLRPKHTLAYTSPTLSGFSLGTALSFGFDDAASQGRTVRGGGARLQYRNSRVMLLASYNLYYSDPWDDGGVSRQTANYYKSLSAFYDFGPLATSLTWQRQDVDQAGTPSTTLYTFGVMAPVGERDVLRLAVMQRQVTAHDKDAWGAMVGYDHFITPRWAVYGRLGMIGNQRASSVTYAGTPVDQVGDNPSNVSLGMYYHF

SEQ ID NO: 13838 - protein, 671 aa, Solibacter usitatus
MKTLAILTIGTLYSGYVHANIEKLTVYGHRDGLIGESISASSGIIGQGEIEQRPMLRSAEMLELIPGMAVTQHSGSVKANQYFIRGFNLDHGTDFATSIDGMPINMRSHGHGQGYTDLNFIIPESISTINYQKGSYSASQGDFSSAGSAQFKLVDNVKHQQIELSIGEDNYKRAVVLGSTNLTKGKLIAAAEWQGYDGPWDDINEDVNKKNALLRYVGKAFNGDLSISAMAYDNTWNSADQIPQRAVSQNLITQLGSLDTTLGGSSSRYSLSGNWQGEHLKASAYVINYDLNLYSNFSYFLNAPINGDQFNQQDSRNIYGTTLSYQFETKTSGLNMQHTAGLELKHDDIDNVGLYNTKAREQLSTVRQDALKQTSYSSFWESKLLFTPKLEATAGVRYDYFDTNVTSITAVNSGKASDDLISFKASLNYRFTQLLAAYANWGQSFHSNDARGSTINIDPVTGDQAERVDLLVKSEGAEIGLRFADEKKYNMSAALWWLKLDSELLFVGDAGNTEPSDASKRYGLEMSAYYWINEQFNIDLEASFTHSRLDINDNNNYIEGAVPVVASTGLNWHLSKQWQSSIRVRHIGKRTLTDDGDKRSNPLTVVNSSVSYKQTHWKVDFELLNLFNSTDHDIDYYYASRLAGEPAQGVEDNHFHPIEPRTARLTLSLLF

SEQ ID NO: 13839 - protein, 1723 aa, Solibacter usitatus
MKWLPATAVFAAVLPALTAFGDPASVEISTSHTGSGDPTSDAALTGFTQSSTETDGTTYTIVGDITFSTFTNIPVPVVTPDANDSSSNSSKGGSSSSGATSLIRSSNLHSDFDFTKDSVLDLYHLFFPSASNTLNPALLSSSSSGGSSSSSSSSSSGSASAVVAADPKGGAAFYSNEANGTLTFTTDSGNPGSLTLQNLKMTGDGAAIYSKGPLVFTGLKNLTFTGNESQKSGGAAYTEGALTTQAIVEAVTFTGNTSAGQGGAIYVKEATLFNALDSLKFEKNTSGQAGGGIYTESTLTISNITKSIEFISNKASVPAPAPEPTSPAPSSLINSTTIDTSTLQTRAASATPAVAPVAAVTPTPISTQETAGNGGAIYAKQGISISTFKDLTFKSNSASVDATLTVDSSTIGESGGAIFAADSIQIQQCTGTTLFSGNTANKSGGGIYAVGQVTLEDIANLKMTNNTCKGEGGAIYTKKALTINNGAILTTFSGNTSTDNGGAIFAVGGITLSDLVEVRFSKNKTGNYSAPITKAASNTAPVVSSSTTAASPAVPAAAAAPVTNAAKGGALYSTEGLTVSGITSILSFENNECQNQGGGAYVTKTFQCSDSHRLQFTSNKAADEGGGLYCGDDVTLTNLTGKTLFQENSSEKHGGGLSLASGKSLTMTSLESFCLNANTAKENGGGANVPENIVLTFTYTPTPNEPAPVQQPVYGEALVTGNTATKSGGGIYTKNAAFSNLSSVTFDQNTSSENGGALLTQKAADKTDCSFTYITNVNITNNTATGNGGGIAGGKAHFDRIDNLTVQSNQAKKGGGVYLEDALILEKVITGSVSQNTATESGGGIYAKDIQLQALPGSFTITDNKVETSLTTSTNLYGGGIYSSGAVTLTNISGTFGITGNSVINTATSQDADIQGGGIYATTSLSINQCNTPILFSNNSAATKKTSTTKQIAGGAIFSAAVTIENNSQPIIFLNNSAKSEATTAATAGNKDSCGGAIAANSVTLTNNPEITFKGNYAETGGAIGCIDLTNGSPPRKVSIADNGSVLFQDNSALNRGGAIYGETIDISRTGATFIGNSSKHDGSAICCSTALTLAPNSQLIFENNKVTETTATTKASINNLGAAIYGNNETSDITISLSAENGSIFFKNNLCTATNKYCSIAGNVKFTAIEASAGKAISFYDAVNVSTKETNAQELKLNEKATSTGTILFSGELHENKSYIPQKVTFAHGNLILGKNAELSVVSFTQSPGTTITMGPGSVLSNHSKEAGGIAINNVIIDFSEIVPTKDNATVAPPTLKLVSRTNADSKDKIDITGTVTLLDPNGNLYQNSYLGEDRDITLFNIDNSASGAVTATNVTLQGNLGAKKGYLGTWNLDPNSSGSKIILKWTFDKYLRWPYIPRDNHFYINSIWGAQNSLVTVKQGILGNMLNNARFEDPAFNNFWASAIGSFLRKEVSRNSDSFTYHGRGYTAAVDAKPRQEFILGAAFSQVFGHAESEYHLDNYKHKGSGHSTQASLYAGNIFYFPAIRSRPILFQGVATYGYMQHDTTTYYPSIEEKNMANWDSIAWLFDLRFSVDLKEPQPHSTARLTFYTEAEYTRIRQEKFTELDYDPRSFSACSYGNLAIPTGFSVDGALAWREIILYNKVSAAYLPVILRNNPKATYEVLSTKEKGNVVNVLPTRNAARAEVSSQIYLGSYWTLYGTYTIDASMNTLVQMANGGIRFVF

SEQ ID NO: 13840 - protein, 980 aa, Solibacter usitatus
MDNYHTSQGEWHRLLCALPIYLFVSNSVCAANSNTIVVDGGKLHFENLTLVNDTSGAFIIQAKNGAEFNGSQLFLTSSGTRGGGAWIDDSVFTGDNLEINVSGNAASGIYLANNSSATLSDITIAAQNNAMGLNLDGTWSTQGFATAQLSDSAIATESGDAIKVMAGDLTLTNTTATTTGDSSYAVNANQAATVNIDGGRYATQGKYSDAVWVVSSDSSVNINDATLSTAGDRAIALNAQNGSATITNSTLETEGLNAYALYSGRQQLTGDKLTITTQGTGGAGLFAATGGKGTLTNSDITTHGELAAGLLAYPGSAITADNVRIETTGKQGFGLWSRAGQLDISNSTIVTSGDAAAGLYVNGFSTTLSNNVSLNNVTLQSAQAQAINADTTTLALTVNDSTLSGGNGQVMNVSHYEDAADPANNLYSTVTLTAANSQLNGDITSSDVANSVAVDLTSASVLNGAVDNATSLALDNTSRWNMSGSSVVGQLTNNGTIAFSAGNAADTLTVTGDYAGNGGTLMFNSVLGDDSSPSNKLIVGGDVLAGTTYVAINNLGGHGAQTVEGIEIVDVGGRSYGNFVQSGRIVAGAYDYSLLQKGENWYLTSQATPVDPEPEPTPEPTPAPEPGPNPDPTPAPEPGPKPEPTPDPQRKTPVIRPEAGSYTANIAAANTLFAMSLHDRLGEPGFVDALSAQPEVTSLWLRQVGGHNGWHDGSGQLTTQSNRYVAQMGGDVARWSRNGVDRWHVGFMAGYGNNHSSTRSVMSGYRASGSVEGYSIGGYATWYANAPASQGAWVDSWLLYNWFTNSVEGKELASESYKSRGFTASLEAGYTQKLGEFTGSQGTLNEWFIQPQAQAIWMGVKADDFHEANGTRIQSEGDGNIRTRLGIRTFLKSHHAMDNDKERVFQPYVELNWIHNTRDFGTKMDDVSVYQAGARNLGEIKTGVEGQINPRLNTWGNIGVQVGDKGYHDAAAMVGLKYHF

SEQ ID NO: 13841 - protein, 756 aa, Solibacter usitatus
MNGTSQLRLAASISIAALALATASAAAAQQAADDGAGIQEIVVTAQKRQQSGQDVGIALSVVSADALAQRNVTSVTDLTGLVPNVQANFGAGQVAFNVRGIGTNEFSANFDSPVALNVDEVYLSKNFMSGLLLFDIDRVEALKGPQGTLFGRNATGGTVNFFTRGPTDDLAAGGTISYDNYQTIRAEAYVSGPLGAGLSARLSGMVVDQNKGTYRNLTLGRREGFEKKWALRGQLKWTDGVTTALLSITGGRQRGELSPYEGVGVFTPASVAAGAPAFCAPYLNGTVRGDTAGCVRGTDGGYPGDRDPYTSTNDLTHKVRNESLGATLRIEHDFGASMLTSLTSYQFARRRQLEDSDGSPVRTIDVQYDNRIRQISQEIRLSSTGSGPWSYVVGGYYEHDGYRNGDYLFIGAGAAPGYYSPFTQKVDALAAFFHNNVALTDTLGLVAGVRYSRERVSFDGGTFAATGLAGTPFRPTALVAPLSAADTSRKDDDATFKAGVEWKPRLSSELIDKLLIYANVSTGFRSGSFNGEFAASQAALTSLAPEKITAYEAGFKSSLADRTVQFNASVFHYKFTDGFINVDSATSPVPVTINAAGISSYGIEADLLWRPIRQLTLSMGGGWLDSKIDSDVTVNGRSLKDARTIQSPRWTYNVQGSFTQPVGNGLSVVLSGDANYRSSQYYEVTNSINSREPGYWIVNGRIALNGPDDRWSIALFGKNLTRTVYRTYVNDLPDFGWLLNIYGQPRTYGLSASFKL

SEQ ID NO: 13842 - protein, 948 aa, Solibacter usitatus
MRLQITRGRLLATTMMAGVATLAAFTANAQTAPAPAPAQADNEVEAVVVTGSLLRRTDTATPSPVTVQTTEQLKAQGITTIADAIRSLSADNSGSIPAAFGNGFAAGSTGVSLRGLSVNSTLVMIDGLRNANYPLADDGQKAFVDLNSIPFNAVERIETLKDGASSLYGADAIGGVVNIIMKSNYQGMGADISYGSSQHGGGDQYRFTGDIGYGDLDTDKYNLYFDVEYQLDKAIRGDQRGFPYNTNDLTSIPGGQNNNPQTGGSTFYGNVLRASLGTPGNLATGVGIDGALWQPLRTCAANAPLTTQKDEDGNVMGAYCAQNVANFGDIQPKQSRAAVYGRFTIKPTDHLEAYLSGSFVQSKTSVRGTPVTVSSSTPNNLTNLVLPVWICDTGVNCATDTTAVNRRLNPNNPFAADGDYALIKYRFSDLPASARYNNRMLRMVGGVKGDVADWNYQANLVIAHDSLESVQTGFLSYKQLMSDIQTGAYNFVDPSKNSAAVLKALSPDLAKTSTTDLDSINVQASRPVFSLPGGDAQLGLGGEFRYEATNDPALNPVNDAQGLGNARTEGNRTVASAFAELGLPITDKIEVNVSGRYDHYSDFGGNFSPKIGVKFTPIKTVALRGTISKGFRAPSFSEAGNSASQGFTTFSFKSAKYADFRASHGNNEYTKDYSLSSITTANPDLDPEKSTSYTLGAVWAPTRSFSVSLDYYHIKKTDVIAQASAGVALAAYYAGQAIPAGYVVTADAADPQHPDALARVLSVASPYINADSLVTSGLDLNVQATFYLPADVKWTSNLDATTLFDFKYTQDGTTYNYVGKEAPYVLSSGAGTPKNRLSWTNTFEHGPIHVTGVMSYVSGMREVDDSYDSACLYGDAAFNCRVKSFTTVDLTGAYDVTQKATVYADVMNLFDTGPMFNPANYAGVNWNPTYSQSGIVGRYFRVGVRVKY

SEQ ID NO: 13843 - protein, 481 aa, Solibacter usitatus
MTFKTTLLAGTVLGVATLASGTALAQTPAGQTASQQAQIEALNRQIQALQSQMTSLKESLQKDISAVGKKVSDAPTVSVEGGRPRFRTADKAFDMAIRMRVHADYGAWFPEEDQGIPDLTDGFNIRRAFFGINGTVYNDWAVELTFNAAPNRGNGIELQAANVSYRGIKGWTFDIGVMQPKFTLDDSTSSNDIPFMERAPAANYIVNIGASDGRTAIGVTNRSDRHIVAAYVTGNRIGTGTGDDQVNILGRAAYRVIDTNMGGMGIGASGVYQVQPEAGTTSAGGTAIRFDDRPGARIGSSTQRLTRSVNITNIDSAYGYGVDVGGNYRNLWAAGEYTVFGANTKERVPGTNAVNPFNDPEFDAFYVSAGYVLTGERRNYTVGEFAGVKPAWPFTPTGGIGAWEVAVRYSQADLVDASAGAGSSGSSFDRPGKETLWTFGLNWYPNAAIRFMLNYIMAESDKPTGKDVEADILAARVQFQF

SEQ ID NO: 13844 - protein, 797 aa, Solibacter usitatus
MSFTPVPQRHPLSRALHAALLGLAVSTYALPSLAQPLSADHNNPLKQWSIPAGPLAPALDRFAREAGISLSFDAQNVANRNTNGVQGALDTQSALSSLLRGTELQFEPQGPNAYLVIPQPKPTGPLELGATEDYRLAPVIINAKVKASADDDANSVVAKELWVGGKVATSILNTPASVSVVTNKEMQQRSVSTTEEALQYTPGVVSDYYGSDDRNDYFLIRGFQATTYRDGLTLSSMRGVREDPYAYERIEILRGANSTLFGPADPGGSVNFVTKQPRFEKFGQGYVTYGSYDHAETGIDVGDALNDEQTLAGRFTAKMQNSDREYDHSQDDNRFVMGGLTWAPTDFTSATVVLDYLKTNSSPNSGGYPLDKEYDRSDFYGEPGYNFHDVERTSLSGNITHDFDNGFTLRSNLRYSELTDDFGYVYLSDNASRVGTTIPRYVFGTDSDADQLNGNLMLQYDAQFEHIDSSTLVGVEYLDSTTKQSSVYGLAPSIDIANPVFTGVPGGITPYTRKKNDATTKAVFLQQNLSFFDRVIATAGVRNDSMDLSSKEYTGGEQTEKDNFSETSYRAALTYIVNDEVSTYVSMVESVSPPQVGVTPQTGKQYEVGIKYSPMGMDALFSAAVYDLTQENVTIAVVLPSGIIEQQTVGESRVRGLDLEAKAQVTQDISVIGAYSYMESEVLRGSLYDGSSLKGNEFTTAPKHTASLWSYYDIPGTDVSVGLGARYVGAYYMDAANTKKSDGTTLFDAALNYKIAKGTDLALNVSNLFDEQHVVGSGTANYYNPGREVTAKVSYSW

SEQ ID NO: 13845 - protein, 511 aa, Solibacter usitatus
MNFFVKAGLVVTGANLLAIAPGQALSLDQLQKIDAVTPDGITSGQITSVNELSDVKPTDWAYQALQSLVERYGCIVGYPDRTFRGARPLSRYEFAAGLNACLDKVIEFAASKEDLDTLKRLTEEFQAELATLRGRVDALEARTKELEATRFSSTTKLRGEVIFGLDALANSNGNEVNSNGAVSFGNKVDLDLDTSFTGKDLLKTRLRARNIEPITNRLAPGFRAPGSVLDYGGNSNNTFFIDKLYYTFPAGSVRFTVGTVGVGVQEYGMRDATFSSGANEGKTFRKGPANIYESNGKAGVGFDWRINPNFSFQLGYLNRGADQVGVDQGGFFGQGTVGTAKSGWDVATQLRFETDNRKFRAALAYSLRNDRYVTDLGTTRAERPFGAANYNTNNLALTMGWAVSDNFTISGAYGIGFANVAGGSDSATIQTWNVGLTFPDLFAKGNSGVITVGQMPYVTSASQQSAEDTGSLGLEVNYKFQVTDNISTGLGFICSTIRTVLRTAEPATFPI

SEQ ID NO: 13846 - protein, 716 aa, Solibacter usitatus
MLRNTSLLLIMGTCSVAWADSAPVELGATTIDGERDAASGVQLDEPIRTGSRLGLTARETPASVSVSDRRLIEERGAKDSQDVINAMTGVNASANPGFGGFVAYRGFTQNQVTQLYNGINLGYSSATRPVDAWVLDRVELIGGPSSFLHGAGAVGGSINYITKLASRDQQIIDGRIRYGSFDDSEVAFGINQALASNPADARHFMRLDFSRGHGNGYVDRNERHTDSLAFSLLSDLTPNLTHTLALEYQEDREDSPYWGSPILPGRSTMKIDNSRRFENYNVGDGRYEQRVRWLRSILDYQISDSTSVQNTLYHYNAQRDYRNLERYTYTRDGKVQRSSPYLQRHDQNLLGDRIELRHDNQLFGLASQWSLGLEYSRMRQTLYPTSSSWSDVVDAEHFDPGSFDDIPGVNAGLTKQRRHEVINRAVFAENRLQLTERLALLTALRYDYLDMDVTNYGAVTPTSPAYFERRWEPLSGRIGLTYALTPSASVYVQYSSSADLPAGSLAAATYSNVGLFDLSKGEQWEVGSKFDFLDGRGAATLALYQIVRKDFAVRDSNDANLTVQAGQQTSRGIELSGRLQVTPKLLAEANYAYVDAQYDEFNEAVNGVSVSRKGNAPTNVPANVANLWLTYSLSSAWSVGADGRYVGSVYADNANSLKAPAYTLFGAFARYRLDEHTTLTGRVRNLTDEVYAKQAYNSQYYMGPPRTFELALDMRF

SEQ ID NO: 13847 - protein, 878 aa, Solibacter usitatus
MRGLLMTLRFKPALLAGISALSITSVYFTPSFAADTAVATADTQAAELDTVVVTARGKPRTVLDSAVPVDSFSESDIKASTFTDTNDILKTLVPSYTLAREPISDGATFVRPASLRGLPTDKTLFMVNSKRRHRSALVTIGGTGAQAPDAATIPASALKNVVVTRDGAGAQYGSDAIAGVIDFQLKDSPSGGSLTAQYGQFYLGDGEDVLLTGNLGLPIGEKGFINTTVEYTSQNQVNRGKQYCNVGIPNQSAGFCVTSYAAANPAYKALINDYVQKWGQPDAEATRAVVNAGYAFSDNLSIYGFANYSKSSAVEYFNYRPPVSNAVNATPIRLQDGATFQFSSIFPAGFTPMFGGDVTDYSMTGGVKGLTGYGLSYDLSARYGNNKIAYSIWDTVNPSMGPASPKKFYDGALVSTESSANADFAYDWDGLSFKTPVTINFGAEYRKEGYEIEPGDVPSYIAGTWAVPDPFKFCNATTRTPTAAGLALPATAGLNCANYLSTTADGFAGIDPVYNALAVGSNGFPGNTPLYSGKLTRDSYAGYLETSGNVTEEWFLDFAVRGEHFSDFGSTWNGKAATQYQLTPNFGLRGSVGTGFRAPTPGQAFTTNVSTRVENGAIIASGLFPATNPVAKFLGAKDLKPEKSTNLAIGFTATPIEGLSLTVDAYSIKIKDQFYATTPITVTPAIRTALVSASIPGADTIGQVQFFQNAFDSTTRGIDVVATYRMSWENGQSTNLSVSGNYNKFKIDKVFSTNFFDAEGVHDFENAAPRWRSVISATHQIDKFKAVGRLNIWGPYKNMFSVGNPIVQKWDPETFFDLEMSYQATDNYSVAIGARNLFANYPDPDKTGESATNGRIYRSDAIVDWQGGFWYARLSATF

SEQ ID NO: 13848 - protein, 1032 aa, Solibacter usitatus
MRCNKPVAHVMMSSLILSLLAVSVQAASRANDDRINGVDLLSGFNTLWTTGATWDTGTPTALGQSLLRRNLQIVVDRANSRTLAQETAAYFDDRRDQSYSAISGLGSLSDAYKAGAGAFTTITQFDDSNKTVKYDDKGNGAGSSSSALGKVVDLVGAVRNDASTTPAKSHYLYPRPWRQSLDGQNLAFVVAPSLRPAESTTPASDSGFPSGHTNAAYLSAYALAYAIPERFSELMLRASEIGDNRIEAGMHSPFDVMGGRITATYFAIDNLSNSANAQLRADARAQALTYFTAQCGGNINNCIASIDPATDRTSQHAQDKALYTSRMTYGFDPVGPTNLAPVVPTNAEVLLETRFPYLDASQRREVLGTTEMSSGYAVIDQSGGYGRLNLYAAGDGYGAFNSNVTVNMNASLGGYNAIDAWRNDISGSGALIKNGTGNLILTGNNTYSGGTVINGGTLTGHAQAFGSGTITDNATLVLDQSTNNTLANTLTGSGALIKRGAGSLNLTGNSSLSGATTVQAGRLAVNGNLGNSIVSVQQGATLGGNGTVGGINVAQGGVVAPGNSVGQLNVNGDVNLAQGSVYQVESDANGNADRIVASGRATLNNSTLSLVEGGNWVAASRYSIISAAGGVSGAFAAVQTNFAFLTPTLNYTATDVGLTLDRNAQTFASLATTRNASAVAQGLDSAGAGNALWRQVVQDDAATAQATFKALSNELHASTQSALIEDSRLVRNAMNDRMQQAQSAQSFGSTTQTLAGDASRGVVWTQAIGATGQTDSSRDASGLETRTSGLLFGTDVPLDDTWRVGALAGFSNSSFDLRHASGSTDSDNYHLGVYGGAKWGQLGLRLGAVHTWHELTAKRTLDLPGSSEHFKEDYKAATNQVFGELGYTLEMGNAQLEPFANLAHVRLDTDAFDENSNAISLQNKSQDNHITFSTLGLRAATRLNAGSVTIKPNATLGWRRAYGDVTPESRSAFSGGSTFELSGAPIARSAAVLGAGVDLGLSDTLSVGLSYDGQVSNDASDQSLNARVTLAF

SEQ ID NO: 13849 - protein, 625 aa, Solibacter usitatus
MQHRPLAIAISLALAVSPAIAQTTDAQAANSTDVASKTDRPLERMVVVSSRVAMPIREIATSVSIMTRDEIETRGYINLADVLRTQPSVTVTGSGSVGSATSLRIRGEEGYRTLVRIDGVDVSDPTGTQVGPKFGQIQSSNINRVEILRGSQGLVYGADAGGVINIETANGVGAPSGHVSAEYGRYNATNLAADVGGSRDKFDYYVAASDFSTDGFNSLIADNETPDADGYDNTTLHARLGYQASDSLKLGFVARSTDADGKFDNCGFGETATNNCTNDFEQTNVRATANYAHGASKHEFALSKMFIERNNYTQGVFSFGAKGYTERAEYLGNTELNQDSSLIYGIDWEKEAITSTDDARIQRGYYLEYQSEVLKDFFITAGVRHDDNEDFGEHTSYRLSSAYIWTIGENELKLRGAYGTGFRAPSLYEIGYNAGPFARAPATDTALKEETTKGYEVGLTYSLASGSQFEATYFDQKIEDSIYFDLAAFSGYLQDLGESSSKGIELIADVLVTDTIGVTANYTYNDTEDTAGDQRRRRPRNSGSVSVYYDNNTWKLAASLRSSHDSVDGVALKGYEVMDISARYTVNQNLSLSARVENAFDANYQDIAAYNTSGAAGYIGAQYQF

SEQ ID NO: 13850 - protein, 664 aa, Solibacter usitatus
MIQTRTAVAVALALTTSPAAVYAAETAPLNEDQIVVTATGFSQERREAPATISVVNEKELNTRSNQNVTEAIREMPGVLVGNGHGSLATGDVQMRGMDSTYTSYMVNGIKQATRESRPYGHHIGTEAAFMPPIAAIERIEVIRGPMSSLYGSDSIGGVVNVITKKAYSLENWTGVLENNYFLQEKSEYGNTNQTNAFLMGPIIPGKLGVSVAADYLDRRDDDSQSDQRFVKHEAGNLDATIAMSPTDTQLWDLNVTKGNQEKSHNNKEWYWGFDRDAASLSQHAWYGDDLLEVKNYISYEKAKTEYRVPGMSSQFIKQRNFEANSANTFSLGDHKLTLGANWTRNELDDTFGIEDKEAPGVTPVSKITRDGWAVFAEDAWMIVPDFTLTTSARLDHDSYFGYHVTPKLYGNWTIDESWALKGGVSAGYKKPDLRQNNEGFTSVYGSYPYSEISIGNDDLKPEQSVNTEVGVYWQQDALALDATLFYTKFKDKISDYTICTQTATQKCVYNGYTADSVYQYFNVSDAEIYGIELNGDWQVTASLRANANYTYTHSEQKSGDYKGYALSDFPTSMANVSLTWNVLNDLELWTKSSWRSNSPDIGKSTSTEAYALVDLGARYHLNKNITLMTGINNLFDANPVYTTTYNQSAMLEGRRYNLGARYEF

SEQ ID NO: 13851 - protein, 396 aa, Solibacter usitatus
MKHGRFIVAGSALSLLASSAMAQSTVTLYGIIDAGISYTNNVKGGSLWQESSGKLGGNRWGVKGHEDLGGGLSALFTLESGFYSTNGTLGQGGREFGRQAFVGFAKQDVGALTFGRQYDPLADLIAPYFGSGFWIPSTHVGDNDNLDQSFRINNAVKFRSDAFAGWRVDALYGFSNQAASSGSQGFANNNAWALAINTTQGPVSVGGGYMQLNHPNATSNTSGAVGGASSTTGDDYSSGFFYGIDGGVARQRIAAAGGNVVWGPATVGLGVSHVQLDYNDGATRKLNNVDVNLRYRLSAPWMIVADYTYTDGRATGLPGTGSADLKPTWHQINVGIDYLLSKRTELYVTAGYQKALGDGTTQVGGHSRPIAAMTTAGGASSTNTQFTVATGVRHRF

SEQ ID NO: 13852 - protein, 864 aa, Solibacter usitatus
MRRSFDRRLDRRLIGGSTAVAALMLLAAPVAVQAQQAFQQTRGATYSFDIPSQDLSGALRAFGQASGQQLAFDEASVRGKRAPALQGSYTAEAALKRLLSGAGLSAQPTASGVYAIRAKTLLVATSAQAEARPAAAAEPDPETPSQVEEVIVVGTPGGKGIDKLSASFAVTTVNADDITKASPKSTAELLTLVPGVWVETSGGVAGANVFVRGFPATGDAEFLTIQLQGSPIYPPSTLSFLENSSIFRVDETISRMEALRGGPNPIFSNGQPGLTTNFQLKEGGEETHGLVKISTSDYDLRRVDGLLSGKLADDLYFMIGGYATTSPGVRDTQFDSEVGQQFTVNITKQMEHGKLNLYARYTDDHGAWYLPFAINVPGVDKGEYTQLGNASRFHTLQINAAGTTRNFDLADGRGFKGYVAGGSFEHEFGDDWTVRDRFSVTDGDANTYGLVGDGAAVTVAALNAVVPGAIKTRGGATLASTDYVQNWGAWIVEKKIKAVTNDLSIAKTVGAHQLSAGYYASSFKSDDFWTIGNVEPMQVKANGDYLAAPVTCADLATAGSTSSCFKFGLTSAGDGRVDALYLADSWQVIDPLRIDLGVRRERFRTDYVVDDGPGFPDGLALRTTDYSNSKTSYTVGVNYDINAVSGVFGRYSRGYKFPSFDNFREGLTDTLSVDQYELGYKLRSGPFELYATGFANEFKGAKFADVGGIQESNSNKAHGVELDGRWRSDFGLSLALNGTWQKTEITKSSIPANKGNSAQRQPDWMIRFTPSYDVTLGSVESTFYGTVSAVDDRFADNANTQVLKGYTKIDLGAIFDVADFTVQVSADNLTDSHGLTEGDPRSTSGANARPILGRSFKVSVGYNF

SEQ ID NO: 13853 - protein, 895 aa, Solibacter usitatus
MSPFCGSPTVLFSLLIPGTIMGGDTLRAINKIGAPSFNLRGLLAGVSAAALMAIFAGASQAADWRGLTSSDWTDGSNWSGGVVPGAGTTVNISTPGAPGNRPVVLGVTGPVNVSVGSTQVGANATVPGLLTIQNGSTLTSTGQVRLGVVAGAAGVVTVTGAGSLWNATTVINSAVGFLGAGTINIENGGQVNLITVILGSGVTSSGTVNISSGGTLQAQTLRGGAGASQANFDDGILRATAANATFINGFTGTELNLLAGGLTIDTAGFAVGTDATSGFSGVGGLTVTGGGVFSLLANSIYTGETQIDFGSSLALTGAGAIASSGRVVADGIFDVSAATTPTIQSLAGSGSVLLGAQTLTIANANDTFAGVIGGTGGLTVTGGNQTLSGVNTYTGATTVSGGRLAVNGSITSPVTTSGAGILGGTGTIFGDVTNAGVVAPGNSIGTLTIAGNYTGSGGTLEIETVLGGDASPSDRLVVTGNTAGTTNVMVVNLGGGGAQTVEGIKIIDVGGISAGNFSLLGDYVFEGDQAVVGGAYAYRLYQGGVSTPADGDWYLRSTELDAAGVAIGPIYAPGVPVYESYAGVLQSLNQFGTLRQRTGGRMLDGDQSADQDGNTAATGIQTRIGGVRSHFEPESSTTGTDYEVSSWTLQAGVDGMLRESEAGALIGGINFHMNTASADISSRFGKGDIDTTGYGFDGTLTWYGKSGFYVDTQAAVTWYDSDLNSSTLQTSLADGNDGFGYGLSIEAGQKIDLTGQWSLTPQAQLAYSSVRFDSFTDAYGADVSLDDGDSLTGRLGISADFDSEWKDASGKTSRSTLYGIANLYYDFLDGSDVDVSGTSVVSENQALWGGLGVGGSLTWSDERYAAHGEAFARTSLKDFGDSSAIGAKVGFSVKW

SEQ ID NO: 13854 - protein, 359 aa, Pseudomonas aeruginosa
MKIRRIVEAVLTSAACVVASTSTTFAQSHVTLYGVLDGGILFTNKTYDHISGREGGRAAVANDGNESPSRIGLSGSEQLGGGVEAIFDLETGIDISSGKIANSNGNFFGRQAWVGIKGGFGNVKVGLQYSPFVLALVKSDPRGGTFFGSGSTIYVGNLYATGLFNKNAISYESPMLYGFQGSAMLGLGGKAGDFQAGRQYSASLHYESHGLGVNVAIYKSNAGAQITSPVPDGVPFLGKMVGVSYDFGAASAKLLAAEYKIDNSFDIRMIGVGGEVRVMPTLYVDAGVWLASDANRSENSTLIVGSGLQYFLSKTTQVYVQAGMVKNRGGMHTGMAINGALYGPTGTTLGAAIGLRREF

SEQ ID NO: 13855 - protein, 556 aa, Pseudomonas aeruginosa
MTFYYLLFGVQDLGLILFSKFLSANSNYSWLKLSLTLAIAIFPQSKILAESMPEEEVGKINLVTEIEFDDQNNSKNKENIDIFLNKQSQFHFAKDVRISPLKALTPGELGDWQEEAVHYAQILQINNFDPDHDHHHEPHQSVVAISGNPAASNMLVGTGQLGQWLGLDENSPLRLGGIFMGNISQQISGGNQPGSTDFNGALILGLGIDLEKAVGWKNAFFEVEGLQYNGQPVNFAAGSVQGYNSIEAGPPLNRTELYQLWLNQTFLDNRLSFRVGKLIPSMNFGYVGRPFVTQTNPQLFTSTTGLIYTPVFVGPAMLGFIPGYYNSAFGLYGSWKSWGAPGDNPATPNGWYTQAGIYDGRGAQGVQTGLTWPNFSGALFSVAEVGGTWTPYADDPATGWGSVAVGGWRQSGPLTAPGGAFEAQTGGMYAYLVQKLGKFRDSEDQNGIVGFVQGGWNSSSTALMHSSLGFGLTFIAPFGDRPLDSYGFGFSWARLNANPLAGYGFNSYETMIQLYAQYHLVGNLFIQPVLTVLPTPGSGGAGAPSVSGTVQLTFPF

SEQ ID NO: 13856 - protein, 235 aa, Pseudomonas aeruginosa
MRVSVHVVGQRRCTHPGQHLPLCVHHRRIGIVSCAWQQEKFLCQFDGIPAYMEQAWSYGASALDVALYDRVDVVRGATGLLTGSGNPSASINLVRKHAVSRDFTGTVSVGGGDFNKTRGVADVTVPLRPEGTARARVVGVYRDGESDMERYSLRKKIGSAIVDFSTREVIGIGHRHLARDVCVFCVPDSERIAAIAQEVRRLFFCANTASRVHAVFALRQRAVSTEQPPCGTVVI

SEQ ID NO: 13857 - protein, 742 aa, Pseudomonas aeruginosa
MPRSIPLRPAPLALSLSLLASFSAPALAADPVEQQMVVIGSRAPTSISELPGTVWVIEREQLDQQTQAGVPLKEALGQLIPGLDIGSQGRTNNGQNLRGRSVLVMIDGVSLNSSRGISRQFDSIDPFNIERIEVMSGASAVYGGGATGGIINIVTKKGVGGDTRFNTELGARSGFQSHEDHDLRAAQSISGGNDLFNGRLAIAYQKNGAAYDGSGDQVLTDITQTDLQYNRSVDLMGSLGFTFANGHSLDLGLQYYDSGYDGDRGLDLGRNFDALRGRAPYSIKGGVDLDREPESKRHQFNATYHAPEVLGHDLYLQAYYRNEKMAFNPFPTIRYSNSGAINYGTSYYSASQQDTDYYGMKLALVKTWERASLTYGVDLDREKFTSDQMLFNLPLAAASGGLVASEQAKLGRYPDIDTDSRAFFLQGSWKATDDLTLSAGVRRQSMSTDVSDFVAANQQILIANGLGKTADAVPGGSKDYDVNLVNVGAIYKLNLQQQVWANYSEGFELPDPAKYYGFGRYGAADGNGHYPLLQGVSVNDSPLDGIKTKQVELGWRHTDGALDTQVAAFYSWSDKSIKYDSKTLAVLQQDTKKRNYGLEGQATYWLDDHWQVGVNGLAIRSQEKVDGRWLKQDVTSASPSKAGAFVGWKDDQRSLRLQGVRTFNLNDEPGNKIDGYALFDLLGTQALPVGTLTAGIQNLLDKDYTTVWGQRAQVYYGGLAPAGLFDYKGRGRTYSLTYSVEF

SEQ ID NO: 13858 - protein, 463 aa, Pseudomonas aeruginosa
MPLLCALIVGGLFGTSQAQAGGFMVPTTNTAGWGRAMAGGSLFPNDPSAAFNNPAAMAFIDKRIAQLTVNYADIDIKYNGDAYDYQGNPMTGGYQDGPGTPELGTNDGGQAGFGAWLPTGFLVVPINDRFAFGLSQVVPMGMRSTWDPNWKGRDFAVDTKIETIGLTGSLSFKVNDNFSLGAGVIIQRTSGFVSQNLDLYASAANSPGMGGIPFPASNSSALMRVKVDNTSPGFFAGAVWKPTDRDTLGFAYHAKIRNKLKGHYNLYDHDGGLTEGAIEGGTPGLAYPGLDLRMGASASARLDIPAYASLDWVHQFNDRLSLGASATWTEWSSFQDLTLKSHGNTIVSIPYTYRNTWTLAVGGDYKVTDQWTMRAGVAYDQTPTHNATRDPRIPDGDRYFASLGAGYRFQSMPELSIDAAYSRQFVKEVPLKTVNQDRLGGGRLDGRATSKGQVFSLSATYDF

SEQ ID NO: 13859 - protein, 484 aa, Pseudomonas aeruginosa
MMRYQRVTGATLGLALMASAAPGWAADEQATSPTPDNPSYAAQVQSIPSVEKPIKGQAGASGLFEGQSLTLTTRNFYSRENMKDSFTFRIPKAGGGSQRIHQRNAWVQGTVLKYSSGYTQGSIGFGFDVAAFNEIALERGKGRIGGGGNRTLANSDGEAIGEWSKLGVANIRLRASNTEFKAGRFLVNTPVFSYIDNRALPSSFTGFAVTSEELDNLSLQAGSFRKVSPRTGSGDEDMTTEYGTRQVKGDRLNYLGGNYKPLDGLEISLYGSHFQDVWNQYYLGVTHDIGDLENGIALRTAFNGYHTGDTGAREAGYIDNDTWSLAFTLGHRAHALTLAYQQVDGNEYFDYVHETSAIFLANSMLADYNSPNEKSAQIRYETDWSYYGVPGLSTGVWYVKGWDIDGTHYDGDRNGAYGNYAEVRAQDGEKHHELGLMAAYKVQNGPIKDSTFKLTYMMHKASQNQVDGSVNELRLVSTFPFNLL

SEQ ID NO: 13860 - protein, 716 aa, Pseudomonas aeruginosa
MNVSTNHSTFNVSLLATAIAASFFFPISAMANDNNSSGDIETISIFGQAYRNTATKTSLEPEETPQGITILDGEALEQRSVKSLNEALRYVPGVTTEQKGGAVTMYDTFNIRGFDVKQSYYDGLVLQGLNGWNLQPQIDPIALQQIEVFKGPTSVLYGSMPPGGMVNMIAKSPQKEKSTDVKLATGTGNLVEASIDTTGQFGDSDFSYRFIALARQKDGQVDYTKEERYVIAPSVDWQVSDRTLINFNMYYQNDPSMGMNSAMPSSGMIYDNPNGSTDPSTFVGDKNWSTFEREFFMAGYKINHEFNNNWSFLQNFRYMNASLYQENTYHLESNFDASTGNLDRNIYSTDESSTGYTIDNQLSGRVMAGGLEHNLLFGIDYQKLDGDSLYQEFGTTNQFGNFNIFNPNNDMIDKSKLTKSYESKEKISVEQLGFYTQDQVRIDRLVLIAGGRFDQYKSSNTTSTASKDADQSQFSYRVGALYELESGFSPFISYATSFEPAAGLDGKGNAYDPELGEQIEAGVKYDSADYTKTASASVFRIVKSDALMSDPTDPWGPQLQIGEIRSQGVELQGQWMINDRWDVAANYTYIDMEITKDSGNDLEGKTPIYVPTHAASLWSNYYIYDGILTGTRISGGLRYVGEMEMDANNTDKVPDYTVADVSIGYELDGLSESLAGATAQLSATNLFNTEYYSCYDSANCWYGAEQTVELSVNYNF

SEQ ID NO: 13861 - protein, 687 aa, Pseudomonas aeruginosa
MYAEETSSAIPEIIVTADFRGADARSIGGSISVISTEAIERREALHIEDVLNIAPNVNFSAGASRGRFIQIRGIGERSQFKDPLDSSVALIVDGVDLSGIGLAGGLMDVQQVEIMRGPQGTRFGASALAGAINIRSNRPTGVFEGAISAGVGDYGKQNFGLVLSGPLVNNQWLGRVAFQSNASDGYIDNDFLGKDNTNNIDEKLARVSLRWLASDDVTVDLSAYLVDADNGYNAFSYYNTRDIPTDDPGQDRQETLSVSADVLWQGFSAFDVKVNIFGESSDLDYGFDWDWGNLAELGYRGGENNARDRESTGIDIRLLSADDATLLGASWVFGLYWYDREVSLDSTSGDNFSGYGTFSSQTDTERRALYGELEWSLSERLNLIVGGRWEHYQLDYFDNAAVVADPSDDLWGGKIVLEYQLQENVLVYMSANRGYKGGGVNGQAIAKVLNDPSTDADIAEFLTTRAAFDSEALLNYEAGIKGWYLDSALSLSASAFYMDRKGMQAKASVLFPPAEWRDYVDNVDNGKNAGIEFEAQWQLLPELIVFANIGFLDTELGTLIVDDLDSENALNQDGRSQAHAPEYQFNVGAAFSFMNDFSLTVEVDGKDTFYFSNSHNQQSDSYELIHASLNYSHDNYRVSLWGRNLGNEDYQTRGFYFANTPPNYASNEAYYQLGEPRVYGITASYTF

SEQ ID NO: 13862 - protein, 705 aa, Pseudomonas aeruginosa
MSTSFQCPRRPGSFLLSALSLAMFSGGAVHAAETATLPATQVSATATEAQEGYSAKSASTASKSDVPLKEEAQSVNVVTPQTIADYNVRSLDDAMKFVSGVSQGNTLGNTKDSLVKRGFGTNDDGSVLRDGVRSVMSKNFGATTERVEVLKGPASLLYGAMEPGGVINVISKQPQYVQSTTLSGSAYSEGGGSFGIDTTGPLGDSGLAYRLVAERQSEDYWRNYGVDQHTLVAPSLSWTGERASLTLAYEYNDYVSPFDRGTVFTGGHPADISYDKRLDEKWANTVGISETATARFEYQLSDDWKTRLTYGWNNDRYSLSIAQPSTLSSSGVLRRQANGGHYDYETRYASWDFIGKQEVFGQQHDLLIGAEQEDSDKYRGKTYRNGVQGGFNIFSPSYGSLAEPSVVSTTTSNLSNQLTSSSIYLKDNWHLDDRWILVLGGRYQHYDQHIAQGLGASRNTNLNKNDDIFLPMAGLVFKVNEDLSLYGNYSRSFVPNEAVNDDGTTFDPEEGRSYEVGAKYALAPELDFNLAVFDIEKKNVVTTVATGVSEAAGKVGSQGVELDVTGRIAERWDMIGTYAYTHTEVLDDPKNEGNRLSQAPKHTASLYLTHHLQVPSGLGEWHAGGGARYVGDRAGDNANTFYMSSYTVADAFLRWDVPMAGYKTRLQLNVDNLFDKQYYPSSTDSPLQVNVGEPRTARLSASVTF

SEQ ID NO: 13863 - protein, 687 aa, Pseudomonas aeruginosa
MSSSGLFPSRPLWPLTPLALACLIVSGETLGADGRPSELPSQVITANPLGNESPATPSSVLEGDELTLRQKGSLGETLNGLPGVSSTYFGPGASRPVIRGMDGDRIRLLRNGVGALDASSLSYDHAVPEDPNSVERLEVVRGPAALLYGGNAIGGVVNSFDNRIPSEPVDGIHGSGELRYGGADTTRSRSGALEAGDGNFALHVDAASREFNDVRIPGYAHSSRQRQIDGDTGKHRVQNSDGRQDGGAVGGSYHWEHGYAGLSYSGYDSNYGSPAEDDVRLKMQQDRYAFASEIRDLEGPFTSLKLDAAYTKYEHKEIEDGETGTTFKNEGYEGRIEARHRPLGPLNGVVGAQFANSRFSALGEEAFVPHTETDSAALFALEEWKLSDRLDLSFGARLEHTRVDPDAKGNERFAENDGSQSFTTGSLSTGAVYKLTPIWSLAATLSYTERAPTFYELYANGPHAATGTYEVGDADADKEKAVSTDLALRFDNGVHKGSVGVFYSRFSNYIGLLASGRHRNEEGEVVAAGDDEALPEYLYSGVRADFYGVEAQDRIHLLESPYGNFDLELSGDYTRAKNKDTGEPLPRIAPLRLNTALIWELQQWQARVDVEHAASQHRVPEEELSTDGYTTLGASLGYNFDLGESRWLAFVKGTNLTNQTVRYASSILRDRVPAAGRGIEAGVKVAF

SEQ ID NO: 13864 - protein, 789 aa, Pseudomonas aeruginosa
MKVMERASLFALAAALGSGQLWAGQAGDMPSGGSVAAADGASEGLAEIVVTAQRKSENLQKAAIAIASVGGDTLRSAGVVNPAQLTALVPSLQVSNGNGAYANFYIRGVGNFTGNALTESAIAFNYDGVYVARPSSTSGFFYDLERVEVLKGPQGTLYGRNATGGAINVLSRQPQFEWGGHANASYGNYDAVNLEGAINAPLAPDLAVRLTGIYNRHDGYMKDGTDDQKEYGGRLQLRYEPTSELSILIGADYFHQGGKGPGGTLVPTGIDKRYGNFSPQADAYYAGLQHVVGGTTFSPLPNIQYQDNTYWGVNARINYATDFGTFTIIPAYRSSKLDYVTGNIGFFILQKEKFRQQTLEARYASPDSLPVQALVGGYYFRERGRDPYNIINNQFGFVDQFDQRYGTTSAAAFGRLTYAVTPDVHLTGGLRYTHERKKYSGQTLALTRVCLAGFAQCQGQAVPFPNTIVPPTVTVLPDTSVVPDFTSFGAFPFQVGQFGTLVAQDKSKSFNKVTWRAGADWTVTPGSLLYVSYETGYKSGGFYATRDAGIYRPETIRAWTIGSKNRFFGNRLQVNLEAFYWKYKDQQISHLGVDSANALIFPTENIGRSTLKGVEADIQYLLTPTTLLNADIQYLSAKYDRFVYTTPAAGGTPQTGCAVSPIATGFSVDCSGFRPPQSPAWSINLGLTQTFELGSGAKIVFDGRAHYQSRTLTSLEFLDQEYQDGYLLGDLQLTYHDPSDRFTVAGFVNNVGDKTVKGQTYLVTYAAVPTASAILRPPRTYGVRLGYNF

SEQ ID NO: 13865 - protein, 416 aa, Pseudomonas aeruginosa
MKILPVPMLAAGLALLPSFAQAEFFADGKAGLELRNFYFNRDYRQPGASQSYSEEWAQGFLLRYESGYTEGLFGLGVDALGLLGVRLDSSPERSGSGLLPYSTSDRRAAHDYSSLGLTAKLRVSHSTLKIGTLMPRLPVVQFNDTRLHPQTFQGGLLEVNEIDGLALQFGQLRQVKQRDSTNAEDLGITRGNKRNVLAGRHPGSDRFDFAGGTYRWSERLSSSYHYANLEDFYRQHHLGVQHLLPLADDQSLKSDIRWARSTDEGGSRVNNRALNALFTYRLGGHAFGLGYQRMSGDSGFAYLAGTDPYLVNFVQIGDFANKDERSWQLRYDYDFAAIGLPGLTFMSRYLRGEHIDLLDGGGRGKEWERDTDIAYLVQSGPLKNLGIKLRNGTFRSDFGNDIDETRLIVSYALPLW

SEQ ID NO: 13866 - protein, 616 aa, Pseudomonas aeruginosa
MNRVFLTPAAVALCGASSLSLAEPVSLDDQVVTATRTARTAAQSLAAVSVIDRAEIERSQARSVPELLRQVPGVSLANNGGFGKNTTLFLRGTESDHVLVLIDGIKVGSASAGLTAFQDLPVELIERIEVVRGPRSSLYGSEAIGGVIQIFTRRGDGQGAKPFFSAGYGTHHTLEGSAGVSGGAGNGWYSLGVSSFDTAGINTKRAGTGGDEPDRDGYRNLSGNLRGGYRFDNGLELDGTLLRAKSHNDYDQVFGNSGFNANADGEQNLVGGRARFTPLDPWLVTLQAGRSEDKADAYQDGRFYSRFDTRRDSLSWQNDLTLAEGHVLTLGYDWQKDEIGSSEAFSVDSRLNKGWFAQYLGQHGRQDWQLSLRRDDNQQFGVHDTGSAAWGYALSDALRFTVSYGTAFKAPTFNELYYPDYGNPDLDAETSRSLEVGLSGTHAWGHWAVNAYRTDVDDLIGNDPRPAPGRPWGQPNNIDQARIRGVELVLGSQWLGWDWNANATFLDPQNRSGGVNHGNELPRRARRMFNLELDRRFERLSLGASVHAEGRRYDDPTNKVRLGGYATLDLRSEYRLNDEWRLQGRIANLFGADYETAYGYNQPGQAVYLSVRYQAL

SEQ ID NO: 13867 - protein, 424 aa, Pseudomonas aeruginosa
MKTIWFKTSLALTISAVSTYTLANGIAINEQSASGAGTAYAGRASSALDASTIYGNPAGLSKLKRTEVSGGLAIVKAKDDISQAHSTAQGSNKGDSVPLAAVPFGYFSTPINEDFTFGLGIYVPYGIINDYENGFMGSSHGSYSKVQVITVQPTIAWKINDKVSVGFGPTFNRIDGQLKNTLATNGLLGSNGDTKINIKGDDTAIGYNVGVMVDLTDDTTWGLTYHSKVKYHLGGNTEVKNAPGALGLNGKYDAKLDITLPESVDTSITHKFDDKWTGYLGAVWTRWSRLEKIEVRNSGVPALGQALGFNTIGEDLNWRDTWSFSVGTSYQATPEWVLRTGFAYEPSPTSNEDRNVRIPVGDRKVFTVGAGWSPNQDLTVDVAYAYLWETTAGVNQEGSALQPAYSAKYDNSAHGLTAQVTYRF

SEQ ID NO: 13868 - protein, 851 aa, Pseudomonas aeruginosa
MTLPFTRAAWRPLCSAAVLGAALWAAGASAAERRFDLPAQPLAAALTRLAQQAQVQVLFDESLLRGLRAPALSGSYAVREALERLLAGSELELVEAGGGYVVRRRQVDAYSDNALQLDAQTIVGNGREVDASNVGRSTLTRRDIERQQADNIPSLLQTLPGVTMGGSPKPGGQTTNIWGLGDAEDVPYTLDGAQKSGFERYQQGTVFIEPEMIKRIEVEKGPHSVFTGNGGFGGTVHMETKDAPDLLREDRDVGAMLKYGYHSNDQQKIYSGAVFGRSQDRRVDALVYLNGRDGRDMKLADNLPLSPKDYPVNPQRLPNSAQDEKTGLFKLNLHPTEEHDLGFTYLRSKSSRWTPFSASSYPTPPSQWTIDRYGYELGLTRLLAHRDTTDTTWTGKYNYHPLDNPWIDLQLSYSDARTEQLDRREDSAFYQLATGGQRMRTEYRDKVLELRNTSRFDTAALQHELTLGAVLHKHKRDILMHMPGKTYDTPRYNYGWLQPAFMPAGKQDTQSFYIQDAITYGSLTITPSMRFDSVRNDGQANLAPIYHNPRLGHDYRAQTYSGWSPRLSVFWTATPNLAFFADYTQTWRAPVIDEQYEVQNSSTIGGSSRDLDAERIHAIRGGSVINLPDLLVAGDSLQIRTTLFQNRIKDEIFRTRSVGCRQQSIDNGSIGGSCGDLLPLSNYRNLPGLTIKGFEIESFYDSQRVFGSLSYSWMTGKHDGAYSNPWGPNVWARDIPPPKWVAMLGLKVPEWDARLGWQGEFVRKTDRLPSDRYSGGMGTGSGDIYWDHAANDSYDTHRLFAEWVPAKLGLKDTRIDFTVDNLFNRSYRQPLGGDLVYSQGRNAKISVTQFF

SEQ ID NO: 13869 - protein, 732 aa, Pseudomonas aeruginosa
MDRRNEPSPLPTKRPLAPLMLLMAACSSPALAEDAARKDDPLELGADTVTGEQASSRVERSASAKYAVPLLDTPQTVTVVPQKVIQEQNALSLRQVLSNVSGITFNAGEGGGGSGDSINIRGFSANANMQVDGLRDSAQTSRSDLFNLEAVEVIKGPNSVFGGAGTSGGSINMVSKQPKAEAFTHLGAGLGTDRYRRLTLDTNQPLEGLGESTAFRLNLMAHHNDVAGREQIDKQRWGIAPSLTFGLDTPTRLTLSYFHQRDDNLPDYGVPALNGRKLDGVSRHDYFGWRNLDEERIDNDVATLKLEHDFSDDFQLQNLIRYSHLHRDTVISASHVNQKGLPPGRYLPAGPQAYGRDSKTRMWINQTNLTGRFDTFGLAHTLIGGFELSRETYDRTTYSYNLGKFYPANGFDLHNPPGYWNGPTDKRDSARNRTELEVKALYAFDTIALDERWDLSLGLRYDWIDGTSRSTPSGKPTVRADSSDGKLSTRAGLVFKPLENGRVYFSYGTSFNPSAEHLVTTGSGVTEATGGLAPEKNSTYELGTKWEFLGRRLELDAALFQVKKEDARERLADGSYVLAGEQRVRGLELSASGKLNEHWDLFATYTYLDSETLKSSNPQREGQALGNTPPRSLSLWSTYELPEGVTLGYGARYVSQRNVTSVDNGKLDAYWVHNMMLGYQATRDLKLQLNLDNLFDKAYVERVRQVYGNQSRSSAIEYGDGRTAILSAIYAF

SEQ ID NO: 13870 - protein, 816 aa, Pseudomonas aeruginosa
MHFSLRSRHLRPSLLASSLLLAVSAQAQEKLDMDLPAAPLGQAINALAQQSSVQILFAGDLGTGRQAPALKGRYTPEEALRQLLRDSGLQAQTRDEHTFIVVPAGEARKAAAPVPQAQSEPLDMEQMEITASRTSSDLVSATRQSTVIEHAQLEELRQGSDSLATVLAKAVPGMSDSSRTITEYGQTLRGRSMLVMVDGVPLNTNRDSSRNLANIDPALIERIEVIRGSSAIYGSGATGGIISITTRPAGGENRAETRLSATSPLTRLGSDGLGGQFQQYFAGSLGALDYSFDFGTRHVGASYDAHGDRIAPEPSQGDLFDSNVYNIGGKLGLRIDENQRVQLALSHYDARQDTDYATDPRVARLPPGSVPANAIKGLELDEQNRIRNTLANLEYENLDILGSRLSAQLYYRDYFTRFTPFDARAVSTRGGNVDQIMQNSEVFGSRLTLRTPLGESGNTELVWGGDYNQERSDMPLDVFDPAAYDASGGLVFDKIGKLTYMPPLRTRSAGAFAQLQHRFDEHWSIDGGLRYEYSTAEFDDFIPLSESKAASPVAVKGGDLDYDAVLSNLGIVYSPVAGQEIYASFSQGFQLPDVGIQLRNARRGFDIGSSNLEPVKTNNYELGWRGAIGGNTLGSLALFYTTSKLGDVQSFNNGLILTRTKERIYGVEASADWLSDDEVWGAGGSATWMRGREKPDGKDWQNMTGYRVPPLKLTAYLQYKPDADWNNRLQATFFDSKDYRLDGVESFGRRQVSTYTTVDLVSQYRITPDDQLSLGIQNLFNRDYYPLYSQLLRNNNNTSHLPAPGTVLTASYTHNW

SEQ ID NO: 13871 - protein, 702 aa, Pseudomonas aeruginosa
MPIASRAPVPLTLVALLFGGKALAADLFNDPSGVPEVLTATRLKQSPAEVPGSISVLDRELIVASGARDIPELMRLVPGMMVGYLSGNQPTVNYHGTSMSGARRLQVLIDGRSVYRPGLASVDWSDLPVALEDIERIEVFRGPNTVSYGANALMGVINIITRAPGESPGTRLKYTAGQRGIRDWYASQSIALEDSDFRLSLSGQEDDGFDHAHDGQSLRDGRRLSRFNLNASHSLAPNQSLEWQLAAKEGSNQHPYAYHSPFPRVPDNVDNSDTLAHDYAGSLRWNVDLDPRHSFYIQGYAQHWERQQEWNACEAAIAFSPELARLWELNPGYLRQFGDDPSRLPPGSAEEQRLATKVLEQLNSGGLQPVCGRVDRNIRESRYDLELQDTLSLGDNLRLLNGLSYRYDQARSETFYGGKVSSQIWRLFSQVEWHAGEHWLLQGGGMLEDVQGSGSSFSPRLAVNYLINPQHSLRAVYSEAVRSPGMYENDVDWRYRVRHLTPAPYGQSEAYYFASAHGPGDLGKEHTRSRELGYNGFFREAGVAVDVRLFHEEITGLISDPLSVVDFSPDNGDRIRFAGAEGQLDWRLGLRDRLRATYAYLDYDATSRYDRRLTARHGGSAGWMRDWGRGWSSALFYYGDDSLNGHRFERIDLRLAKRIPLGKAALELSGVLQQRLDDEPLTLPDNRYDSRHLLYFSAEVTF

SEQ ID NO: 13872 - protein, 532 aa, Pseudomonas aeruginosa
MKMRIAPLRLALAGVCLAWIPQAGAQMANDLTIGNPKAMALGNAVTADETGIDSVHYNPAALTRMKGRQATVKLLTGVMDIRAGFKAPPNYGEGTFGLRDDPVANSHSRTLTPTMYLPGLGGMTEVPLLVAPLAGISINPPGSKFTFATNVYTPQALGYSRDSDSDPARYQGREVSLQRLTYFSPTLAYQVNDELSVGLSVGFSHQAVALNQDFRAPNQLLGLLQQTKEIGCLPGMQEILEVFFNVCGGNIGPFQNLANIDLDIQQSLSPSFNLGVLWEPTDWFAWGATYQSESRMKLKGKYRVDYGQGWQGFWTGVHKSLGGAILGQMFPYGNVDEEHGNATMNMVYPDAFSTGIRVRPFKKWQFNVDLKWNGYSDWNEFKIEFDRELDLLRIAKYLDSKDATSHSITLDRGYRDTWSWAMGVQYDVNDRLQLRAGYEYRPSAIPKGQADILVPIGDADLYGLGLGYQWDKDTVIDVGFNYFVTKQSVKADTSCNLNCTGLDNLVYNPYAGLDVDTTVKAYIFAMTYRTTF

SEQ ID NO: 13873 - protein, 804 aa, Pseudomonas aeruginosa
MPVRTLRPRSLSLAIHAAAMTLALAGAAPALLAAEAPAASSARSYDIAPGPLGRTLSAFASDNGVSLAFDPALTEGRRSAALRGRYAPVEALHRLLLGSGLELQQRSDGSYTLVPAATDGALELQSSLITAQAAGAETLPAEYAGGQVARGARLGMLGNADVMDAPFSITSYTARTIEQQQARSVADLLQANDPSVRVVGGRGDLVDSYTIRGFSVQNADVAFNGLYGLLPFWRVPIEFAERVEVLKGPNALLGGISPGGSVGGTINLVPKRADDQPLTRVSVDWTQRGQLGTHLDIGRRFGENNAFGVRFNGVYRNGDTAVDHQSREFPMLSLGLDFRGERLRLSSDLLYQKESLEGVVRPLLTGPGTTHIPHAPDSKTRFGLRDSYLDQEDYSMVNRGEYDLADNLTAFASIGGRQSNYETIAANSILVGNQGDIVNSLARQRGDRRTYSAEVGLRGNFDTGPLRHDWTLSANRLHERLGMVYAFTGMQSGNLYQTSPHTPLPDFSSLDGSIPKTNETDLGGVALADRLSFLEDRVQVTLGVRRQQIESRNYDQTSGARTSHDKRHVWTPMASVLVKPLQDLSLYANYIQGLSQGEAAPMTAANAGQVLAPYKAEQYEIGAKYDLGGFTTTLALFEIRKPNAYTDASNVFRADGEQRNRGVELSLYGEPLDGVRVMAGATYIKPEQNKTGDPASEGKDAPGVARRQANLGVSWDTPFVDGLTLDSRWIYTGSAYVDSANALAVPHWNRVDLGAAYAFQVAGKPLVARANLENALGKDYWTAANGYLSISSPRTLSLSLTADF

SEQ ID NO: 13874 - protein, 480 aa, Pseudomonas aeruginosa
MTPGTRLRQMTSACGRVARPPGRRKFTVMPNRVRAAALGLAVLTCLAPRPAAAQGSVWTRKHLFGDWGGVRSDLARRGVALGAVEQVVPSDVLGGGARQGTSVAALMTLSARVALGRYAGIPGLSAYVSAWLVQGRGPSGHDVQSLSGLAYEEAPGGARLGDAYLSWKAAHDAVHVKLGKFGIDENFDQNPAAAALVNSNFTYRNIMADNLPGGGPAFSYEGPGAMVAVQATRALRLRVGLFGGDPLGQPLEGPAPPARDAGGLGFPLNAGALVIGEADVRYRLPGLGRGMALVGGLYDTLSRPDLLYSVTGQSLALAAVGIDPGPARQDRGDDVIYAGDTQTLWHGARGRRLRGFARVAAAPPDRNLISLDAQAGLVLDGTFRGRPHDAAAVAVSWDRISPRAATLVRAENRLGGARAPVPGAETDLELDYTAQVAPWLSVTPDVQYIVRPGGGIPDPLDGAKAEPDAVVGQVEVTVVF

SEQ ID NO: 13875 - protein, 846 aa, Pseudomonas aeruginosa
MVTGSRIPRAQQEGPSPVTVISSEEIQNRGYRNVFEALQTQTQNTGMTQGEDYGNTWQPAANALNLRDLGPNHTLVLINGRRVADYPTAYGGSVNFTNLANIPAVMIDRIEILSGGASAIYGSDAIAGVVNIVLKKKFDGVDVNLRAGTTERGGGDNQRLQLVGGGATGDFEGLFGLQVEQRQPVWANQRGFMDSYPDGNNVGYRLNPQSGRYLGDASCAGLGGLFGGNVAPVPGARGGYRCMTDQYYNNYWTLQTKKENYDGYAGGTWHLSDSGKLFADLLFGFDHLQNNTRGPSFTSPDFINASSGDLERWYRLFSPEEIGGKSSNNSKWREVSWTGTLGYSDRVANTSWEYELAATRSEYRSDRTTRYTPAAGILDLYLGRKLGERDGYPVYDPDPARLGRPLSEEEWRSLRRNVTQHSESYSQTYSFTGNGELFDLPAGPVAFAGVLEVGKQGYRIRPDSQYNDGSLYNVSKASSSGGSRDRYAAGGEFSIPLHDTLLASAAGRWDQYRFSGRTEEQTTYNLGLEWRPLTSLLLRGSYGTSFRAPDLNYIYQADANGYYPAQKDYYGCEKGVDGACKNGRVDYVQSGTPDLKSERGRYWSYGFVWSPSSRFDFSADYYHIQIDDLLTTLDPDKLLRDEAACRSGGLDPDSAQCRDTLARVERNAGDASVDPNRLNKVYVNAINAAKERTSGIDLRSNIRWGAGDYGAFSSTLGYTLVLSHDYKQSDDYPSENQRDSLDSHDWRSKLNASLTWDYAQFTSTLFAVRYGSVTNAAGSGRLSPWTVFNASARYRLNERASVGLTVNNLLDQIKEDDSDGWPYYPTGNYDAMGRQWWLDFSYHFGG

SEQ ID NO: 13876 - protein, 880 aa, Pseudomonas aeruginosa
MHRSLHTDAPLGAALLLALQLAPGSAAAAEEQAPVDPPTVQLQRIEVTGSAIRRVDAETAVPISVLRAEELRQQGVTSTEELIGRLSGNQGVYNSSRSVGSATGGASFADLRGIGANKTLVLLNGRRLANNAIDGSAVDLNTIPFAAIDRVEVLRDGASALYGTDAIGGVINFITRKSLNEGRFDSGYASPTHDGGGNQRNVSASWGFGELEEDRFNVFAVANYDKQERLGAKDRGYTYNYQPGRGLDYSSGTAFPGNWSQGANASNPLAAGGCKGADLIPRNGICRQSLWRYLDLVPETEKTSVFSRATGKLADEHNVSLEYFWSRSDNATQVGPGTLTGLQIDPGTAFYPGNGITPGPGGFVLDPSRPVEVNWRQSVLGPRLQSSQNTGQRLLLGFDGQFAGWDYDIGASYNQNKVVDHIHSGYVDDRAAALGIANGTLNPFGPQTDAGLAYLGSHALSGDFRTSVGRVKGLDARASREIGDWFGAGPAALALGGEFRKEAFHQDIQDFAGNVQSLGVDPAATVSGERNLKAQYAELNVPVLDSLELSAAIRHDKYSDFGSTSNPKYSFRFQPFRQLVLRGAYSEGFRAPSLYELYNPTFTTYTSANYDDPRLCAGGQPSQGGIANRDCAQQFYNATGGNTDLRPETARNVTLGLVYQPLRDLSVGLDFWWIRIANQIAEFPEAAIFADPQAYAGRIVRKADGSIDHVVTGLANLGKVKTSGVDLSLDYRFPASRYGQFGLDLQGTYVSRYDFQQQIGGQYLDNVGDFQGVGVIARWKHVANATWSRDAWQATLSNRYTSGYNDYDRASHGKVGSWNLWDLAGSYRLSHALGLTLGVKNLFDREPPFSNQTYTFQSGYDPRYTDPYGRILFGRLSYSF

SEQ ID NO: 13877 - protein, 794 aa, Pseudomonas aeruginosa
MPNMIRDRNEKSMKPISFRVSLLLCAVSIIPISAVAATQPKTHPAAHPAAAPSESISVVRTLRQASGSGQMVRTHAEASVSTVDRAYITKQVASAGALNLVQNMPGANVATSDAFGMSNQVTMTLRGLNQQEIGFMVDGTPQNDPNNGTIYPSQLIDSENLQSASITQGSSPIDTPSYVDLGGQVSFKTIDPSHQFGGYASSMFGTWDAKKEFIRINTGDIGHTGIRGWMSFSDFYDQHFTGPGTDRRLHIDAKFLKEWGQGNRVAAVFTWAHQTISNYYEPTLAQWNATGRSNYYSPTYIQGGSPAANSAYWRMYQNPWEDFNIGLPSTFRLARNLTADVEPYFFHGSGGALSGTTLPTGGYYWGNQFESPGSTLPGASGGQAPAVQRYLNSPYRTGFVEKLNWTQGKNTLTLGNWYEYDDFSNWIDYTPVTASGAPQGPRGTDPTVMMANGRPLRSGDYNLMTQVNGIFLNDRLSLLHDHLQITGGIKAVMVDRVGTNHIPGTEYRIHDNSFQPLPRLMVRYDFNHEHQLFFNVTTGFRAPLGTSFFGSTSPATGQVTSLGAGQQKDEYSIAEEIGYRYQGRQVLGSVTFFNYNFTNRQIATQTYVGNLPVSTTINEGGQTSRGVDIELGTVPFMHFSPYASFEYLHTTIDNDFRVGNDYLPTKGKTAVQSPRFQASFGLSYDDSLFFGNFGLKYLSSQYSTFMNDEKMAAQTHGDMTIGVYLPSYRYIKHPKFQLNFVNLWDTHYLAGLGSVLPNARSTRGVNGTIIDAAGAPTYIIGAGFTVAAQLSTEF

SEQ ID NO: 13878 - protein, 409 aa, Pseudomonas aeruginosa
MHPTPRLAAALLAGSGLGWPLLAQADLVEDSHASLELRNFYFNRDFRQSGARDNADEWAQGFLLRLESGFSEGTVGFGVDAIGLLGFKLDSGSGSGGTGLLPADGSAGGSQDDYAKLGLTAKARVSNSLLKVGALHFKSPLVSANDTRLLPELFRGALLDVQEIDGLTLRGAHLDRNKLNSSSDYQVFSANRIGGRSDAFDFAGGDYRLTPALTASLHQGRLKDIYRQTFAGLVHTLDLGGQRSLKSDLRFARASEDGGFRELDNRAFGALFSLRLGAHAVAAGYQRISGDDPYPYIAGSDPYLVNFIQIGDFGNVDERSWQLRYDYDFGALGLPGLSFMSRYVSGDNVARGAANDGKEWERNTDLGYVVQSGPLKNLGVKWRNATVRSNFANDLDENRLILSYSLALW

SEQ ID NO: 13879 - protein, 416 aa, Pseudomonas aeruginosa
MTRSAPNLLKSASLAPVLLAGLPSLAGAEGFIEDASVSLGLRNLYFNRDFRQPGAAQSKQEEWAQGFLLQAKSGYTQGTLGLGVELIGQLGLKLDSSPDRAGSGLLPRHADGRAADDYARLGVAPKLKLSNTELKLGELLPELPILLRNDGRLLPQTFQGGMLTSREIAGLTLHGGQMRSLSQRNSSDHQDLSVDGRGGAFSDRFDYLGAEYRFNAERSQVGLWQARLQDIYRQDYYSLSHKQSFGGWRLGASVGLFDTRDEGAAKLGELENRALTGFFSATRGGHSLGAGYQRMYGDDGMLYIAGTSTPLVNDIQVRNFTSAGERSWQLRYDYDFVALGIPGLTAMARYASGAHARTKAMDDGRAWERDVDVAYVIQSGPLKNLGLRWRNAMLRSNHAADVDENRLILSYSLPLL

SEQ ID NO: 13880 - protein, 706 aa, Pseudomonas aeruginosa
MPSRPRPSFVSHLLPGSLALCGLAIACAVQGEERRSLEPMVVTGSYNPSDTFDLPFSVDSIERRQIADGQLGINLSEVLPRVPGLVVQNRQNYAQDLQISSRGYGARSAFGIRGLKLLADGIPASTPDGQGQAATLNLDVAERIEVLRGPASTIYGSNAGGVIQMFSRDGQGAPRVGAETSVGSDGLSRNHLYTEGEGDGVGFLVDASRMDTDGYRDHSAARRDQTFAKLNFRPDADSRVALIYSSLEQNDTEDPLGQTWDAYKHDPRSVTANAELYDTRKSIDHQQAGMNYERYFGEATLQVNAYVGKRSVVQYLSIPRGVASNSQRGGGVVDFDRDFHGGTVRWLQPVRQAPGVLNLTVGLDYDQSRDDRRGYQNFNGDQLGVKGELRRDEVDTATSLDPYLQASWAIDAWTLQAGVRHSTMKMEVDDRYLSNGDASGSRRYRKNTPSFSVMYAFTPDLHGYLSAGKGFETPTQAEMAYAPVAANAPDVFNFGLKPATSSQYEAGLKARLWGNTRVNAAIFQIRTEDEIVVASSLGGRTSYQNAGKTLRRGFELGLESELSEHWNANLAYTRLSATYDSDFEAGGKTIGKGKHLPGVPESSLFGELVWKPAEGISMGWEGMYRSQVYVEDSNSEKAAPSYAVFNWRTRFEQRLGAWAFHQLVRLDNLFDRQYVGSVIVGDGNRRYYEAAPGLSWYAGAGVEYQF

SEQ ID NO: 13881 - protein, 452 aa, Pseudomonas aeruginosa
MKSHLLRPALRPVAGGLLSASLLCNAVHAAEAFSPNSKWMLGDWGGKRTELLEKGYDFKLEYVGEAAANLDGGYDDDKTGRYTDQFALGVHMDLEKILGWKATEFQFTVTERNGKNLSNDRIGDPRAGHISSVQEVWGRGQTWRLTQLWLKQQYFAGALDVKFGRFGEGEDFNSFPCDFQNLAFCGSQVGNWAGSIWYNWPVSQWALRVKYNFAPDWYVQVGAYEQNPSNLETGNGFKMSGSGTKGALLPVELIWQPKVGAEQLPGEYRLGYYYSTAKADDVYDDVDGQPQGLTGNDFKSRGSKHGWWVVAQQQVTSHNGDASRGLSLFANLTVHDKATNVVDNYQQLGVVYKGPFDARPKDDIGLGIARIHVNDDVKKRQRLVNQVNGIDDYDNPLYQPLQDTEYNAELYYGVHVTDWLTVRPNLQYIKQPGGVDEVDNALVAGIKIQTVF

SEQ ID NO: 13882 - protein, 815 aa, Pseudomonas aeruginosa
MPAPHGLSPLSKAFLMRRAFQRRILPHSLAMALSLPLAGYVQAQEVEFDIPPQALGSALQEFGRQADIQVLYRPEEVRNKRSSAIKGKLEPNQAITELLRGTGASVDFQGNAITISVAEAADSSVDLGATMITSNQLGTITEDSGSYTPGTIATATRLVLTPRETPQSITVVTRQNMDDFGLNNIDDVMRHTPGITVSAYDTDRNNYYARGFSINNFQYDGIPSTARNVGYSAGNTLSDMAIYDRVEVLKGATGLLTGAGSLGATINLIRKKPTHEFKGHVELGAGSWDNYRSELDVSGPLTESGNVRGRAVAAYQDKHSFMDHYERKTSVYYGILEFDLNPDTMLTVGADYQDNDPKGSGWSGSFPLFDSQGNRNDVSRSFNNGAKWSSWEQYTRTVFANLEHNFANGWVGKVQLDHKINGYHAPLGAIMGDWPAPDNSAKIVAQKYTGETKSNSLDIYLTGPFQFLGREHELVVGTSASFSHWEGKSYWNLRNYDNTTDDFINWDGDIGKPDWGTPSQYIDDKTRQLGSYMTARFNVTDDLNLFLGGRVVDYRVTGLNPTIRESGRFIPYVGAVYDLNDTYSVYASYTDIFMPQDSWYRDSSNKLLEPDEGQNYEIGIKGEYLDGRLNTSLAYFEIHEENRAEEDALYNSKPTNPAITYAYKGIKAKTKGYEAEISGELAPGWQVQAGYTHKIIRDDSGKKVSTWEPQDQLSLYTSYKFKGALDKLTVGGGARWQGKSWQMVYNNPRSRWEKFSQEDYWLVDLMARYQITDKLSASVNVNNVFDKTYYTNIGFYTSASYGDPRNLMFSTRWDF

SEQ ID NO: 13883 - protein, 778 aa, Pseudomonas aeruginosa
MPDRSDARRRAHQAFLTTSCVVAVRVAVGSAVCWTALAPQIAAAQSQSQQLPSVTVDAPKRAVATRSAPAPQRSTNAPIRRQARRTPIAAPPSPAERAAAAAVQLNEAKLGYRAMPSPTTLRTGASPLDTSQAVAVVPEQVLKDQLPRNLDDALANVSGVTQTNTLAGSFDAVIRRGFGENRDGSIMRNGMPLVQGRSLGPTVESVEVLKGPASLLYGIQSPGGVVNTISKRPELYQHGSLTVIGSSFGGGHNGANAIFDLTGPLGTQGLAYRVIGSGLDEDYWRNFGANRERLLAPSLAWYGESTTVQFSYEHRDFSYPFDRGTAFVKGAPLAIPATRRLDESFNRTWGQSDLLQASVEQRLGDTWKLTTAYSYNREIYEANQLRITAVDPVTGIEKRSNDGTHGALAYVGYGTSYLRSDLWLGGLRHEVLIGGEAQRRLIYRQDLIRQATPTFNFYNPVYGLVGPGTTVSASDSDQTDRLETRAVFAQDTLHLTDRFSLIGGVRWMDYEQLAGRGRPFTANTDLSGNKLLPLGGAVFKLTDQISLYASYTQSLQPTSTIAPLQNSGGLVIGSNIAPEEGTQYEAGLKFDLNKRLSGTLAVYDIDKKNVLVSQFNAATGLNEYRAAGKVRSRGVEFDVTGRLTDDWSTIASYGYTDAIVTDDPALSGKRLQNVAMNTASLFLVYDFGTALPGRLRLGGGARYVGDRPGDSDNSFVLPSYTVADLFATYEVKYGRTPVIYQFNVKNLFDKVYYPSAVNTLNVALGDARRFSLAATVKF

SEQ ID NO: 13884 - protein, 448 aa, Pseudomonas aeruginosa
MQGDGKKRLWTLPLLLGAGLMASAVAEENAERSKEGFIEGSEVNLLLRNFYFNRDFRKGQSSPAGGGYTEEWVQGFMANFSSGFTQGTLGVGIDAFAQLGVRLDSGGGRSGAGGSVDLLPYDDQGRPQDDYSRAGGAVKLRWYGTVLRVGDVFPETPVIQYGNSRLFPSSFRGFTLVNDSLAKGLTLQAGKLNSMTQPNSTSGSDDFYSFYTGRRIDSPWVAYAGGDYQATEHWSVSLYGSRQKDAWDQYYAGTSFNYPLDDKLSLLGGANYYKVKDQGRQVMGELDNDIWSVRGGFAYGPHQVLLSYQRNNGDDDFDYLRQTDSIYLDNSIQYSDFNSPKERSLMLRYDLDMAAFGVPGLSFMTRYGKGWDADYSNANSVYMRTDANGNPLTNQGRWERDVEVKYVVQGGAAKDLAFRVRQATVRSDSFESDLDEVRLIVEYPLQVL

SEQ ID NO: 13885 - protein, 472 aa, Pseudomonas aeruginosa
MPDSSMKRGATLCLALAIGPGSTLADDSLGHRDNISTGLNQRQKAEMKVPPGFVEGSTLNGFIRNYYFARDNHDTPSRRDQREWAQGLMLSFRSGYTDTPIGIGLDAHAFYGLRLDGGGGSGGAGVLPLDSAGRPADSFSAAGAALKLRGLDSLLKIGDQLLENPVIASGVSRMVPQSYRGVTLKNYHFRALELDAGFVEATRLRNQSGHSHLTSGYGNGTKGGIAADRESPHIAWLGASYSAPGGSQATLYSGRLEDIWNQHYLGLSQPWRLSSQLTLTPWLHYYKTRDQGRSQLGRIDNDLYNAGLTLAGGGQSLSLSLQKVDGDTPFDFIAQNDRTFLYESNAMQYADFNGPGERSWKIQYQASLAFLAAPDWQFGAAYGRGQADLTRVDPDSAGYGYLYNPNGKNAQHWERDLSLRYAFPAGPAKGLSVTLRWATHRPGEGYTAPGNTRGNSSSDEYRVVVDYPIRLL

SEQ ID NO: 13886 - protein, 746 aa, Pseudomonas aeruginosa
MSSRALPAVPFLLLSSCLLANAVHAAGQGDGSVIELGEQTVVATAQEETKQAPGVSIITAEDIAKRPPSNDLSQIIRTMPGVNLTGNSSSGQRGNNRQIDIRGMGPENTLILVDGKPVSSRNSVRYGWRGERDSRGDTNWVPADQVERIEVIRGPAAARYGNGAAGGVVNIITKQAGAETHGNLSVYSNFPQHKAEGASERMSFGLNGPLTENLSYRVYGNIAKTDSDDWDINAGHESNRTGKQAGTLPAGREGVRNKDIDGLLSWRLTPEQTLEFEAGFSRQGNIYTGDTQNTNSNNYVKQMLGHETNRMYRETYSVTHRGEWDFGSSLAYLQYEKTRNSRINEGLAGGTEGIFDPNNAGFYTATLRDLTAHGEVNLPLHLGYEQTLTLGSEWTEQKLDDPSSNTQNTEEGGSIPGLAGKNRSSSSSARIFSLFAEDNIELMPGTMLTPGLRWDHHDIVGDNWSPSLNLSHALTERVTLKAGIARAYKAPNLYQLNPDYLLYSRGQGCYGQSTSCYLRGNDGLKAETSVNKELGIEYSHNGLVAGLTYFRNDYKNKIESGLSPIDHASGGKGDYANAAIYQWENVPKAVVEGLEGTLTLPLADGLKWSNNFTYMLQSKNKETGDVLSVTPRYTLNSMLDWQATDDLSLQATVTWYGKQKPKKYDYHGDRVTGSANDQLSPYAIAGLGGTYRLSKNLSLGAGVDNLFDKRLFRAGNAQGVVGIDGAGAATYNEPGRTFYTSLTASF

SEQ ID NO: 13887 - protein, 435 aa, Pseudomonas aeruginosa
MIRVRPVGRLALFLALGGTSPCHAATEEAKAPDYLEWRLLNRNYFLYNDYRRADAGRGYRKEWAHGLIVDLESAYTPGRVGFGLDLHGFAGFKLDGGRGHAGTGLLPLDSSGDNASEYSDAGAALKLRLGESLLKVGEMTVETPVFDTSDKRLQPQYARGFFLQSDDLDRVRIQAGRFTAFKEQASSSGHGDFDGYGASTAGSAIGFAGASLAASDNLSGSLFAAQLDNVWRQVYLNMNLQRAAFSLDGNLYRTRDQGRSRAGAIDTLAYSLQLKYRVGAQGFSLAYQRVHGDTPFDFVGGDSIYLANSIKYADFNGPGERSWQARYDLDLAPFGLPGLSFMARYVSGRAIDGSHAPAGGAYNPLGADGRYRPLQGSGGKHWERDLDLRYLFASGPFKDLSLNVSHLSHRANAAQAGDDIDRLYLIVEYPLKGSL

SEQ ID NO: 13888 - protein, 719 aa, Pseudomonas aeruginosa
MPRFSRLRTEPFALGLSTSLLLVPPALAETEEAALALPSQLVSVRQDPAELDHIDLATPVSAGSRLGLSALDTPASTSSISGEEVRRRNNPSVQAAVTRSPGISFIGTPGDGGTGLSARGFSGHASVMQLFDGTRLYTGMGTVNFPSDPWMVERIDVIRGPASVLYGEGATGAVINVVPKKPFAGEIRNHLRLGYGSYDNRQLALDSGGSLTDSLSYRLNLNQQQSHGWIDRGDSRNLGISAALRWQASDDLAFTLAHDYGDQEPMNDFGTPLVGGKYHKRLREKNYNVRNDVQRYNDQWTRLTSDWSLSDSVTASNQLYYIKARRHWRNAETYEWDVPREELLRKDYLRISHEQEQIGDRQTFAFQHALFGLDSRTLVGAEYNRIRFRLTNNISPYTDVGGDYIDPWHPAPGYFESRSPYRPHSRSQTRTFALFAENRLQLNERLSLVTGVRRDQNHIDRDDLLTGTRSDRSLQGGNWRAGLVFALTPELSLYGQYSTSEDGVSNLITLNAAQQQMDLTHSKQTEVGLKQLFPDGRGEWTLAAYHIVKKKLLSANPLPPHDAQQVGQQSSDGLEASLELNLAQDWRLSANAALVRAEYDDFDETIDGQTYSRNGNRPRNVPRRTANLWLDKSFAETLRVGAGLRYVDRRYADAANQASLPGYTVVDANLGWRVRPDLTLGLELYNLFDRQYALADNNNGQQWIMGQPRSFNVTADFSF

SEQ ID NO: 13889 - protein, 376 aa, Pseudomonas aeruginosa
MSRTTFALAAITAAVAGLAATGAQAQTSSVTLYGLIDTTISTVSNTNAAGARTTGFQVPWFSGSRWGLTGKEDLGGGTSAIFKLESEFETPTGNMDTPGVLFNRDAWVGLSNPTFGKLTFGRQNALARDVAGIYGDPYTSAEVTLEEGGFTNVNNFKQLIFYAGSATGTRLNNGVVWKKLWDGGFFTGLAYQFGEVPGQFSQNTTETAALGYNGGNFHLSAFAQQAKVNGFTDRSYSLGGNVILGMFRVNAGYFHYTGDQPAAIGNRKDDAYTVSLKIAPPGAFDYEIGYQIMKAGNAAFSADGNTLNAYADVSTATASGSGRKNTLYGSVFYHVSKRTEFYVAADYMKLKDQYIVGSTNGHNSQTEFGVGMRTRF

SEQ ID NO: 13890 - protein, 891 aa, Pseudomonas aeruginosa
MKHRGWSAVRGGRKGAQLALGLGLVLLGTAALPLHAQDGADSASQQQTALRRVRLDIPAQPLNRALLRFAEQAGVQVFFDSQRFAGLGSAAVHGEYLLADGLSQMLQGSPVEYRFSGKDQLSLIRVSQDDLVQMSPSVISAARPDDWVYQTPHSVSVIGREQIERNPPRHAADMLEETPGVYSSVSQQDPGLSVNIRGIQDYGRVNMSVDGMRQNYQQSGHQQRNGTLYVDPELLSEVVIDKGASSAMGGAGVIGGIANFRTLEARDLVRPGKQVGGRVRLTSGLGGDANGTHFIGSAAFAIGTEVWDMLVAASERHLGDYDPGTKGSIGELRTGAWFNPEAGQRVKHSPVAYSGYVMRSRLAKLGVALPQDQRLQFSYLTTQVSYDDANMLNTENQALWEKLGSSDVRAQNFAIDYGYAPDNPLVDFKAKLYYVDNRNRQQTLQRGITPGYSITYQTDTYGAQAQNTSTFALDDLSTLRANYGLEFFYDKVRPDSSQPRASTSAVGFPAAEGMTPKGDRALGSLFARLDYDYDDWLNLNAGLRYDRYRLRGDTGFNARTFILGTTRQTDMPLQYAVDREEGRFSPTFGLSVKPGVDWLQLFATYGKGWRPPAVTESLITGRPHGGGAENMYPNPFLSPERSKAWEVGFNVLKENLWFSDDRLGLKVAYFDTRVDDFIFMGMGMQPPGYGMAGIGNSAYVNNLDSTRFRGVEYQLDYDAGLAYGQLSYTHMIGSNDFCSKTAWLGGVTQTVKGSGRRPPVIDMRPDEQANAATHCSAVLGSAEHMPMDRGSLTLGMRFFDRRLDVGARARYSEGYSVAGGATVSQAGVYPADWKEYTVYDLYGSYRVSDELTLRLAMENVTDRAYLVPLGDVLAFTLGRGRTLQGTLEYQF

SEQ ID NO: 13891 - protein, 584 aa, Pseudomonas aeruginosa [sequence omitted]

SEQ ID NO: 13892 - protein, 416 aa, Pseudomonas aeruginosa
MNNNKKCAFFLLPILAGDSVPALAEGFLEDSRASLALRNFYMNRDFRDGVGRAKSEEWAQGFLFDYRSGYTEGTLGVGLDLLGKLGVRLDSGAGRSGTGLLPLRDDGSAAGDYARLDATAKLRLSRSELKVGGLVPKLPTIQPNYGRLFPQVFQGALLTSGELSGLSLNLGRLTEVSQRNEAGTSDLALFNRNRRFAGAAQADRFDLAGLDYRIAPDWTGSYHYGELEQVYAQHFLGLKGRIGVAADSLESDLRLALSRDTGGARGGRIDNRSFSGSLTYRLRNGQAFGLGYQRMSGDHGFPYLEGTDPYLVNFGQYNDFAEAGESSWQLRYDCDFAPLGVPGLSLMTRYFSGHGAKPKGADGSREWERDSDLRYVLQGGALKGLGLVWRNATYRSAFSRDIDENRLYLTYELPLF

SEQ ID NO: 13893 - protein, 927 aa, Pseudomonas aeruginosa
MFPRSLLCSLILSACVQSIIYSEDIKIPEEISKLLSALDFPLTRVNQDDFEKNYGLLHNAAQNIVIANDKQPKMFICKLNTTDGGVINCRSCSLINNTQPIFFGDNKSTLCGGAIYSAESVILSKNSRIIFYQNTTLNQTNSSSGTGGAIQAKNFEASLNKETLFSSNLTKVKGGAIASTEMCRFFNNSASIHFDNNRTTNADSFGGAISAVSCEFARNRGKITFSENKSGKGGAICSTTSTRIVDNQAPITFSHNVASNTSNQGNGGAINSPTIVIENNKQPVLFSGNSSAHAGGALSYQHLTIQNNGPVYFLNNTSCWGAACYGQTNNGTTTISADYGDVIFDNNIAIDRMGVWRSAMHFSSNHSLSLGASSNQHIYLFDRMNTGGLSSFIINPEDKHTGAVVFSAASTQLKLANQSIKNLQISYKGELTIKHGIVSVEDGAILWLYKFTPEDNTHLCLGSRAIMQTQENSSSQKDSNLQLKNVAILLTDILKPDSSPPTVWIYPGGSGGNYTENTDARISISGSLSLWNKNYSDPYDSVDLSQPIDRIPLLHLSEPANNSVTIDDFDVQAINAHKHYGHQGIWTPYWEEVSSPSITSSLETTNSKHRYLYANWTPTGYVVNPQHRGDLVANTLRQTARNAMAFYPALINDSTSFYLEGNGLASHTRQRNQNEILGFSSRSLGYGGECLFSSKTQHKFLLTFSQLIGKIKEHTSNNKVSSHSYLLGATLQTPQFNDYLITTASLGYGYGDHHMQSFYAQNKTSETQFSDHVLSARIGCYTKLPLLNHHVTPFIQLAGVRAKQTQINETGDFSRKFSNQHPLVSLTLPVGILASWHADSYVPSVWEFELAYQPLVYEQKPKVLITLLASNGSWISSGTAVARHNLHVEGRNSAYLFHNIVAFLNYHLDLSSSTTSHYINAGSRVVF

SEQ ID NO: 13894 - protein, 434 aa, Pseudomonas aeruginosa
MKTLRTLPALLCAGFLGLSAQAAEDSRSGPLAGFGERLQRHGVKTHAQFWSLSLKNLDTGPRQHSFGNSGDLFLGADLDLATLAGLDGASLHIEETLFILDRGTGQPTGPSWQGAVGSYFGGAPLHNDIGANQLSLLTWQQQWLGGRLDSHLGRTNARRYFLIYNCETVVTCNDPIIDASTGILPPPYGAWGGYLKYRATPTLYLHAGAFESNPVDYLKKRHGLDFGTDDASGTSLLLGIGDKREESLDPYRSHYELNAYLNTANQVDPLTGASDHGSAGGFFKFQQLFWRADGGRLDSPRALGLFGSLSVSADDKQPFRHFAELGLTYHAPFDRTRDKLNLKASYLRLNDHQLEFQRQARIAAGGDAKLGQRDVYALETNAHIALTPHIALEPSVQYIFNPDNYYNPGARELSGDGFVVGLQLMVDMGSLLGL

SEQ ID NO: 13895 - protein, 155 aa, Pseudomonas aeruginosa
MISVVLIASEDLPGLAAQMAMLVPAAVDGLVKEVVLVAGDEPGVAVLAEDSGARLVRVEGDTADRLAAGAAAARGDWILTLRAAPVLREGWREPVERHLAGGAGGAASLVAPSGLLGRLASKMHGVLLRRLDWPAAGALDEKALAKALKAKAIRY

SEQ ID NO: 13896 - protein, 802 aa, Pseudomonas aeruginosa
MKHVVSSALLLGLSSLSLAAQAAPIALDLPAQPLAASLEQLQGASGLRIRFDRAAVADRRAPALRGTLEPSEALQRLLAGSGLSGEVRGGDAWVEAAATGAGIAPGDSVDLGALSVVATQDPATAAITEDSGSYTTRAMRTSTKLAMSIRETPQSVSVVTRQRMDDQGMRDLNDAVKGVTGLTVQQYGPARVKYAARGFDVDNIMYDGLPTSISTYTQDVISAADLAMFDRVEVVRGATGLMQGAGNPAAAINMVRKRPTQEFRASLQGSVGTWDRYRSEADVSGPLNSEGTLRGRAVVAYQKGNSFQDHVSSERGVFYGIAEADLSPDTTFAIGASNQNDNRNDNWVGLPSPLGGRHLDLKRSSYYGADWSYWDTDTTHLFSDLTHRFANGWQMKLAADKLWARINMLGLYNDCYYSTTGCASMTQNPGDYSYTDDHDSYDAYANGPFQLLGREHELVVGASYRQERFDGHGGWGSLFNKDGTPTGPMDPTQWDPSSTLKPRLNTSLWGMKLDQEQKGAYLTTRLNLADPLKVILGGRLDWYKADADTDSYKVTRNVTRYAGVIYDLNQTYSVYASYTDIFKPQSNFDAGGGLLDPITGKNYEIGLKGEHFGGALNSQIALFQIDQENRATEDVGGPSPCPFSPTSRYCSRASGKVRSQGVDLELSGALSDDWQMMAGYTYVDAKYKHDSNKANEGKPFDAAKPRHLFKLATSYTLPGELHKWRVGGDLATQSKTEDSSTGFQQGGYTVVNAMLGYKVNERIDTRLNFNNLFDKYYYSGIDFGNLNYGEPRNLMFTVKYSL

SEQ ID NO: 13897 - protein, 431 aa, Pseudomonas aeruginosa
MSAPFSPPSSRTLRGLGALALCGGFVTPASAAFLEDSSARLEARTVYFNRDFRDGSSSSPQGAAKREEAAQGFILDLRSGYTEGALGFGVDTLAMLGIKLDSSPADSNSGLLPSSGHDPRRSVDQYAKAGVAGKMRFSQTQFRYGAMLPDMPLLKYNDGRLLPTLFHGAQLTSEEIAGLRLSATRLERYTARDSSDAQDIRVHCKNKRYACDITGSRFDAYQLDYQVNDGLLLQYAQGGLRNVYRQRYLGAVGKRQLGAGKLSADLRWFDSEDAGAARAGRIDNRALSLLLAYAQGGHTLSAGWQRMNGASSMPYLDGSNPYLANYLQVNDFANPEERSWQLRYDFDLRSVGVPGLSFMTRYVNGDHIRLANGDEGKEWERDVELKYVVQSGRFKDLSLRLRNATYRTDFERSARDVDEVRLIASYNLSLF

SEQ ID NO: 13898 - protein, 802 aa, Pseudomonas aeruginosa
MPRPTFRPGLLALAIALAVPAPFLHAAPAEQASVRDYRIAAGPLAGTLNRIAAQAGLVLTLDPALAEGRSAHAVQGRFDAPGALREALKGSGLELVENAGGTYSLRKVPEDTLSLQAMTVSGAEEDPLGPTSGYVAKRSMTGTKTDTPILETPRSISVATRQQMTDRAVHNLDDAVRYMPGVVASSFGSDTRSDWLKVRGFKPTQFLDGLPMAVGVYNNPKLETWNLERVALLRGPASSVYGQTPPGGMLDMVSLRPQNVASHEVKAEVGNYNHKQVSFDSTGPLDDEGRFLYRVSGVVRDSNTQVDHIDDKRYNIAPSLTWNIDDDTRLTFLGQFNRDDTGITSQFLPLRGTKYDAPFGKVSHHKNLGDPDWEYYDRTYYWLGYAFERRINDVWQFRQNLRYLRNDLSFQALTPASYYAAASDDGTLQRTSTSVDEDVSQFVVDNNFQADFDTGALRHTLLLGLDHNRTTNEYTSIFGFNVPPTNINNPIYGQPIPKPPRSDAYYDYKQKTYQTGLYVQDQIALDNWRLTLGGREDWVHTGATFYNKGDATNTSRDKKFSGNAALSYIFDNGVAPYISYAESFQPTTGADMNSTSSLKPTEGKQWEIGVKYQPVGSDSLFTAAVYDLRQENVSVSQNIGGTPVTSQTGEVKVSGIELEATSNVTDNLKMIGAYSYTDTEVKKGQYAGNRLQQAPRNQASLWADYTWHEGALNGFSVGAGARYVGSTYGDQANTYDGYAGSYTLYDAAVRYDLGQLNGSLKGVSVAVNANNLFNKDYLASCDGYYCYYGDQRSVVGSVSYKW

SEQ ID NO: 13899 - protein, 730 aa, Pseudomonas aeruginosa
MKKHSTARRVLALGLNLTLAGVPALLWADEEPTELPALTVSAGAGGETPPALDLDDSAGGGSRLGLSLRETPGSVSVANRASFERRGLRSTQDIANSLPGVNASAPPGFGGFVTYRGFSSNQVNQLFNGIPVQYSSAMRPLDDWIVDRVELVGGPSSFLNGAGAVGGSLDYISKLADRYGDFMEGRVRYGSYDDSEVAFGFNQALGIGPEPKHFVRLDVSRSGGNGYVDRNSRESWNVAFSLLSDLTPDLSHTLALEYQDEQEDSPYWGTPVLNPYAGELKIDKSRRRENYNVADGRYEQRVRWLRSILEYRVSDSTRWRNTFYHYDAERDYRNLETYRYNADNSGVVRSNAFLQRHDQQLNGNRFELQHSQPLFGLASDWALGFDYSINKQTRFPSTASGPFGTVDPASFEPGHFYDLPGMRPGHRKDRSNEVRTSALFAENRLGLTDELSLVTGLRYDHLDLDVRNHRTVTASDPAHFERRWDVVTGRAGLVYQFTPHANVYLQYSTAADPPGGVLTSASFGQVRDYDLSTGDQWELGSKFDFLDGRGSATLAAYRIVRRDFSVADPNNPNLSVPVGQQTSRGIEAAASLRITPKLLAEGNFAWVDAQYDEFTENVGGVAVSRKGKTPPNVPERVGNLWLTYDFDPAWQGGVDARYVSSVYANNANTWHVPSYTVYGTFLSYRLDERTRITGRVRNLTDEVYARFVQSTPLYYVGDPRTFELSVQTRF

SEQ ID NO: 13900 - protein, 1160 aa, Pseudomonas aeruginosa
MFKNMQKGSKQYPSIQFIMKCSFIFIVAQLTFMSMLFASDVKSQDLDQKINLRLENVTVADALMTISRQSNVRFSLREQSVKAVKKNVTLVSPQISIKQAIDHILANTNLQYKIVEGYLVVDSKPVPIIVNGTVYDDATKETLIGVSVKIKGAAVAASTDVNGKFRISIPEEGATLVVSYMGYVTREFKVTAANSKDLSIHLKASSTQLSEVSVQARRRTNTEVAVLDERKKSAIVQDAISAAQIERTASITTTQALQRVSGVTITDDKYVAIRGLGDRSVVGQLNGVRLASSDPDRSSIPFDLVPASLLDNVTIYKTVTPDKPADAAAGIVELKTKSVPDSMVFNVVMQSGFNSNIGIGGQHNSFYNSDMGFLGTKINDKNLSQDFLNLGTQYKGGLNEIQNMISNSGYSPAVKQEVTRINNIMQGFDPILTTKYKQSPLNQLYSATFGNSYTVFKKHKLGVVAGGNYYRRTTDISGGDIQQYSIYQGVVTGNPQVSSPRNIPNYITPNNLYMGRYQTYKENTGTETLNYGTLLGLTYRFDSRNEISMQYLGSWGGETQATNMYGGYEYTGLPGDVNSTIYSLKQSYRNLNTFNLQGEHKFLSTIYSPKLSYNVSSSKAGQNDPDYRFVTLADYMPRSGGAVGTPTTGVNNGTQYGYSDHLYALSSGYVNGFGAYGIIQAEPNGRRYRNLDETNYNYKADLSIPFKLFGQMQEFKTGVNYLNRDREFTENVLFLPGSNFSSNKSLPLYTVNGNLDRLVSNEIIGIRPQSVGIGEGGSPIGGFLYNSQKSPNNYTGFFETKAGYAMLDLKVNKDLRLTGGLRFESTNIQSAVDTAGVFLDPALTAPGTNIPLTLMSPNSVYKPGYKPYYSLNATYNLKDKMNFRAGFNTTLARPELREITNVFEFDAFQMGLVVGNPNLVNQYTQNLDFRWEWFPNNGEVIAVSVFGKRIENQLYKVFSLKTSGLAATYPEYPTIRFENDPNIGKVWGVEFELVKDLGRVWDPMRNFFIGTNLLLAQSDIKKSPERLEANRSLDRHTPDNSPLFEQAPFSINGWLNYDNKKIGTSLTGTFNMVGERLIQINLTGEPDLYTRPVPMLDFVFSQRLTKRVLFKGYAKNILNPAIETVYANPGTGGTWYGNKYLNRSYHRGGEFMMGFTYNLY

SEQ ID NO: 13901 - protein, 460 aa, Pseudomonas aeruginosa
MKSRKINKSRLALAITAGTLGALAQQAVAAGFIEDSKASLTLRNFYINTDNRNGSASPSKQEEWGQGFILNYQSGFTQGTVGFGVDALGLLGVRLDGGGRAGKNGLDRQPGTVFPLESDGEPVHDFASLGLTAKAKVSNTEFRYGTLQPKLPVVTYNDGRLLPVTFEGGQVTSTDLKDFTLVAGQLEHSKGRNSTDNRSLSIAGANGSSASSRDSNKFYYAGGDYKVNKDLTLQYYYGNLDDFYKQHFLGLIHNWQIGPGVLKTDLRAFDSSSDGKNGSRSGRADGYVSSGYYGSGVTKGEVDNRAFSGLFTYTVSGHSIGAGYQILNGDSDFPFLNRGDGEGSTAYLITDVQIGKFQRAGERTWQVRYGYDFATVGVPGLTFNTIYLSGDKIKTARGDQSEWERDISLAYVIPDGTFKGLGFTWKNASFRSGLPAAGSSNNQRDQDENRLIVSYTLPLL

SEQ ID NO: 13902 - protein, 421 aa, Pseudomonas aeruginosa
MSHPSHVRALCASLCLGAGLPVHAGHVHAGQGFLEDAKASLTARNFHLHRNFVGDASQGKAEEWTQSFILDARSGFTQGSVGFGLDVLGLYSLKLDGGKGTAGTQLLPIHDDGRPADDFGRLAVAGKLRVSNSELKIGEWMPVLPILRSDDGRSLPQTFRGGQLSANEIAGLTLYAGQFRGNSPRNDASMQDMSLFGRPAATSDRFDFAGGEYRFNGERSLLGLWNAELKDIYRQQYLQLQHSQPLGDWLLGANLGGFRGRDAGSARAGKLDNRTVSALFSARYGLHTLYLGLQKVSGDDGWMRVNGTSGGTLANDSYNASYDNPGERSWQLRYDFDFVGLGLPGLTFMTRYLHGDHVRLAGVTDDGSEWGRESELGYTLQSGAFKRLNVRWRNSSQRRDWGSNTRFDENRLIVSYPLSLL

SEQ ID NO: 13903 - protein, 928 aa, Pseudomonas aeruginosa
MKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNYVYEGDNILDGLVFKPRIPYGLRYSHVKFFDERHHKRRLGFTYKYKPENNRWLDSIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRDPRSIETVSLCNNTRGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFAAPGRNFSLAFEMKF

SEQ ID NO: 13904 - protein, 452 aa, Pseudomonas aeruginosa
MQNLRRAVFAGLVAGTLSEGAAATAGDGGFVEDSELQFLARTYYFNRDYRDSPNNAGRNRFKPRSERNGYREEATQGLRLQFASGYTPGSLGFGLDAHAMLGLQLDSGGGRTGTGNLPVGADGHPDHRYGKVGGALRLRHGETRLKYGQTTTSAPVFAASSNRTLAGMAYGLLLEDSSFDGLLLEGGRFTAASGPGESKVRGDISTVYGRLGAYPVRLDAVGFLGGQWQATERLQLSLYASRFDDIWQQAYFGASHRQPLGGERALRVDLDAYRTRDSGQSRFGRIDTLASSLALGYEQGPQRITLAYQRVHGEQPFDYMAFGDGRSSASMVLANSVGYSDFNGPGERSWQLRYDLDLGALGLPGLSLHALHARGRAGASASSAAESIYAGLYGRDGRHRESDLGFAYRVKAGPLAGLALRASQAWHRGNASYLDGDIDETRLVVDYSRSIW

SEQ ID NO: 13905 - protein, 444 aa, Pseudomonas aeruginosa
MRNLFALTPLALALFSAPGAWADEGEAEEGFIEGSSLQLLTRNYYFNHDRRHASGHDSKEWAQGFIATFQSGYTPGVVGFGVDAYGMLGLKLDGGGGTGGTSILPITAPSKEGYESGKAPDEFSSGGAALKIRAFDTELKLGDQFLGNPVVAGGESRMLPQTFRGVSLTNNSFEDLTLTAGQVSFTKYYNQSGHRRLGSYYGELPGDRDSHHLSWLGGTWGGIEGFTSSLYAAELQNVWKQYYADVDYTYEIDEDWSLNPGAHYYKTVDSGDSLLGRIDNNTYSLHFAVGYRQHTVTAVLQKVNGNTPFDYINQGDSIFLDNSQQYSDFNGPNEKSWKLQYDYDFVALGMPGLTASASYSRGKLDLTRVDPDSPGYGGWYSADGNNAKHWERDLDLQYVVQGGPAKDLSLRLRWATHRGTGGYSAVDNDIDEYRVIVDYPVDVF

SEQ ID NO: 13906 - protein, 795 aa, Pseudomonas aeruginosa
MTPFPRFALRTLPALFLSLGCLAATAQAAEAVRYRFSQAAAPLAQALNAFSRASGQTLLYTAELPPQATAPALHGSLDAEEALQRLLQGSGLRARRIDERTLTLEPIPASGALDLDATTVSAAAPAQGYRPAANASISRGDAPLLDIPQAISVVPAQALQDQRPRNLDDALGNISGITQANTLGGTQDAVMKRGFGDNRDGSIMRDGMPSVQGRNFTATADHVEVLKGPASLLYGIQDPGGVVNVVSKKPQLQQANALTLRGSAYAHGRNGSGGQLDSTGPLGDSGLAYRMILDHEDEDYWRDFGKSRETLVAPSLAWYGEDTTVNLSYEHREFTTPFDRGTAIDPRTNRPLDIPRSRRLDEPFNITEGRSELTRLDLERQLDDTWKAHFGYGYSRETYDDNQARVMAVNADGTLTRRMDGTHGAVSSDSFATLDLSGTLQLAGMQHDLQFGMDHEKRKIFRADLLRDSKTSRFDYLDPVYGQVVPSTRVVAGDSDQTDKLRSDSLYFQDSIHLDERWILVGGARYQIYDQLAGRGRPFNANTDINGQKWVPRGGLVYRLSDEVSLYGSYTRSFKPNSTIAPLSTGETIDSAILPEEATSWELGAKLDVPGRLSGTLALFDIRKKNVLVNELDGAGNSSVRAAGRVRSRGLELDLTGQLSERWSLIGSYAWLAAEVTEDPTLEGKRLQNVARNTASLSAVYELGQLFGGDRLRLGGGARYVGKRPGDPANSFDLPSYTVADAFASYDTRFGGHGVKFQLNVKNLFDRTYYPSSANRLYVAMGEPRQFQVSTTVEF

SEQ ID NO: 13907 - protein, 276 aa, Pseudomonas aeruginosa
MRKALCTALGVAALTPLAAHAQSAGSNVVTLGWFHVMPQQSSTPLTTNVAPTPINTPLRLPPSFTSAGTGLSTSGADTVGLTVSHFLTDHIAVTSVAGVPPVFKVSGHGTITPPGPAGALGTQNIGLAQVNPIVKSVRQWSPAVVFQYYFAQATAKFRPFVGIGVSYNWFSDLQLNTNFIKQTQDNLGAILAAGAGKPGVTQVSAKASSSWQPVFNAGLSYNITDHWGLVASVTYIPLKTTSTVTIKAADGTTLAESKSDLKADPIISYVAVSYKF

SEQ ID NO: 13908 - protein, 697 aa, Leptospira borgpetersenii serovar Hardjo-bovis
MFFSILRFKSIQILFPIFFCISIQAQDESTKIGNKVVEKESPNKIITKNNNTTTESLRKENGQNIPEESQIVVTGSRGERRLKDSTVATEVISRKKIEASGARNAAEVLETQLGIDVVPFFGGSRVRMLGLDSQYVLILIDGERIAGRLNNAVDLSRFKVQNLERIEIVKGASSALYGADAIGGVINLITREADKKLSYEMRTTYGNGSRKNFNTEGEFNTNANMGFRNEFVSGSVSSGYNKNPGYRLVPNSQATTGNAYQDLNTGINLTFNPDGNFKGKTRILYQHRNQNGVDVTQSKAIFDRNNKTHDFLATGSLEYGFGKRNLISFRGNISKWENKYYNNQRGSDELDVKQLNAELTSQGTVQLDMEASERHFITIGAESFANELESDRLQSRYVYRTRKAVFFQDEWTISSSPRIRMIPGVRYDDDSQFGNQTTPKLAVRYDIFQNLVWRASYGRGFRPPSFQELYLRFENPAVGYVVEGNPNLKPERSITINSDLEYNPFSFLTLSLSLYRNDIINLIQYKFDSNKGKEFAEFQLQNIAKAYTRGGEFGVQYRFLKYFTLELGYNHTDTRDLNTDRPLEGRALHQASANFIYNSPGGFQFNLRGKHLDKRPFYSATNNLAGQDSIPTEVKLNENPPVIYGKPFSILNVRIEQKFFNKHFSLFLGVDNVLNQYELTYNPTRPRFYYGGFSAQF

SEQ ID NO: 13909 - protein, 713 aa, Leptospira borgpetersenii serovar Hardjo-bovis
MKIIKRQHMYWCSLPLLVMGPIAQAADSQTATKNSEEKTKIVVIGQQREADTQSYQPTSSVTGTRTETNLLNVPQAVNVVPRQVLRDQAARNIDEALYNVSGITQSNTLGGTQDAVMKRGFGDNRDGSILRDGVRSAQARNFTPTTERVEVLKGPASMLYGMGEPGGVINMITKKPQLVQQTHIEGWGSSFKGGGGQLDVTGPLGQSGFAYRMIVDHDETDYWRNFGRNRQTVVAPAVMWFGDTTTVRVAYEHMEYLTPFDRGTIIDSRTGKPVNTPRDRRFDEAYNATRGDQDNITLQIDQVLNDNWKSSLTYAYNRNRYSDNQARALLLDPITGVLSRQADATASAVSRAQAVQMTLNGDLDLGGMGHQMLFGFDYEDSRTYRGDMIRGKKNSNFNIYDPVYGLMPPSTAVSAKDSDQRENLKSYGWFMQDSIELTDKWIVLAGLRYDRFDVFAGKGRPFITNTDSSDSKLVPRAGVVYKLTPEVSLYGSYSESFKPNSSIATQIDSLPPEQGQSWEVGSKVELVNGVTGTLALFDIAKRNVMVNELVNGETITRTAGRVRSQGVELDIAGQLTDNLSAIATYAYTDARVTEDPDNKGNQMTNVARNSASVFLTQALGSTGWQGGDDLRIGAGARYVGRRAGDAANSFTLDDYTVADAFISYSLPISNYRVKWQLNVKNFLDKTYYPSSGGNLRVAVGEPRQFVLRASVDF

SEQ ID NO: 13910 - protein, 686 aa, Leptospira borgpetersenii serovar Hardjo-bovis
MEQKMFKKKLLVAAILCTPIMSPVNAAVDAQPMRSIEVIKVVGEKTERSLKDTTSSVSVIDEDKLASGQYLSVSNALSEVPNLVTLTGSVPDIRGISGNGSATGFNSFTGGAKARVSTLVDGVAEPFVADMTGDSGLWDIEQVEVFRGPQSTINGRNSIGGTIFVKTKDPTFDWNGAVRGGYRNQQDYIDSAVMLSGPIFEDQLAFRISGQNLTGNTFNKGEVYAGNPAHFDLNELISRRWRGKLLWQPTGADNFTLLYSFTYNDEKGDTGRNYFSGDNPWAYKPLFQRYIETESNTHSVKIDYRLNDDYSFDLLAAYIDYDWGFEGYESVAAAEQQVIMQDKSYTLDGKFNFGLQNPEFNGFVGLSYYKREQDFSSSGGVTYVGDDSSSSHSIYGEVSYALTEQWKIIAGGRVEKEQQIRNFAMSTRGRVVADKLDDDHNIALPKLVLQYALNQDTTLAVSARSGYNAGGGALSFADNAYYYYEKETVDTFELSSRSSFDDGNINISSNVFYNNFDGYQASNNERKITNIDEAVTYGLELEAGVMLNDDWQLNSGLGLLKSEIKAASPSYGDIIGNELNSAPKITANIGLKYWVNDELTLGLSGNYVGEYYADINNTTERVAGDYVVSRLNLDYQNDQWRVSGFVNNLFDEQALTVNEPANRSYPQGYAAIIEPRAFGVSVTYSF

SEQ ID NO: 13911 - protein, 310 aa, Leptospira borgpetersenii serovar Hardjo-bovis
MRLFHSRKGFSNSGIHMKKTLLAAGAVLALSSSFTVNAAENDKPQYLSDWWHQSVNVVGSYHTRFGPQLRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNVYAKYQWQNYGAANENEWDGYRFKVKYFVPITDLWGGQLSYIGFTNFDWGSDLGDDSGYANNGIKTRTNNSIASSHILALNYDHWHYSVVARYWHNGGQWNDDAELNFGNGNFNVRSTGWGGYLVVGYNF

SEQ ID NO: 13912 - protein, 485 aa, Leptospira borgpetersenii serovar Hardjo-bovis
MKRKITFQKFKSYKVLHMQKTKIAFRFYFKILFFICIGSISVNSLFGVGVFQPSHNARYAGMAGVNLAIGGSPMDIATNPANLVLNSKGGLEFGIGLPYIRSQYKDRLSDTNPETEYHNSQNYNILAPLPYFGLTLPLTDRLSYGVGIYVPGGGSGQVNGILRLTPNAQSLRDWSGVDIPGPIGDSKKIKEDLSTTFYVVKATNALAYRFGNLSVGMGIEMIYSKQIANQKFYDITHTLEIPGQGFDYRSKNAYSMGGIFGFSYAFTELFRIAYSYQTRSILPLDGGMQIGIGDVNNYRRTGVSATFNLPEKHGLGFSFGNESLKIGLDFLYYNYNSYDQTFKQRLEDPWFPTFLGKTNTITQNIAYHDAWAGAIGIEYKLDSFVYRGGYRYNTGVVRSEGISALQAGIMVQQLATLGLSFLSGKWSFDLAINYLFAKKVTADPGNNWAVLHSAFGPNDIRILNYSQSLQSDVPVILFGASYKFD

SEQ ID NO: 13913 - protein, 310 aa, Leptospira borgpetersenii serovar Hardjo-bovis
MRYDHINNIGQKNLAPQYNDISAGHNYSQKNYNGWSYYLGLNYDVNHYLSLFTNFSRTWRAPVIDEQYETQYSKASVSATSLNLEKEMINQTRVGGIITLNHLFQENDAFQFRTTYFYNRGKNEIFKTRGVNCVGNAADTNYVCPKPIGNYRNLPGYVIQGAELEAYYQSTYLFGEITYSYVKGKRDTSPRNPWGKTLTWIAEIPPRKATATLGFNIPKYNFTAGWRAEFVRRQDRSPLSGDPEAKYWSLPASRGYSLHNLFLSWSPAKIKGMNVKITVDNLFNRAYNPYLGELASGTGRNIKFSLSQKF

SEQ ID NO: 13914 - protein, 777 aa, Leptospira borgpetersenii serovar Hardjo-bovis
MKEQVHLYFRIFIVSIFFSPVSVFALDVALIGFIKNKNGKPISNARVLIQESRKSAVTNENGEFVLDHVPPGKYVLTASARGYQSETLSVTIGEKDQKTQFILLESSLDGSAINVTAKSTISDFLTSPQPITVLSGRQLDRQRGETAMSAINNTPGVSNLTTGAGTSKPIVRGLTGQRVLVMTDGIRQEEQQFGDDHTVELDSFNIQKIEIIRGPGSLLYGSDALAGVVNVIRDKAPRSGEGVPQMAGLFNSNSYSNNKQDAGNFAIYGNVDGFGYHASANTRKAGKITTPNGTMPNTGMIEKNQNASIGLDGKWGNFYLDSFRREQTQDLLDNPNENPGSTVHQKLLHEKSHFHSFLIFPAGNLELDFSYQRNNRREIESKNKLFPIKDVLRDENVDIFDKSFQFYQATSKAKYQGLNLLLDTTTADAKFHHKPIFNLLQGTLGVSGLEQRNRTIGTEPLIPSYGIVNIAGYFLEELKLGSLTLSAGVRGDKRSADIKNNMTLGIAEQTKNYYATTNSTGLVWRIDKSFSAILNYGRGFRAPTPFELFSNGVHEGTGKFEIGKDSFKPEYANNLDFSVRYASSRIQMEVNVFQNQIQNFIYAASIAEIDPNSGLPKYKYKQGNAVLKGGEFSIQAELTNKLVFSGGIDIVYARNQNDTNPLPRTTPNRARAGLRWTEGSILGLKDFYFSINGRFYDSQYRVDPKETPTKGYNLTDIGLGFELPYLGDGTSRPSVDLNVQNVFNVSYVDHLSRYKDYALNPGVNVILKISFPFTVVP

SEQ ID NO: 13915 - protein, 940 aa, Leptospira borgpetersenii serovar Hardjo-bovis
MFFSHTTPHISQSITLANAQPLKVTMGEDTQTLDEVVVTALGIKREQKALSYNVQQVKGEALTAVKDANFINSLAGKVAGVQISSGATGAGGATRVVMRGMKSLTKNNNALYVIDGVPMFNTGSSGGDGQYGSMGGSDAVADLNPDDIESISMMTGPSAAALYGSAAANGVVLVNTKKGKKEKISLTVSNSTTFSKAYIMPEMQNRYGTSSGLFSWGDLTDKRYDPKDFFNTGSNIINSITLSTGSDKNQTYFSASTTNSDGILPNNSYNRYNFTARNTTNFLNDKLTLDIGAQYIIQNNTNMVSQGQYYNPLPALYLFPRGDNFDEIRLYERYDTNYGFMKQYWPYGDGGLSLQNPYWTQNRIRRTSDKKRYMLNASLKWKVTDWLNITGRVNLDNSDYRNKTEKYASTLATFCSVNGGFEDAMRQERSLYTDLMATVDKTFGDFRLNTNIGMSLYHTSMQTIGFAGDLIIPNFFALNNINYAANYKPLPDGYDDEVQSIFANVELGWRSQLYLTLTGRNDWDSKLAFSNQSSYFYPSVGLSAVLTEMFTLPKIISYAKVRGSYTVVASSFDRYLTNPGYEYNSQTHNWANPTVYPMDNLKPEKTKSWEIGLNLKFWENRFNLDATYYRSNTLNQTFKVDIPSSSGYNKAIVQTGNVQNQGIELALGFTDEWAGFRWASNATFTLNRNKVKRLAGGSTNPVTGELIDMPNMPVGWLGKENVAPRVILTEGGTMTDIYVYNELTKDNNGNIKVDAQTGGLSMHTAETPTKVGNLNANYNLGWTNNFTYKGINLGVVLSARVGGLAYSATQGVLDYYGVSSITANARDNKGVPMNNGKVDTQKYYQTIGTGEGGYGRYYLYSATNVRLQELSLSYTLPKKWLNNVANVTFGLVGRNLWMIYCKAPFDPELSASTSSNYYMNVDYFMQPSMRNIGFNVKVQF

SEQ ID NO: 13916 - protein, 867 aa, Leptospira borgpetersenii serovar Hardjo-bovis
MKIIKTILVILRAVSIERFVTLKKRISFLFLIFLTVPTMEVFAEVSFRARVYSRSKNSGEANVRVLLFETKKFYQTDVEGYFQAVAPSSGVYTFRILKDTGAQEIRKEIGEGEELVILDSDQSTKSGGGGSKGSINVTGEREKQLMSRTKLRFEEIKRMPGTFGEPLRSIETIPGVVPVSAFGGGASNYSFRGADPTTNLYLYDDLPILYPFHFDGLTGTLNGNLIKSMDVYTGVLPANFNNALGGVIEIESPDKVERSSGNFLSSLWAASANYQTTFANGKGYILGAVKVGYMDKTFETIGTITGVSSLPDGVRLPHYTDSQVKMVYNFNDQHQISFYSLTAKDDTAFNPPVKRYNDPTKDQFAEYSGGNLSVGQGYRTQALRYIWRPSEKFVNRITLISYDPFVDYNVLFGSLKAKQKASGAYNGIRQDAYWDPNKHLTLEFGSEMRFLNYRTSGNTIQQTDPNNPDPNPYDTVTPDFKTVSDTNRVQSKYYNAYTTMKIKFGGLLIEPGARYDYIPYIKNGALGPKAQMSYKFEEGPLKGITVFGGAGNHFNFPLDTRFSEQSGNPHLKFQKAFKYGGGVEHELTSNWQAKGEVFKQEFSNLIVTDPYITEIIGTNPDQYGKVFQPYILNKPLNYSNNGTGHSQGYELLIRKIATPGKRDDWFGWISYTWSQTFRNPNIYKPDGMIAPVATGPEQRLLAQSYHNSKETLYDYDRTHIINVVFGWKFSQNWQLGGRWSYLTSMPITPIVGDDGGRFSNPANNQTIWAPVSANNPYLADYVNTKRLADYHRFDIRIDKFLNYEWGYVNTFFEIINVYMRQNVSGETFNVTRPYSSTNPKPSPTFGTITLSGGVVIPFFNIGIEVKF

SEQ ID NO: 13917 - protein, 1038 aa, Leptospira borgpetersenii serovar Hardjo-bovis
MKEQLLSNFQKGSVMLFLYFCLWVSAAHAQSPRISGKVTDAADGGPLPGVSIKVKGSQKGGITDVNGAFTIEAAKGAVLIFSYIGYTPKEVTVAEQASINVSLSAQNDQLSEVVVIGYGTRQKKDLTGSVASLSSAQVKDLPVASVEQKMIGQLAGVQISSPTGAPGGGTTMKIRGSGSIGAGDGPLYVIDGFAITNTAGQDYNPLNTLSPDNIESVNVLKDASSTAIYGSRGANGVVMITTKKGKKGPPVVTVNSYIGSQVIPQKGRPQVLNGAEYAQFQKEIREDAARYQGRIPTDADIPEAYRNPAQYGEGTNWYDAVLQTAMQNNIDASVRGGSENTRYSFSLGRLSQEGTIRYTDYERYSIQANFESDLSKKIKVGMSLSPTASTQVRNSFETGQRDILTRTLWLSPIVPITDANGNRTVFITSPGAIGAGNPLNTLEFASTKAKYFRGLATGFAEYQPIEGLKVKYSLNVDYVNNNNFVFRPNFVIGETGNQNPNLSIPNSSTAYSGSTNWLSELTATYDKQLGKDHHINALIGYTAQEERGEGYNFNATNYGDNLVETINAATLLNGQGAGIDKWSLLSYLGRIDYAYKGRYLFTGTLRTDGSSRFGSAKRYGLFPSAAFAWRVSEEAFLKDSKWLSDLKFRTSFGRAGNFNIGNYRYAASITSANYSFGGQLANGRAAGSIANDELTWEKSDSFDIGFDLGILNNRISFTADYYNRLTYAMLYDSEVPLSSGFSNALINEGEVRNTGFEFSINSENIKGAFNWNTNFNISFNRNKVVSLNYKNDPIYSGRSGEGNFTHKTEVGKPLGQFFGFVVDGVYRDQADLDSSPKHSSSIVGSAKYKDVDGNGIIEAVKDFDVIGSPQPDFIYGITNNFNYKNFDLSILLVGSQGGQLMKTANEFLTNIDGVFNVDRKVLNRWRSPENPGDGVTPTTNGGRTLYREVNSSWIEDADYLKIQNITLGYNFTQKFITESKFIKNLRMYASVQNLVTFTNYSGANPEATTANSGVLTPGRDFVSYPLPRVMTFGLNMTF

SEQ ID NO: 13918 - protein, 555 aa, Leptospira borgpetersenii serovar Hardjo-bovis
MQKEFQKREEIFNQLKSEKTDKQEVSTNEIKFHISQINLEDNERLLNEIEKENILGKYIDKDLGSTDITNLITDLTNRLIAKGYITSVTTISEDNDLSTKTLNLKIIPGKIEKIILNEDKTLDNLKKYFLVDTKAGKVLNIRDLDTTTENFNYLEANNMTMEIIPSEIQNHSIVKLKNEMKEKFTVSVLTNNYGEDRQNAIWRGGVSINIDSPLGIGDRVYFSYMTVHKKKPDRSWKRTTESLKPGEIAPIGPKGYDPRKDTLPYKRDLDLYNFRYTLKFNSYTLSLGSSRIENTSSFYTPNTVYDMETVSNTFSVNLDKVLLRNQKNKLTFGIGLKRKHNQSYIEEAILSDRVLTIGDISLNGTTTFYGGLLGASLGYERGMRALGAERDKNKGVRSPKAEFMKYTLNTNYYKPLTQKLVYRFNTNITYSNDVLYGSEKHSIGGVGSVGGYHRTGNIQGDKAMEIENELSYRVLDSEKFGKITPYLSYSYGKVRNNKNNSKYRKGYMSGAILGLRYNMKYLDLDVAYAKPLARSNYLKPKNREIYFSATLKIKF

SEQ ID NO: 13919 - protein, 805 aa, Leptospira borgpetersenii serovar Hardjo-bovis
MEQKSILSFCIFLLFLLSWGVFAQSEETQRPSLNGEEPERAAISVIGKRKVDLKRIPGSAIVVEKEFLEQTKPVDSMEVLRRVPGASIRYQDTGLILNLGFRGVNNDLGRKVLILEDGIFTSLNPYSAPEQYYTPNIDRMERIEVIKGSGAILFGPSTIGGVVNFITKRPSKEPTLSVSAQGGSYGFFSSQVSYGGTFGNTGIDISFLRKQGNGFRDHQDFRLHEFSFKSITDLNEKHILTSKFLATAQDANMTYLGLTTAQFWNHSSSNFAEQDNRKLQRYSGDIGHEWKFTDHSKLVTKVYAAYAERNWARQNYLRNTGSNFGAIPGNVIKTYDTEPFVNRPGDTVYMLDSVGHRNRSYRFVGAESRYQQDYQFFGIKNQLDAGLRYHYETADIKYLDGPPTPDYAIFGNGLDKPPTGTASSEYSLSKSGNIRDHEVNHTKSVAGFAQNSFKFYDRFSVIPGIRYESFVQNRTILRQQSLDPITGQPLPNSPSQEVDKGSKHTYHVVIPGLGLTYDLNKDVTWFAGAHKGFSPPRYQDALNNSGVVNRIDPEYSYNYETGFRGDITNYLSAQVSYFDLNYINQIIITSSTSGNDSASSAKNGGRTYSRGLETNVTFDPAKLFGASFKLPIDLIYTRADARMNQHSIDAAKITPNQSLLDFIVAQKDKNGNYVPYVSRDTATLALGFIHQKGFYSRVEYQYFSAQYHDDSNTRTIYWADLITDPLGKKVLQYLNITSNSSGETGVIPAYGLIHFSMGYKDPIKRWSLFVTGKNLADVRYISGRLPEGIQVGPFRQINVGVAFEL

SEQ ID NO: 13920 - protein, 347 aa, Neisseria meningitidis
EGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAAS

SEQ ID NO: 13921 - protein, 708 aa, Buchnera aphidicola
MKKFFFALLSIGISAQAFAKTDNVPTDSLRVHNLQTVTVYSTRTAVPLKKIPAKMELISSRNIKQSGFNNMTDILKTQSSLDVIQYPGFSSNIGIRGFKPSGKYVTVLVNGIPAGTDNISTLNTSNIEQIEILKGPFSSIYGTNAMGGVVNIITHKSKDKIHGNVSLFGGSYQTMAGSFNLGGRFEDIFSFDLSLGLDKQNKDYKTGSNNFLSLSKLEEAIVDVNATKNKKMKGSDYTVATGRLRFGIDFTPEWSLNLYQNVFLGDAIPVGGSIWGVYGESKKNLNRSSTSFELLGKHGCHTLQFSPYFNIEKSENYNNADPTGFINYKSDYYTYGALLQDKISFGGQNIVLGVDSRNMTMESERFEQAGVNTKPYNPGYATNNIGLFGQANFYLLNDALSISAGARADFMFFDLKANEYLNNEAKQETHNVINPNVGIKYEFVKGLTAHGTFGSAFSAPDAFQKAGQYVGPFGTTIGNPDLKPEKSMTWDFGIGYSNARCGIQADVTLTYFHTDHKDLILSSPDYANNITTYINADKARMSGIEALLSYDFGSLFANKFSLRAFANATIMLNSEMKKSQTDAPWSEMYYVRKQNITFGIEYRGKEGLEVMLNGRFMGRRIEQNWYAYYPEVRPELQQLLAAEEPELAAQGLLRHPQAMVFNASAYYHMNKYLTFRVNLNNILDELYTEKDGYHMPGRNIMGKVMVNF

SEQ ID NO: 13922 - protein, 915 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGAVPGGAVPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 13923 - protein, 211 aa, Plasmid pFKY4
MIKRTICLVYPLFCLASPTWAEESPWTYRIGMTNVAFDASAKVYLNGQRVPGGSADASDNNALTFDFGYAINDQWNVRAIVGIPPTTKVTGAGTLPGIQLGKITYAPTVLTLNYNLPALGPVRPHIGAGVNYTRIFESRDANLKSFDADHAWSPALHVGADIDVNRGWFVSIDIRKLYLKTDASGYLGPQEAKARVTLDPLLTSIAIGRQF

SEQ ID NO: 13924 - protein, 975 aa, Synechococcus sp. RS9916
MTSRTTALGQAIRYALATTATLAALPAFAQSSNAAPTTLDRIEITGSRIRQVDVETAQPVLALSRLDIERQGFSSVSDILQNVTAMGSPTISRANVLSAGEDAGGTYVNMRNLGTQRTLVLVNGKRLGISTSGFQDVSTLPVSAVERIEVLKDGASAIYGSDAMAGVINIITRTNVTGITANVYHGQYGEGDGARDRFDVVAGWSNDRFSATFAAEHSEEKGVWARDRGFSRYSNTDRHPTDGWTTNSQWGQFFGVKGGPGCTNAKEGCNYALNRGSDPTNPANYHFTDPTAFTGDVSNTNDQMHLSYPIKRDSLYFSGQANITDNVRFKAELGYNKRSSTRVTAGYPFDVDVAKINPMSIDSYFNPFGNQHGYATPTEVKWNRRLWELPRTSTSELKTYRAVAAFDGSFEIGERYFDWEVGYQYNKNELRQHTTGNLHKGRVQAATGPSYYNASTGKVECGKPGAPIAGCLPWNPLVPYGVDSPYGMTNNQALQDWLFPAENATGRTTSKNAFATISGSLFTLPAGDLGFAFGVENREETGKFVPDALAQTGATTNLAAGPTGGSYKVKEAYLELNVPVLADLPGARELSLNAATRFSDYNTFGNTLNSKFGFKWKPIDQLLVRGTWAQGFRAPTISDLYGGGSETFANFSDPCDSKYGSAKSSAEVRARCARDIADVANFRQLDSSNKPTEGSVAATPTPFIGGSNPNLKPETSTSRTLGVVWSPTFVSNLNVSLDWWKIRIDDTIVDDSPNQILIDCYEQGLADRCARFTRNPSNGIVTGLKFGGRNAGFAEVEGYDMDLSYRLETDYGKLSTSWSTTYVAKDISRSSNDSTIVPTVSNGIVTNTGIGFRVRSNLTVGWDLENFGVSWTARYYSSVKEQCVNPTKYADECSDPGVIAPWYKGARNYNERGAVTFHDVQFRYNLPWDATVSVGANNVFDKQGPVMYTKPRSVFSYYGGYDIGRFIYMKYTQRF

SEQ ID NO: 13925 - protein, 621 aa, Synechococcus sp. RS9916
MLTPLFVQPALPRPHAPPAFIAPLAVMAFAWVPLAVHAQSDDTANPSAKSTDPSDNASNRLQAAASWSNDTATLSPIVVTAGRGAQRLAEAIAQTTLFDAQDIADTTARDLPGFLQFAPGAQIVRNGGPGSTSSLFLRGASATQSLVLIDGVRVDSVSQGNAQLEQIPLDQIDHVEVVNGNVSALYGSGAIGGVVQVFTKDGANHPPRFHFEVEYGSYHTQREAAGIDGALDKDGTTTFSVMFARAKTDGFSSIDPALVPVNPNANGYFDESVSASLRHKLNDRWDIGLRYFLSNGDDSFDNPFGLPADLNNVRSKVQTASAFANGKLSNGWAMRFIVATGIDRSNTSLNGAYRYRYDSDNRQYTWQNDFTFARNQKLQVGYEHLDQTLDSNQYSAPDRHVNSVFAGYTARLGDSQIQANLRRDEYSDLGGANSYYLGYGYDFDERWKATASWSDAFRAPSFNDLYYPYSGNPLIQPERSHSVEAALQYTSDALGLMKLTAFETRYTNLIDYVQTTPGIYVAENVGQAKVQGIEGSWAGRVGKTDVRAAVTLQNPVDEDTHTDLNRRARHFASFAANRNIGGWRVGGEWIVSGERDDSGTPLGGYGVVNLPRATTSRRPGT

SEQ ID NO: 13926 - protein, 491 aa, Synechococcus sp. RS9916
MKLFQQLLVAPAALGLLAAAAATASEIRTELNMDGVNQYASQEQVTSISQFSDVQPTDWAYQALSNLIERYGCVAGYPDGTYKGQRAMTRFEAAALLNACLDRVTEVTDELKRLMAEFEKELAILKGRVDGLEAKVGELEASQFSTTTKLKGEVSMILGGMPDFDNVDEGPNPDQTTFNYDVRLSFDTSFTGKDLLRTRLRAGNFESLPFGSSSQIFTLDKATSTDDSVKIDRLFYDFPVGDSFNVTVGALVRNTEMLAFIPSAYKSSILDYFGLAGASGVYNKTTGAGAGFRWKQQVEKGRPYATFSANYVSGSGFDDSSIGAFSEESGINATAQLGVKAANWGAAVGYRYGSEASRIRNPNFSGTLLAGEDSNSVAVGAYWQPTDTGWIPSISLGYGYNDGGGGFPDSQSWMAGLQWDDAFIKGNAAGFAVGMPPFTDDGDEAWLYEIFYRFQVTDNISITPALFYGTNAASNGGDDAWGGVIQTTFKF

SEQ ID NO: 13927 - protein, 631 aa, Synechococcus sp. RS9916
MLVAMGALAESAPAAEPPKLLPDQSFIDTRYMGRHAGQDLPPTIPLTDLPVAEPLMPAKTAWPTEFFAQRRAVAAAGNVALTGGFQGNGVVSTEAGLANTELGDASLWAGARHDHVKPYEDGAGQRVNYGYDRINTQLAAAWRPAPKSRLSGFVMRDAFSHHRIPNYGIDATRLDRYLASTVFEHAPTDSALNRVEAGLVFDALSYDADNTSLRDRGSLGLKYNGLWTTARGLVRGEFATGSFRNTVTADFGLLKYNIDIDALYPAQGQAVHRMPDVQTLQGGLTFATATKLSPQDSLSAALRLDAIHSDPNERSQLPPVSGSGASSFQVTPQQLWNRYYGGNVDSNPTNLNVSGRILVAHDTEDRTGRLHADLRRAVRSPDAGERFYANSGPTALTQVGNPQLNPEAHHRFELGARQDGGGFKGNFAPGNPTGSWRVAVSGYGDRVVDFITADRARGQTGIARSDGAIIYRNVDAYLAGTALEAWWQVSEGWGARAKLSWTRGENLTDSRPLYQIPPLDGEMVIEHRRELAPDTVGSAGARLSFAASQNRIDAYSSTGSAEDTAGGTAGWALLDLFAGVALGERAALTAGIANVLDKHYHLHVNPLPQSPTTKLQWAPGRSAFVQATVSF

SEQ ID NO: 13928 - protein, 140 aa, Synechococcus sp. RS9916
TGESTMTYRLGVQFDWDKTWLQSDIGRLTGYWDGAYTYWDGKDYKDNHSLSFSPVLVYEFGNGNVKPYVEAGIGVSVFSNTQVEDRKFGSAFNFEDRIGFGLRFAGGHEVGIRATHYSNAGIKERNDGIESYALHYKMPF

SEQ ID NO: 13929 - protein, 841 aa, Synechococcus sp. RS9916
MRASRLLLNSSALGLLLAATPALAQEVPQDSAASADGGETIIVTARRQNERLQDVPASVSVLTATALQNTGATKAEDFTQLTPGVTIVTGTAEAGDTQINIRGINGARDAESSVALVVDGILKTNTAQLNQPQGTLTQVEVLKGPQGALYGRNAAAGAIVLQTLKPTDTLSGGLRASYANEATYEATAHIAGPLGDNIGFVLSGYYFTTDGWWRNTLLNNSKTVDDKENWAIDGRVMVGQGTSTQLDLKARYAEFHGASLPFNASFHLPLFGTVNPAFYEDVNKHEFNFYNNIRATNDQKSFDVSAKIDHEFGNGMKLVAWALYSDVKQDLVADGTSADFARYISNADSAVDSSVASCFASTAALTGFPVNQPGFIGQIPVPFLFAPSTGSTFGPYSPTTCDGIQYQLRNQKDFSTEVRLLSDTDGPLTWQLGAYYLHIDRKTGVSLGADTGQGVIKQLYNAPDTANPTSLLLADKFRTNVYAAFGAAEWKPSEVFTGGIALRYDIEDRVANSLVPDVTDPFTGGPINPGLAFGAFKPQNATFKQLQPKVTLSFHPSPALNIYANWGIGFKSGGFNNQGSAAVVDQNFNQFINAGVTIDDQYRKEKSSAFEAGIKGELLDGRVTYDLAAYYTRVTDMQFFEFFVGSFGLLRVVSNIDRVDIKGAELNLTGKVVDGWKVFGSFNVTDSEIKKNRSRPYTVGNKSPYTADWTINLGTEINAPINDSVKLLLRADYRITGPTWFHSVQDQERPTLFSGLLPISELNFLPPSFGNARYDVARRDAFGVLNLRAGINTDRYRIAVFADNLLDRKYIAEAIPAIEFGGSFISPGARRLIGVEVGASF

SEQ ID NO: 13930 - protein, 91 aa, Synechococcus sp. RS9916
MFSRVLALLAVLLLSANTWAAIEINNHQARNMDDVQSLGVIYINHNFATESEARQALNEETDAQGATYYHVILMREPGSNGNMHASADIYR

SEQ ID NO: 13931 - protein, 762 aa, Synechococcus sp. RS9916
MAHEVAARNIVRIVSLGAVSCLSLSLDFPNGSQKAFAQASLPPITVVAPPNPTVRQASQKPRTSAAHTRRRVAVPSSRQAQPVPYLTPSTATLGVPPVSYAGGQVATGASLGLLGNRNVFDTPFSTTSFTEKLIRDQQARTLQDVVNNDASVRTNVPAYSGIQGFFIRGFPVFAQDIAFNGLYGVADSFSPALEPIERVEVLRGPSTMLSGMPPFGTIGGTINLVPKRATDLPLTRFTTGFISNAQSYNAIDVGRRFGLNGEWGVRFNGAYQTGHTPIDNQKQEFGVGALAIDYRGDRLRFSADLGYQQLDFNSPLRNRSVLPGFPIPKAPDLRINQQQPWEYRDSNNRSAALRAEYDVSDQLTVYAAYGHSFFHQVYFGGLPSIFNARGDYRYPIRLTPYQTNSDTGEVGLRGQFETGPVKHRIGATVVGLWQGTGLINIPVGSTITSNIYNPVYAPPRSDVGLPRFSPTTAERFNRSVAIADTMSFLDDRVELTIGGRWQGIGAKALSPTMGLTTSDANNEAFSPGAGIVVKPIEHLSLYANYVEGLTSTAPPINAVNLNQNFPAAVSKQVEVGAKYDFGSIAVTVAGFEIKQPSGFLDPTTMVFALNGEQRNRGLEVNVLGEPIQGLRVLGGVSLIEGVLTKASNPAFNGNTAVGVPAVQFNLYGEYDLPSGLAPGVTLTGRVIHTSSQFYDQANTQSIPDWTTLDLGLRYTTTIQRTPVTLRANIQNVTGANYWATTGRGILSPGAPRTYLLSASFDF

SEQ ID NO: 13932 - protein, 713 aa, Synechococcus sp. RS9916
MKNYLIKPPILFSVLCFYSYANVSLASEIDDLMSMDLDDLTTQSVTVTTAAKKEQSLSDVPAAIYVITNEQIKRSGVRSIAEALALAPGVQVTKISEFNWQVSLRGLNEALFNKLLVMVDGRSVFSPLMSGTFWHTIDAILDDIDRIEILRGSAGTMWGGNATNGVINIITKNSNETLGQFLEVAAGEYNYKEVSYRNGFQINDVTTARLSMKGVQSDYYTFNDDEWNSYNISFRTDYVEDDRFLTFQLGGYHTKSEHSDWYRYDILETPFNPNDPMSAIVGYKAGLNDFSRGFYSNLNLGKTVDDTHYEATLWIDSNSRTEPSANGEYDTLNTDMLAIKQINPNNELTLGLGARYTKIKVPEKKADFYLGMDPYHRTSSRQTEREQIYNVFSQLETQLTDKFTSSLGVKIEHFTRNNTTEIQPQARLLYRSSDDHQFWTGVGRAVVTPSSVDSTTDLYRLGSVAAPLPNCDASTQNCYAQYPMLSLTAGNPDMDNESVVTWDAGYRGKLSDTLSIDTTIFLSHYENLRMLDNGLWFCRYGECVDGSTQPGQLAVHEFKLVDAIDAQSYGAELSLFWQPTDNININTSYSYIDTQAECSSEYMTCNSYDNGGYKVLYNLQPKHYVSLQMMWAINSQWQIDGWLKHKSSVSSSLDFYQPPAITTMDVRVAWQYNQDWPLVEFVVDGLGSSTYEDLPNTAPLEEVAFLRFSWTKL

SEQ ID NO: 13933 - protein, 1154 aa, Synechococcus sp. RS9916
MGAGFFRDVSKLLLCTTFLVAAPVSAVLQAAEIPAKPNSAARSVLPSDLKERLAQALRQGERELIAQVYDSTYRDPRLRDAVVQHAGSLSSRALRDVTTAADLGVLTSGQPMMLAPNAAPATRTAAVSGLSATSYQNVAMASNTSPNLPNPLPDPVLQTWNLDLIHAQAAYSRNFTGAGVVVTVADTGFDLTNAALSNKLLTNLGKNYVVRDGETYDPNDLTPQSALKNDIHGSHVSGLVAAEKFDNVDAHGVAYDAKVIPLRAIAEEGYSTVGGDSSVLALNYFAGLSGTMVYNASYGPNFDAYTGLKKWTINDVTDEGNAAMNVLQAGKIIVAANGNDRGKNPVAANNPSGLALLPFLNPAHAGLGVYDDQGQLFDGTPLQSQNGQIVAVMSVGITKAAAWYSNYCGVTASWCVAAPGGDDKTKAPVYSTIPQNTYGFAQGTSMAAPTVSGAIAVLIQANPNYNAQDLAHLLFSTTEDLGAAGVDAVFGYGLIRLDRATDGPTTLAANAIVSVADNQTAYWSQLLTTQGDLANTGAGILTISGRTNAGGNVLAQLGTLAVDGTLTVASGKKLEVAQPATLAGFGTVVGNTVVAGTLSPGKMANVGDFFSNNVVPAGTVLNGNSVGTLTFNGNVTLTSTANTRIDVDGSLIVPGGPGTYDKIYVTGAGNVFYAAGTLTPVLRGSVGTVSNYTPPIGSEYAFVQAQNGASTAGAFSTLVQPSSGLPANGRFDLIYNSTSIALVVTPASYGALASTDKLGASQRSVAKILDGERAASGTMPQADGKALYDALYKLDTVAELDKALTQLGGPGQPAIASAPLQAFSGFLGSIGDRQDALAAGGEQGHTGTAQAFEMSYAGRNTMTAGTNSAVNALASIAPAQRVQDGWSLWGQGFGRSSRIGDSGDLAGSKAVSGGFTLGADRWFSNNLLAGAAFGYARTTATSTDIRGTSDTYAGAAYASWTPGAAVVDLRVAAGPSQSSTTRQILLAPSGLQGNANGIGVGTTLEAGYRFALTPDLTVKPFAGLSWQGFRRDGYSESQLPIGLVYAAQTYEKLTSTAGAAFSARLRTLDGTTLMPELKLGWGYDLRDTTLVSQAALLDEAFLVDAAKPGRNAALVGAKLSGWRTESFRLFAAYNGEFRSNATSHQISAGARMNW

SEQ ID NO: 13934 - protein, 267 aa, Synechococcus sp. RS9916
MNNGIDGNIPNVLFETQFSAYPFATWAERLRYHPTPEFNLQFGVFQTWDRIFQRSTNGLDWGIRGGDGVMMLAQIGWTPEFFKKSVRVASDGKSAATPQMKGLPGHYWIGGSYSPWKGYAQFGSTEKASGSYGFYLHADQMLYQVAPGCEQGFTLFFDTGYYPQDNISIMPWQFNVGAFYTGLLPSRTNDKTIAGLIYGEFGGDYASTIQASGIGRPEHEAVLEFGYRIQFTKFAYLQPDLQYVSHPSGTGRIPDAVVVGAQLGLSF

SEQ ID NO: 13935 - protein, 515 aa, Synechococcus sp. BL107
MKLFQQMLVAPAALGLLASGANAAELNINGVSDYAASADQVTSVTQFSDVYPTDWAYQALSNLVEQYGCVAGYPNGTFRGNRAMTRYEAAALLNACLDRITEVTDELRRLLEEFETELAILRGRVDGLEARVGELEATQFSTTTKLKGVTNWVLGAAKYHGQGSKNAAKNNGGTSFSYNLALNLETSFTGKDLLYTRLRSGNMNNIYGGNGVGLFAQEYGFDSGNTVKVNRLYYSFPVGDEFTIVGGPVVRMDDMLPVWPSAYPSDMTMDFFTYAGAPGAYNLTLGGGAGVYWQTEGGFSISTSYISTDGNLSDPNVGGVATDAAGTSATTQIAYAPEGWGLAAAYTYASGAEGGGALYGGNGTPGAVAISQSGNTNSVGLSAWWTPEDSGWIPSISTGWGLTDVSNSNLSGVRSATSQSWYVGLEWSDVFIEGNSFGMAVGQPTFITDIDVKGRKNESDYIAGSGYAWEFFYKFQVTDNITVTPAVHYLSKPYAGQDSDGLNAMSGLIKTTFKF

SEQ ID NO: 13936 - protein, 145 aa, Synechococcus sp. BL107
MGFGVRYVDAANPICWQVGPAGARYDATTAQAFGEIGYRVAVGQAVAEPFGGLALVHLHRDGFTEGGGITALSASSRNDDIGYSMLGSRLTTSFTLSPGLVAMPRLAASWQHAFGATAPIADLAFRSTGERVRRDQVRGQLSWQF

SEQ ID NO: 13937 - protein, 432 aa, Synechococcus sp. BL107
MKLFQQMLVAGATLSLLAPVAAQASDVVNLEEMNSYSRSKTKSSRFDSKTFINEVSEDIANLKGRVDGLEVKQNEFEAGGFSDTTTLDGKAVFGLMATDHSKVKTDGTDVLAAAYQYTMNLNSSFTGDDNLYVRLRSGNSTSNFVNKEFGTYLSMGTEYGDLLKVDKIWYTFPVGDSNTVWVGPKIENYYMHGTTPSIYKPVTKQFTLGGNGDAYGASTDSGFGWAYKADNGFAVSSNVVSKQNVASESGTSKGFLTNEAKTSWATQAGYTTDQWSVSAIVNNKYNGWTDGYYESKQHTPSNFTTGVTNFTAIGLRGWWRPLETGTATPAVSLGYDTTDYDEAPEASNNSTAWFAGLTWQDIFQADDRIGVAFGQPTMNEDEPNEPFAYEAYYEFKANDSITITPTIFGGTNRNGADGDDVFGTVLQTTFKF

SEQ ID NO: 13938 - protein, 513 aa, Synechococcus sp. BL107
MKLFQQMLVAPAALGLLASGANAAELNINGVSDYAASADQVTSVTQFSDVYPTDWAYQALSNLVEQYGCVAGYPNGTFRGNRAMTRYEAAALLNACLDRITEVTDELRRLLEEFETELAILRGRVDGLEARVGELEATQFSTTTKLKGTTHWVLGAAKYHGEGSKAEATANGGTSFSYDLRLALETSFTGKDSLVTRLRSGNMNNIFGGGGVGLFGQEYGVDTGNAVVIDRLFYSFPLGDEFTIVGGPRVRMDNMLPVWPSAYPSDMTMDFFTYAGAPGAYNLALGGGAGIYWQTEGGFSISTSYLSTDAELSDPNAGGLLTDAAGTSATTQIAYAPENWGIAGAFTYASGGEGGGALYGGNGTPGAVALSGSGNTYSYGLSAWWMPEDSGLIPSISAGWGLTDIPDPAISGVKDATTQSWYVGLEWSDVFVEGNSLGMAVGQPTFISDVDTKKGVDDFVAGSGYAWEFFYKFQVTDNITVTPAIHYLSKPYASQDSDGLNAMSGLIKTTFKF

SEQ ID NO: 13939 - protein, 993 aa, Neisseria meningitidis
SPQVLTPNVTTPFKGDDVYLNGDCAFVNVYAGAENGSIISANGDNLTITGQNHTLSFTHSQGPVLQNYAFISAGETLTLKDFSSLMFSKNVSCGEKGMISGKTVSISGAGEVIFRDNSVGYSPLSTVPTSSSTPPAPDPSPTASSSSSPTVSDARQGSIFSIETSLEISGIKKEVMFDNNAGNFGTVFRGNSNNNAGSGGSGSATTPSFTVKNCKGKVSFTDNVASCGGGVVYKGTVLFKDNEGGIFFRGNTAYDDLGILAATSQDQSNTETGGGGGAICSPEDTVTFEGNKGSIVFDYNFAKGRGGGILTKKFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVLGGELVVTEGATLTTGTITATSGRVTLGSGASLSAVAGTANNYTCTVSKLGVDLESFLTPNYKTAILGADTTVTVNNNPTLDLVMKNEAEVYDNPLFVGSLTIPFVTLSSVNNTNSNGVVKTAVTINDADAAHYGYQGSWSADWTKPPLAPDAKGMVPPNTSNTLYLTWRPASNYGKYRLDPQRKGELVPNSLWVAGSALRTFTNGLKEYYVSRDVGFVASLHALGDYILNYVQDDRDGFLARYGGFQATAAYHYENGSIFGVAFGQLYGQTKSRMYYSKDAGNMTMLSCFGRSYVDIKGTETVVYWETAYGYSVHRMHTQYFNDKTQKFDHSKCHWHNNNYYAFVGAEHNFLEYCIPTRQFARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 13940 - protein, 370 aa, Neisseria gonorrhoeae
SPSFDSIRYAAPRALHNPDYYENDYEEIPLDALEDENVSESVDTSDKQPQDNTELHEKVETVSLQPRAAQPRAQAAAQADAVSTNTNSALSDAMASTQSILLDTGAYLTRHIAQKSRADAEKNSVWMSNIGYGRDYASAQYRRFSSKRTQTQIGIDRSLSENMQIGGVLTYSDSQHTFDQASGKNTFVQANLYGKYYLNDAWYVAGDIGAGSLRSRLQTQQKANFNRTSIQTGLTLGNTLKINQFEIVPRAGIRYSRLSSADYKLGDDSVKVSSMAVKTLTAGLDFAYRFKVGNLTVKPLLSAAYFANYGKGGVNVGGKSFAYKADNQQQYSAGAALLYRNVTLNVNGSITKGKQLEKQKSGQIKIQIRF

SEQ ID NO: 13941 - protein, 162 aa, Neisseria meningitidis
  misc_feature (2)..(2): Xaa can be any naturally occurring amino acid
DXLYNGEILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFD

SEQ ID NO: 13942 - protein, 387 aa, Synechococcus sp. BL107
MFWNPATLIGAGKGLTVESHSSFIMPESDIDGTFTPGALTTVNGATTSTAGSGDIASDAWVPSTYTAYRFNDQVVFGLAVNAPFGLSTKPEQNWAGQYYSRSSEVFSVNVNPAIAYQINDMFAVGVGVQAQYLQVRLKSAYPFSTSAATTEFKGEGYGIGVTAGLTVRPWEGTEIGLGYRSAVANNLDGSYTNPGGRFFAGMTPVSFSGNRAGIEATVVTPETVTLSASHRINDTFKIAGTVEWTNWSRLKTVHPSSDGGTATTNPTGLPNLEFNYDDGWFFSVGGEYNWNQQVTLRAGVGYELSPIDEAIRSTRLPDNDRLWLSAGMTWSPSENLAFDIGYSHLIPADTKIDISGNHQDYNSNIGTYTGKVDSQVNIISAALRYTY

SEQ ID NO: 13943 - protein, 771 aa, Synechococcus sp. BL107
MRSTFAILVTGFCATSAHMALAQTAAPAAAAASEVVDDTSQGLGDIVVTAQRREQRLQDVPVTVNAISAQGLERQGITNTADLNAVVPGLNIAKSSTVVQPFLRGVGTASLVPGNDPSVPLYIDGVYHSAPAALFFSFNNIERVEVLKGPQGTLFGRNATGGLIQVITKDPTQELSGKFSLSYGNYRAVNATGYISGGTDTIAADLAVVYNNQSKGWGRNTYQAGEGGPIVVGGTTFTDRKVKRAAGYTDEFGIHSKIVMTPGDRTTVKLSGMYIDVDTNQNHYRHPLPGRLLPGPPGQNPYSFTGGFYDYDSDIEWFNRNHQYLFTAEAQHEADFATIKSISSYLKAKAEISVPSDGSPLISRASSFAHLRWKTFTQELQILSNKDWGPSWLEWIGGLYYLNSRAGYDPQEVTYGYRYDGTFNRYSFQTSDSLAAYGQATASLTPTTRLTLGLRYSKDRLAATQYQLGTSAVLGGGNANGAVTILVPKVRTTFDKITWRVALDQRLTPDVLLYASASRGYKTGAWNHGALCATTPPVGVACSNLVLPTRPEVLDAYEIGLKSDLFDKRLRFNISGYYYDYSDLQVQAVVGVPPISVLNNAASARMYGIDVETAFQFNRYLRISANGAYLDAKYKKYPNAVGFIPLTVAPYANSQILFDASGNRLPRAPKFTSTVSVDWTIPTGAGDVTLTGSWYYNNGFYWDPQERLKERAYSLVNGQIALKATDNLSLRIWGRNLLDKKYYSYQTATSAGDQGAPAAPRTYGLAVDFQF

SEQ ID NO: 13944 - protein, 524 aa, Synechococcus sp. BL107
MKLFQQMLVAPAALGLLASGANAAELNINGVSDYAASADQVTSVTQFSDVYPTDWAYQALSNLVEQYGCVAGYPNGTFRGNRAMTRYEAAALLNACLDRVTEVTDELRRLLKEFETELAILRGRVDGLEARVGELEATQFSTTTKLQGKADFFLGAVKYEDRNKCNNKGGDCNSDGTNMSYRYTLNLNTSFTGKDRLYTRLRAGNMANVWTQTDSYLADAKKGDNTLKIDKLWYTFPIGSEFTATIGALVENYYMIETPTRYKPILKAFKLGGYGSVLGASTGQGFGLQWRQDVDPGEAALNIAANYVADGGDGAKSDPKEGMFGENTDAYFLSQVGYGNRQWHVSALYSLKNAGQHCAVENARGRCIETSSGAKAAMGYSTPLAKDLGHPMHAIGLRGYWQPEDSGFIPTISAGVDFGYAEGEYRGNAEALKGWMVGLNWNDAFIEGNKLGLGFGSYSSYATDAKDVSTGDEANFAIEGYYDFAVSDNITITPAIFWVDNAYGEAQISGQNKFGGLVKTTFKF

SEQ ID NO: 13945 - protein, 174 aa, Wolbachia endosymbiont
KKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSFGAHFDKSEEVDKAGGGKETKVTKDAYKVLYSTVGAKA

SEQ ID NO: 13946 - protein, 111 aa, Wolbachia endosymbiont
ADSLTAFSGLVNVYYDIAIEDMPITPYVGVGVGAAYISTPWATAVSSQNGKFAFAGQARAGVSYDITPEIKLYAGARYFGSFGAHFDKDTAAASKDKGELKVLYNTVGAEA

SEQ ID NO: 13947 - protein, 916 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNYVYEGDNILDGLVFKPRIPYGLRYSHVKFFDERHHKRRLGFTYKYKPENNRWLDSIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRDPRSIETVSLCNNTRGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 13948 - protein, 1111 aa, Pasteurella haemolytica
MKSDSLKNNRKAVITAFLLCTGFVAGHPLTVMAIDNETSVEVVQQQIKISGIVKDATGEPVIGASVLEKGTKNGIITDFNGNFSLSVKPNATLIISYIGYKTQEVKAAANKSINIILKEDTEMLNEVVVVGFGTQKKINLTGSVGIASAKELEARPVASATQALQGMIPGLDITTNTGALDQNMNISIRGVGTIGEGSSGSPLILIDGMEGDINTINPQDIATISVLKDAAASSIYGSRAPFGVILITTKNGKEGKATVNYNNSFRFSSPINLPHTMDSYNFALYYNQARLNSSKSVRFNDTALQNMLDYQAGTNEGWKASSSNPDAWDGTSYFNNDFFHEIYSDNVFSQEHNVSVTGGSKNITYYSSFNYLNQGGLLNFGDDGIHRFNATAKLSATVTKWLKLSLSTRLTRNDVFRPTYFDHGNTFYIQLIQTARPYQALYDPNGNLYYSPALQLRDGGETNKRTDRFYYQATATIEPIKNWVTNVELNYNIQHQNNKENRLTAYQYGPTGVATAVNSASGKNEYLKEEYFQNNYLNLNIHSTYSHTFNNSHNMKVMAGFQTENTKRHDFNAKKYGFQDPERPEFDLTTGKNSKDADIGSEVKGYSQDWATAGFFGRLNYDYKSRYLVEGNLRYDGTSRFRRGNRWQLSPSFSAGWNMAEEPFFENLRSNIDQLKLRASYGVLGNQNTSGWYPTYRSMSIGVLNGQWLNNSIAPNTASIGSLVSSALTWEKVKTWNVGLDYSFFNNRLSGYFDYFIRRTEDMVGPAPELPATLGVSSPKTNNCDLKTRGWEFQISWRDRLRCGFNYGITLSLSDQQTYIDSYPGNMTGSFYSSSTYDLWQYVSGYKINTIWGYETIGIAKSQEEMNAHLASLPNGGQSAIGDNWGAGDIMYKDLDGDGQISPGAMTTSDHGDLKILGDSNPHFFFSLDMNASWKGFDIRAYWQGVLKHDFWPAGNSIMNHSTSWGPGQMFWGVPGNQGESWIIGFTEHQNYFRTEETGLDGYKLPANLDSYYPRPLFNNEKGYKNQYIQSRYMQNAAYVRLKNLQLGYTLPKAWIEKMNISKCRIFVSAENVFTITSLSKLFDPETCSGGVGGNAYPLSRTWSCGLNVTF

SEQ ID NO: 13949 - protein, 317 aa, Neisseria meningitidis
MRFSTQMMYQQNMRGITNSQAEWMKYGEQMSTGKRVVNPSDDPIAASQAVVLSQAQAQNSQYTLARTFATQKVSLEESVLSQVTTAIQNAQEKIVYASNGTLSDDDRASLATDIQGLRDQLLNLANTTDGNGRYIFAGYKTETAPFSEEKGKYVGGAESIKQQVDASRSMVIGHTGDKIFDSITSNAVAEPDGSASETNLFAMLDSAIAALKTPVADSEADKETAAAALDKTNRGLKNSLNNVLTVRAELGTQLNELESLDSLGSDRALGQTQQMSDLVDVDWNATISSYIMQQTALQASYKAFTDMQGLSLFQLSK

SEQ ID NO: 13950 - protein, 1503 aa, Neisseria meningitidis
MRFTHTTPFCSVLSTLGLFAVSPAYSSIVRNDVDYQYFRDFAENKGAFAVGASNISIQDKQGKILGRVLNGIPMPDFRVSNRQTAIATLIHPQYVNSVKHNVGYGSIQFGNDTQNPEEQAYTYRLVSRNPHPDYDYHLPRLNKLVTEISPTALSSVPLLGNGQPKANAYLDTDRFPYFVRLGSGTQQVRKADGTRTRTAPAYQYLTGGTPLKVLGFQNHGLLVGGSLTDQPLNTYAIAGDSGSPLFAFDKHENRWVLAGVLSTYAGFDNFFNKYIVTQPEFIRSTIRQYETRLDVGLTTNELIWRDNGNGDSTLQGLNERITLPIANPSLAPQNDSRHMPSEDAGKTLILSSKFDNKTLMLADNINQGAGALQFDSNFTVVGKNHTWQGAGVIVADGKRVFWQVSNPKGDRLSKLGAGTLIANGQGINQGDISIGEGTVVLAQKAASDGSKQAFNQVGITSGRGTAVLADSQQIKSENLYFGFRGGRLDLNGNNLAFTHIRHADGGAQIVNHNPDQAATLTLTGNPVLSPEHVEWVQWGNRPQGNAAVYEYINPHRNRRTDYFILKPGGNPREFFPLNMKNSTSWQFIGNNRQQAAKQVAQAENARPDLITFGGYLGENAQTGKAAPSYSKTNIEWVNGPNTSHKPSPYTNTPTRTGAGVPTITASKKAATPAPTSHGMPTAPKTGNFSDMTGEAAIEKNRHIANAAVYGRPEYRYNGALNLHYRPKRTDSTLLLNGGMNLNGEVLIEGGNMIVSGRPVPHAYDHQAKREPVLENEWTDGSFKAARFTLRNHARLTAGRNTAHLDGDITAYNLSGIDLGFTQGKTPECYRSYHSGSTHCTPNAVLKAENYRALPATQVRGDITLNDRSELRLGKAHLYGSIRAGKDTAVRMEADSNWTLSQSSHTGALTLDGAQITLNPDFANNTHNNRFNTLTVNGTLDGFGTFRFLTGIVRKQNAPPLKLEGDSRGAFQIHVKNTGQEPQTTESLALVSLNPKHSHQARFTLQNGYADLGAYRYILRKNNNGYSLYNPLKEAELQIEATRAEHERNQQAYNQLQATDISRQVQHDSDATRQALQAWQNSQTELARIDSQVQYLSAQLKQTDPLTGILTRAQNLCAAQGYSVDICRQVAKAADTNDLTLFETELDTYIERVEMAESELDKARQGGDAQAVETARHAYLNALNRLSRQIHSLKTGVAGIRMPNLAELISRSANTAVSEQAAYNTGRQQAGRRIDRHLTDPQQQNIWLETGTQQTDYHSGTHRPYQQTTNYAHIGIQTGITDRLSVGTILTDERTNNRFDEGVSARNRSNGAHLFVKGENGALFAAADLGYSNSRTRFTDYDGAAVRRHAWDAGINTGIKIDTGIKIDTGIKIDTGINLRPYAGIRINRSNGNRYVLDGAEINSPAQIQTTWHAGIRLDKTVELGQAKLTPAFSSDYYHTRQNSGSALSVNDRTLLQQAAHGTLHTLQIDAGYKGWNAKLHAAYGKDSNTARHKQAGIKIGYNW

SEQ ID NO: 13951 - protein, 243 aa, Rhodopseudomonas palustris
MKKFLLGSVALIALGAAPAMAADLAARPYTKAPPPMIVAIYDWSGFYIGANGGWGTSRKSWDFYAPGALLLSEGSHDASGATAGGQVGYNWQMGSWVFGVEAQGNWADFKGSNVTLLGGLFDNHSKVEAFGLFTGRVGYAWNNALLYAKGGAAVVNDKYEFVRRADGLVTGTASETRWGASVGAGLEYGFTPNWSFAVEYNHLFLDKKDVTFTNTAVERIKQDADIVTARINYRWGGPVVAKY

SEQ ID NO: 13952 - protein, 738 aa, Rhodopseudomonas palustris
MAGWLALACLAPLNARAAVAESDFDKLMALSLTELIETPIITASRQSETRDQTPSHIIVVTREQIRERRYKNLADLLEDMPGVDFQRGTKSSQYNQFAVQGSLGPHRLVVMLDGVRIGHPSGGNMPIAENLALYHAKQVEFLYGPAAALYGADAVSGVINIITDRGSRGAGSWVEVGAGDFDTQETSFMAGYSGERMAFTVGGHRQRSDRAPLDRYYPNDFRKVDADPDSQRVVPAAEREGYVGDISSNSLFARLDLGDDLTFGFYRNVFRSLTSTGDPPATALYLRDSQWTTTSETTYGKYRYTLGADFSGEVVVDYSRMQVDPHSKYNNSFSNFSDGYSYVLGERIGIEHNINWRFDDTHRVQAGLGYQKHYAIETASLPAPYDTDRGKSEQGYVYPNTTIPMQIYDAAFENVSMYAQLQSEWDEAFSTMVGLRMDRHSDYGQTVNPRLGAVWRLNPQHVLKFLYGEAFRAPSPEESLSAFGIFDGSMSNGLYVGRGFRVPNFNLDPEEARTTSLTWDWRPQANLNFVANLYHSRIENLIVTRPSTQVDAIPGAVLINPETKGNAGVQRHYGVDLMAQWRFKIDEAWSGDLWGSASWIRGRIDEGDGVEWEISHVAERKLKLGTTLRYRDRLSLTTQVLAMGDTTNGRRRAPAPSLQLAQTCDADGAPERCRTDGYTVVNFHAGWHKLFDGRATLWLDIYNLFDTRYYAAHGSGSRTFWDMPQQPRTSMISLEYRF

SEQ ID NO: 13953 - protein, 274 aa, Rhodopseudomonas palustris
MRSVKSLLAAGAASLLPITGAFAADMPIAPPPAMYAPPPPEDFGGWYLRGDIGMTNQDLKFKDTGTASYEDRGFESSSSALFGLGVGYQFNNWFRADVTGQYRGKATLHGATNIYTSPSQILADNYSGNKSEILVLANAYVDLGTWWCVTPFVGAGVGMANVKISGFRDDGVGYLPGSVPVLSTTYYDDVSKWNFAWAAHAGLAYKVTPNVTLELAYSYVDMGSVNMAGWTNYAHASGQSAYQLKNITSNDVKLGVRWNFDSAPIYAPPLMRKG

SEQ ID NO: 13954 - protein, 208 aa, Rhodopseudomonas palustris
MSLRTLLAAALCTAGLTAPLAHAHEAGDWLFRLGVTQVSPKSNNGSVLNGAVDLDVSSNVRPSFTVAYMATRHIGIELLGAWPFQHDIRGSGGLGKIGTTKHLPPTLSLQWHFLPDSTVQPYVGVGLNYTHFFDTQTRGALSGSDLKLGDSWGLAGQVGVDVKLDDRWFLNADLRYIDISSKVKLDGQRIGTARIDPWVATVAVGYRF

SEQ ID NO: 13955 - protein, 790 aa, Rhodopseudomonas palustris
MATMYKSTPSAAWCKKRLLVTSLFAAIYQTSAIAADTSAVSGEAVDDTSEQMTVTAPAPVQKAGSEHSISARELENKGANDFGSIMRYEPLISATGASGGSGNGKSGFDRGGYTGYNIRGMESNRVGIDVDGIAQPNATGRGYVGRAGLNTFGIGRDYIDPYMYGSVDIQSGATSTETANSAIGGNVSFRPKSADDYLRPGKTSAFGYRSGYDSADRSWHNGVTVAGGDEFLRGILVYSRRDGQETENNSGTVDAYPANWHSDAFLASGIWQPNDEHKLTSTFDYYHKTNHTHYDTWDSSGNSTIGTANQTSQTRRWGLSLKDDWTPMNDYLDSVSTKIYYQHTEAHDWTYMPDSVTRKMQTVNSNYDTDTWGLQTALAKTLGRHDLSAGFNASTSKTQRPFSQSPIPSVYSEIMQPEADSRSYTLGGFVQDKINFDLDSHNFAVIPGVRVVHQSTKPENLSDLAANSSVLSESSVANLYGKNSDTQVLPSLTFQYDLTPRLMTYLQYQRGAQFPNASQLYGSWNLGSSYAGSQQYALIGNTDLKTETSDNLEWGLKGEVTEGITLRTALFYNSYKNFIAYTRYTRANNPGQFTNVPSNIYTIYQAENRDKAYIYGGEISTKFNFGTWFEQVDGLSATLALGYSEGKSKSSYSGDKYVDLDSVAPMKAIVGVAWDDPAKRYGTALTATFVKGKQATATNRESYSNSGSAITDASSDYMRVPGYGMLDWTAYWQVAKNVRLNGGVYNLTDRKYWDYLSSRNIETGTNQDANDKALAVMPGRTWQLGVNVDF

SEQ ID NO: 13956 - protein, 374 aa, Rhodopseudomonas palustris
MTRVGVWHWMRPLATIAALSASATCLVGTANAQSSVVIYGRLNTAVEYASASTATDGTHLGGTARLTNNRSVFGIRGEEALGYGLKAIWQVESTLSIDTGAGQIAARDTRLGMASPYGTVFMGNWDTAYTTSTKTLDPYYPTTAGYMSIMGNGAAATTDNVQNTNSFDRRQQNSLHYQSPQWHGLSGAMTWGLPEEKISVPRNPALYSFAGAYERGPLSVSMAYEIHQHYQTAGRNDDGMKVGVSYQFPTTTIALVYERLHYRTATGDLARNSYYTSLVQKLGPGSVKIGFTFASNGTGNATETIGSFHAGPETGATQITVGYDYPLSKRTSIYTYYSRINNKRNALYDFAINGLGVKAGADPQTFALAMRHNF

SEQ ID NO: 13957 - protein, 1125 aa, Rhodopseudomonas palustris
MKRLKSVLLIAIVILCSGFAAAQGYLSTINGTVADKSGAVIPNAKVTVTNIAKGLSHTYTTSQTGTYTAPSLEPGDYTVTAEAQGFGTLSKESLHLEVAHDLRIDFQLLPGVAKETVAVEEVAPLINTSNAVLESTFTNEQINQLPLQGRDFQNLVVLNPGVQRRPGGGFLSISSNGNRVEDNNFIVDGIDDNDAYYGTTVINAEGVEGTPATHLPIDAIQEFNVQSSPEAEYGWKPGAIVNIGIKSGTNALHGTAYYFHRNSALDARNYFNPGDQPVSALRLHQFGGSIGGPIKKDKLFFFANYEGVRDVVGNPLELNTPVTVPYGDPSISIPDAVAACTADGSCNDLSSSLLKYFPTNPGTANPADPTLQTFDFNNTNREDNGIVKVDYQINEHNNASFRYFIGDSLQVEEAHNVLQPQWLDQAQTRAQVIGASYNWMPKNNVVTQWRFGFNRFSQQIFTVDHTVNPTEYGINSGVTDPLDFGFPEIAISGFNRLGGSSNWPLFTTPNLTYQITENTTWSHGNHSFKFGGEFRTGSTDNLRDLDGKGYVAFRGLERFTTGDYRYGYIKAGDTHRVVSQKSFGFYVQDDWRIKPRFTVTGGLRYDVSLPITEQNDLLANFDPAVGIQQVGKQIDKPYNTDWNNFAPRIGFAWDLFGTGKTVLRAGSGIIYEIPHISLFVSQNSASALGLANIPSGANGISVPGGNITTADLKVSDLNWSSAGPIFGDIPSTKLTCDSDTPCSILGVDKNIKTPYSLSWNLNLEQQLTRNMALQVAYVGNHGVKLYSIRNINQNQWYYDWVANGMGDPYEDTDGYSGRPFANPTLCGTHCFPYLAEVEMLQNKDSSIYHSLQVTLRQHSYKGIDFVAGYTWAHAIDQYGSNRSYDWEDPNNGLLERGDASSDIRNRFTLAFTYQTPKLPRYDKAFGGWTFNTILNFEGGRPIDLYDGDSAFSGAYTGNDRWSIYGDPSNLKWGFNGLPFIPVGTPQWAKTCGPYAPGLLPGIDPGTDYPTTSDYAGGCYAENGTVLVPAQWGQFGNMHRNMFRGPGYSDVDMSLAKTFKLTERFSLQVRGEFFNILNHPNFAGLGANLETGAVGIPAYTPDVAESNPVVGSGGSRHIQVGAKIVF

SEQ ID NO: 13958 - protein, 778 aa, Rhodopseudomonas palustris
MVGLNSRIRALLLSGSVVALAVAPAAAQTATTSSPPNQQKQAKRQQAAKPAAQQQVQTPARDPRDALAQAGQGVQALDTITVSATKTEERAIDALAPASAITQGQIERLQPNRLQDIFVATPGVAFQDRGDDPSTAINIRGLQDFGRVAVVVDGARQNYQRSGHNAQGSFFLDPELIGGVDVVRGPSANVYGSGAIGGVVSFRTKDIDDVLRAGERWGVDMTGSYGSNNARGLGSIFGGVRVDPTVDVFGGALYRTQGNYKDGAGTEIGNTGNDIAGGLLKLTVRPADGHEIKFGGIFQDYNYDIGQFNRGPVLTAAQRALYQGSSVYESNVKNYTGTMSWKYSRPDDMLFDWNISLYGNRTDNDQTKTYHNSTSGAAYCGTGNVGNNISGCVGDQRGYRLDTIGIDANNTTRFDYGDWRTAVTYGFDVFNDKVTTWDSRGNSNITTPSGERTVSGGFIQLKNNYASWLEVIGAARYDHYELSSETSSASGSRLSPKITVGVTPLAGLTPYVSYAEGYRAPSITETLISGAHATGGGPALFTCADGTSGLFCLIPNTGLRPEVGKNKEVGINLKYNDVFVSGDSFRGKINAFRNDVDDYIELVASTPQATIYGMYSKYYQYQNIPHARIEGVELETSYDAGLWFVGLSASTLRGVNTDTGLGLASVPSRKVVTSGGVRLLDRKLTIAAQWASYAANTNLPAGYLPATSYDLVNLNVAYRPTADVTLHFSVDNILNNYYRPYAIPGSSTDGTSQNDVLFSSPGAGIVYKGGIKVHFGGA

SEQ ID NO: 13959 - protein, 224 aa, Rhodopseudomonas palustris
MKKILLASVAIVGLAAIAPAQAADLAARPYTKAPPYAPPAPIYNWTGFYLGGHIGGAFGGANNIFAPGVAFNNNDGVFMGGVQVGYDTQFSPNWVFGLEANYSFLDTGSFFANRGLGSVTGRLGYTWGPALLYVKGGYGWADSRFTNGFGGNGGRDGYTVGGGLEYLFTQNWSGKVEYQYYDLGTVNLVAPVVANFRNDQHTVKVGLNYRFNWGAPVAPMAPGY

SEQ ID NO: 13960 - protein, 269 aa, Rhodopseudomonas palustris
MHSKTAPLCLALAGGLLAAPAMAGDLLHWQNNSLTYLYGQDYKVDPDTQQTVTFEHASGWAWGDMFFFVDNIWFNGVSGSDGHTYYGEFSPRLSLGKVSGRDLSFGPVKDVLIGATYERGESSADGVPNQNYLLGPAVDLELPGFDRFALNFYYRKPDGSTGRASGQWQVTPTWAMTFPVGKSDILFDGFIDWVVNDAGSKSRGDFLSKNLHIVPQIKYDLGKALDYAPGKLYVGIEYDYWSNKYGLEDGSLPFKTDQNTFSAIVKAHF

SEQ ID NO: 13961 - protein, 966 aa, Rhodopseudomonas palustris
MNCKSNKLRDAVVLALVVGVGGTGTAIAQEAGTTNLDKIEVTGSRIRQVDSETAQPVLLISRDQIEKQGFKSVADILQNIPTAGSPAISRTSPLSSGENVGGYYIDLRNLGANRTLVLVDGHRLGITNGGLQDVASIPAVMVERIEVLKDGASTIYGSDAIAGVINIITRKDFEGAEANVYIGQWGQGDGQRDVYDFTMGFRGDRGSLTAGVEYTNEDPVWARNRWFSRARFPTGEKTAPRPGGLSGTTEFGRFAYTNATGGTSTRTLRRDVAGLDPADFSSYRALNGTDTSNPSLESTVYSGIKRKSAFLNGHFDFTDNVAFDTSVLYTDRESFAQNAGYPMQSANFDLSSGGLSIDSVFNPLGNQATGALPAGVAPQAVQYVRRGWEVPREVQNNLTTSRFTGKFSGNFNFGEKYWDWEAGFLYNQNKGTQISTGNLNTYAVGQATGPSFINSEGVAQCGTAANPITLGFGPGACTPWNPLVPFGYNAPNGLNDPNVQAYLYQPGQALSETTTKNYFASVSGILATLPAGDLGLAVGVERREETGSFSPDALAQTGISTDLAAGPTRGGYNLNEVYAELQVPLLADLPGAKELSVTLATRYSDYDTFGNTTNSKFGFKWKPFESVLVRGTWSEGFRAPTVADLFGGLSQSFENYTDPCDTSFGPAAGNARCLADVPAGFRQLNASGVAPAPGPGEQTNVPFVSGSTPTLTPETSTSKTLGLVWSPGFITGLNASLDWWNIRIENTIVGDTPTDLLDDCYLRGIESRCVGFTRNAAGNITSLSFGLRNAGYVETEGFDFDLNYRFETQWGNFTTSLLNTYVSKNELKADNSTNPPSQQNGYGGNFRVRSNLSVNWQWDDWSVTWSARYYSRTKERCFATDRCSLPDFTAPEFQGSTVGMNELGSNTFHDLQVAYALPWNATVAVGANNIFEHYSAPAYGQPNSGYSYYGGYDIGRFMYMKYQQRF

SEQ ID NO: 13962 - protein, 743 aa, Rhodopseudomonas palustris
MIRLHPLVVALSLALPVVPLCAIAAEADAGAAAARDVHDFDRLQVTATRTQRALVEVPGTVDVIDREQLDNQLVRELKDLFRYTPGVSVTSTSGRFTGASGVRIRGLDGNRVAILVDNVPVSDTFNFGSYLNANRNFVDLETLKRVEVVRGPASSLYGSDALGGVVAFVTKDPSDYLSADKHSYVGLKFGYEGDWNGLFAGATGAFGGERWSGMVAVSHRQGQEAQNQGDNRSRNYTRTAPNPQQVDGRSVLGKLVYAPNAQQRFKLTVEGNEDDGRIEALSGIDARSPSASQRILSQDGRDHQTRARVSLRHELDALDTALADDLFWQLYRQDSASLQRTDELRGNNTRRHNEHHFDQRVYGLLVNAHKAIDTGTLRHDITYGLEGSWTDTREKRDGYSLNLANGAVSKLVGQDVFPVRDFPMSETTKLGAYAQDEMRLLDGRLSLIPGVRVDYFRLSPRVDDIFRQDNPGVAAETIDEQQVSPKFGAVWRFSDAWSAYANYAHGFRAPPYNDVNIGFTNLQARYTAIANPDLKSETSRGGELGLRFNDTVGYLGVNVYYTDYRNFIESYAPAGVNAEGLLLFQSRNVDDVVIKGAEARAGVDLGALAGWQGWSVNSAVAYSQGDNLTDDTPLNSVDPLRGTLGVAFDSERWGAEVIGTFVARKRRPQLASYYTPAGYATLDLMGHWEFAPGAKVTGGIFNLADRRYVDWNALPNGTLDSSTVLDRFTGAGRTASVSLAVSW

SEQ ID NO: 13963 - protein, 233 aa, Rhodopseudomonas palustris
MKRILLALASAFTITLSASTYAAAPLSFGIKLSGVNSTIAGLKEAKNPFAGNESNFLNIGGAGLAYVEYAFNDNLGLGLEAGYFFGKIGSFTQKTDKKNTYNITAHGVKLFPAIKIYPMGREDENGILKINVGGDLFMPLGLEGKASSADKADVADKGKDLTTLGMGAFVGVGYEFPFGLELDLRGSYAFTNVFKEESDFKKTYLGITNKDHKTNLMNINLTAGYNFAVLLEE

SEQ ID NO: 13964 - protein, 692 aa, Rhodopseudomonas palustris
MNGRKIPVLLGTVAMLALATAPALAQDNQGMAETLRLDEIVLTGEKQARSIKDTASSVAVLTTRDLEESGGQDSIADAATGIANVTYVASGGQGGAPTIRGQDSEGPNSGAVAFFGGTAPRLAFNLDGHYLGYNEIVWGSQALWDVESIEVFRGPQTATQGANSIAGAIIVKTKDPTFQPEGAAQLEYGSHNRRRASLMASGPLSEDLAGRIAVDYWARDNYIDYTNPDFAVGSTDQNHESRTIRAKLLWQPKDLPGFEGKLTFSHSLTNRPNWEAATEPYEDLESATASNPSWRLRTNTTILDVSYDFGNGWTVFNQLQYSDIWVKRSTEPVNAGTAILDQDVTSNETRVTFGSPEDRISGVAGLFVSRTDSDELLDYRGTTTYDDRKDSLGIFAETTWRLADRWSLTGGLRYQRDDITRRGVSSFTPNVLDYDESFDAWLPKLALAYDLDASTRIGAMISKGYNPGGVTLNLTSGEYVPFDAETSWNYEIFGRTRLLDDRLELTGNLFYTQLHDAQRYVVTSLPENIGSSITVNAERAKSYGLELGMDYLVRDNLRVKAGLGLLHTEISRFTSAAADYQGHRFGRSPDYTLSLAADWDITPEWRLSGQLRHTDGYYSDDNEDRDTWVDSYTVANARLTWQPRENLQAFAYVNNLFDDRSVTYLRASRSIGGFEATVVEPREVGIGLKVTF

SEQ ID NO: 13965 - protein, 530 aa, Rhodopseudomonas palustris
MLVSSNVTMQFGSKPLFENISVKFGGGNRYGLIGANGSGKSTFMKILGGDLEPTLGNVSLDPNERIGKLRQDQFAFEEFTVLDTVIMGHKELWEVKQERDRIYALPEMSEEDGYKVADLEVKYGEMDGYSAEARAGELLLGVGIPVEQHYGPMSEVAPGWKLRVLLAQALFADPDILLLDEPTNNLDIDTIRWLEQVLNERDSTMIIISHDRHFLNMVCTHMADLDYGELRVYPGNYDEYMTAATQARERLLADNAKKKAQIAELQSFVSRFSANASKSRQATSRARQIDKIKLEEVKASSRQNPFIRFEQDKKLFRNALEVEGLTKGFDNGPLFKNLNLLLEVGEKLAVLGTNGVGKSTLLKTLVGDLQPDSGTVKWSENARIGYYAQDHEYEFENDLTVFEWMSQWKQEGDDEQAVRSILGRLLFSQDDIKKPAKVLSGGEKGRMLFGKLMMQKPNILIMDEPTNHLDMESIESLNMALELYQGTLIFVSHDREFVSSLATRILEITPERVIDFSGNYEDYLRSKGIE

SEQ ID NO: 13966 - protein, 368 aa, Rhodopseudomonas palustris
MKKLLLFVPLALFATVGDNLVGAGAKSRGVAGAGIASYQGAESIFINPSLISFAQRSSVEIGTTFFMPKVYANGYKSRADFELIPYFGYIKPLDRESTVGLGLFSVSGMGVEYPVSSLAYMKTQFGYAKLIGAYAKQWGNLGIGIGCNISYGALRIAARMPNQLGDRLSKDIGFGLNVGLHYSWEDITLATTLTSPVSMKYSRVFDFNHDGKKESFHLTQPAEAGVGIAYHKNGWFVMGDYKRIFWSHAKGYKDFNWKSQNVYTIGIQKRFANFSVRTGYSYATKVMNGFTDSNVEGVSFRAQDIAFFNLVGFPAITRRHISVGMTMGLKPYKINLAWLYAPKEHLSSGSLQASNRQSSLTIGIEYSF

SEQ ID NO: 13967 - protein, 464 aa, Rhodopseudomonas palustris
MSTFIKKLNNSLNPCFILESSPGPTRSGYRLHKEVAMKAKLLPSILLMSAIASTQPAFADGREEGAYFTGLLGYTFFDHERQIEDDPSLAAGLGYNFTPAISAEVLIGAADLERKHNAGYLDSVFYRVDALYHFNQGEAWRPYLVGGAGNYRFKHDGGGKDEETQYNLGAGIKHAISDSMDVRFDARGVYGDEDETKDAMLNLGFTYMFASAAPAPKDSDRDGVYDDEDACPGTPYGATVDARGCEVIGDADGDGVTDDKDQCPNTKAGARVDATGCPVVGDDDADGVPNEKDQCPNSPAAAKVDSRGCPLDTDRDGITDGLDACPDTPYGAKVDNRGCRIQLSETVTITLNVTFPTNSAAITDEFVSEVEKLAEFMRQYPDTKAVVEGHTDDRGQDAYNQKLSEKRASAVRQMVVERFGIAGERISSVGYGETRPIGDNNTADGRSANRRVVGVVEATVKTNQ

SEQ ID NO: 13968 - protein, 713 aa, Rhodopseudomonas palustris
MSLPTPFPPSLLSASLVSSLALATMATGGAAAASNEPAPYGTTDIITVRGDYRATDLSSATKTPTALVNVPQSITVLSREQIDDQAFTDLADVVRFVPGVSVGQGEGHRDQITVRGQNTTADFFIDGLRDDVQYFRPLYNLERVEILKGANALMFGRGGGGGVINRVTKTPVAETTFARGEVSADSFGGAMVAVDANIATTDAGALRFNAYAEHLENHRDVFEGDRYAINPTFSTDLDPNTTLLLSYEFVEDERVVDRGIPSLGGEPVEGFHDTFFGSPDANTTTLKAHIFRGRIDRSLAEGWSSNLTLQYADYDKLYQNLYPIGIDPAAATVSLDGYRDETDRQNFIAQANLVGEFATGPLQHTLLIGTEFTDQDTDNARRDVFFADTADDQITFGLSDPLSIPTFSFPSDTRNRRSNVQVSSLYVQDQIDLTDRVKLIGGLRYDRFDIDALDRLELLDGSADGNDGRLSRSDEEVSPRLGVIYKPQDSASLYASFSRSFLPRSGDQFLSLTPSSEALDPEVFENIEVGFKWDLRPDLSLTGAVFRLERDSGTTVDPDDPDNTILISGLTHGAEIQLAGRLTPQWTVSAGYSYLDAKEDGRVVDGQDADRDLAQVPEHMVSLWNRYDLSDAFSLGLGVHHQSAQYATIANSVELPSYTRVDAAAYYLVNDRLELQLNVENLTDETYYPSAHNQNNISTGEPMNARLTLRTQF

SEQ ID NO: 13969 - protein, 684 aa, Rhodopseudomonas palustris
MSDVIIVTATKKGYGENLQNVPVAVTAFGEAQLDAKFVQNLQSLSYDVPNVQLEGVGTAPGYANFTIRGLGINSTVPSIDPTVGVFTDGIYLGINAGVVLDNFDLEGIEVLRGPQGLLFGRNVTAGAVVMRTTRPDFNFRASAKASVETGLKKTVSAMVTGPIAEDVLAAKLAVYYSKDEGWFRNQFDQSSFGKSRDIIIRPALSVKGGDNFRMDLRYEHGDIDGDGAPVQSHAIFPRDTFGISIDFPGYYNATWNQAIAETNIDVGLGDGVITNIMGYRQFRSRAASDIDGTPQHFFNGYFNINQEQISDELRYSGKIGAVEVTTGLYYFAQDLAYAEQRDLLGGARIVSGGGTQDQTTWGAFASADWHFSNTLTLNIGGRYSWERKAVRIAPLGANGCDVNTLRCATNFIDDESWKSFTPKLGLQWQPDNQTQIYGFYTRGFRSGGYNLRNTDPGVPPGPFDQETQDSFEIGAKKQFGRSRLNIASFYNQMKNLQREINLPGPLGVSQVIRNTADATITGFEAEGQFFIMPNLVLSGQVGYVHGKYRNIQFDISGDGVINDVDRDLKLPRLSPWTYGAGLTYDQTLGSAGTATARIDFTHRDSARFTDNNAGFLSPADMLDASLTYKTADQIWRFSVYGRNLLNEVTYGGDTPLPAAFGGPGASLSPLNKGRTIGGEVALSF

SEQ ID NO: 13970 - protein, 218 aa, Rhodopseudomonas palustris
MCRCLTRLIKQGRKGLAPNTPTAFTGILAKNYSAGLETKMAKLTLQEQLLKAGLVTSKKAAKVERTAKKSRVQAREARAAVEENKKAQLERDKQLSEQQKQAALAKEYKAQVKQLIEMNRITIANGDIGFNFTDGNLIKKIFVDKLTQAQLINGRLAIARLLVDNNSEGEYAIIPASVADKIAQRDASSIVLHSALSAEEQDEDNPYADFKVPDDLMW

SEQ ID NO: 13971 - protein, 1123 aa, Rhodopseudomonas palustris
MRHIFCRIAGVVLVWGTLSSLPAQVFNAQVTGEVTDATGALVPNARLTMTNLATKTVVTTTTTDAGVYRFPNLAPAEYKLNCSVGGFKSFEQGPITLQVNQTLEVNIRLQTGDATEQVTVSAAPPALETESSTLGQIVTTRSIENLPLNIRDAFALVALTPGVVLGGNFGNAGGSDVGRNFFKSDFNVGGGRSGSQEILLDGAPDTTPDINRGVINPPVDSVQEFKVQANSFDAQFGRTSGGIVNMITKSGTSTWHGVGYDFERHSVMDANSFFNNRSGLAKQSFQRHQFGANVGGPVWKGKWFAFGDYEGLRQAYPASTINTVPTALQRSGDFSQTFAGNGALIQIYDPNTLVSLPDGTRQRSAFPGNIIPSNRINPVGAAVLAAYPAPNLPGNAVTGASNYIFASKSVTNSDKYDIRNDINFNESNRMFVRFSRQEDARLVPGTMPLPVGGGRQTSDHYTQAMADATHVFSTNTVADMSFSFTRALAYQFGRSQGFDLSTLKLPASYISQVVAQFPVFSPSDSVSTSNGADSFVQFQPRNVWAVLGSLFHQKGRHALKVGGDIRLLHFNEGQNSNASGNFSFSRLFTQGPNPTQASTNGGNGVASLLLGDASGGSLIRINPISTQSTYYALYFQDDWRVNSRLTLNLGLRWDVGVGDREKYNRLAYFDPYVASPLAAGAGLPGLKGALGWIGQGNPSNQQSTDWRNIQPRAGFAYSLTQKTVVRGGYGIFFLPRNVQGNGDGAVEAVRTTSMVATQDNLNPATTMSNPFPAGLLPPLNDRDPLANTGSSVAAPVYTFRNGYSQTWSFGVQRQLPWGLVADGHYWGSKSTRLQVSWNINQLPDQYLSLGTRLNDLVPNPFASQGLGGVLSGATISRQQSLLPFPQYTAVTQVFAPAGNSTYQAGTIQLEKRLSAKLTLLGAYTRSKAIDDVRTPQDFYNRRLEKGLSAFDAPNQFRLSGVYNLPFGRDRSFGKSMNPVLNAILGDWDINGILGIQSGQPIGIGRPAVNNGKSAHLDNPTIAKWFDTSVFSVAPSFTFGTVGPVLPDVRTDAQRNLDAVLSKNFLIHVKERVVRAQFRSEFYNVTNHPQFGGPNTSVSSLSFGIVTAQNNNPRDIQLGLKLSF

SEQ ID NO: 13972 - protein, 447 aa, Rhodopseudomonas palustris
MKRILAGVALIGTAVSAQAADLATKAPYYKAPIVAVYDWTGFYVGVNAGAGLGRDRAIQNFAPGLTSTTYLQPFGALGGGQIGYNYQTNSLFGPLVIGLEGDFQGADLSDTRTTLSGPVNYSQKLDWFATARGRIGIARGPVLNYFTGGFAAGDVRTTVTEGGFTAFDSGKRTLTGWTIGSGVEAALGGNWTGKIEYLHLDLGNKTDSFLGQTLQTSVRENIFRVGLNYRIGGNGLYAPAPVANWTGFYLGGNFGSAFARNRTTASIGPFSEQFNLGLDGFAGGGQVGYNWQASNWVYGLEADFQGSTQRDNDTAVLFGLAAYDAKLPWFGTVRGRLGYSLGSTLFYGTGGYAYGNVKTTITAGTGSETISKTASGWTAGAGIETPFTLLGLVGPNWTSKTEYLYVDLGSTTSDFAGGLAPNTIKVTEHIFRTGINYHFNSPVVAKY

SEQ ID NO: 13973 - protein, 671 aa, Rhodopseudomonas palustris
MSSRFHAASRPHRRFHAMLASSCLMPMLSLATGVAQAQQQSTTLPTIVVSPTGLATPVDQIASSVTVISAADIERDQRRTVGDALTMVPGLNVVRTGGSGGLTSVFMRGTNSNHVKVLIDGIDAGDPSKPSGAYDFANLLTADIERIEVLRGPQSGLYGSDAIGGVISITTKRGQGPAKLTGMVEGGSFGTFNQTARAAGSDGNFDYAFNVAHYRSTEVAVTPLDLLAPGQKRNNDIYDNLSYSTKLGLQASDDLAFNFVGRYTDAHKGFTGDDSSHWPNSFPEVLQSTTASRDLLTRSEAVWSPLDGRFKSTLGVSYSNLWNRTNNPNPDYPISYTSYGVGPATFYRGERTKVDWNGVVDAGYGQKIVLGAERQDDKIHTDSVGGYDLLGNYQQSMTTASTGDSAGFVELQSAFTNNFFLVSNVRYDDNDSFGGHTTWRVAPTFILPLTETKLKATYGTGFKAPTLMQLYVNTPYTIANPALRPETSKGFDVGFEQPLFHNRVSFGATYFNNEIENLIENSVVSGQWTYDNVGLAKTYGVESFVALQATETLRFRADYTYTQTRDEKTGQRLRRRPDNKVTLAAIWNPIERAMVSASIVHTSSWLDYDRFGTALLDAPAFTTVNLAANYTIDQHVTVFGRIDNLFDKTYEVPVGFLQPGIGVFAGVRLTN

SEQ ID NO: 13974 - protein, 701 aa, Shewanella frigidimarina
MVFKYSIVGLAVGAALMAMPVLADDATDANIERIKVTGRTFNDYKVGSASGAMRGDINLMDTPQSVNVIPDFVTDEQLATNLAEVLVNDSSVTAGTTRWNRQVFSIRGFEIDSGNGYLINGHQQWSHYVQPIETLQQVEVLKGPSSMLYGQSGPGGLVNMVTKKPTYDSMLDLGFDTDGYGSTRAQLDAGGSLNDAQSIRYRGVLVKQDTKYWREYSTTEENQERDRWLGYLNLEFDVSDDVTLSVKYDHTQDKAGIDAGGWLDAQGNVIGGRKTVWDAPWAFTDNTISNLGADITWQMTDDWKVKVGYNDQQFDRQRFDSAPVYTADPFTNGYRISPFDRYDDWQHKTAFVDFTGEFSLAGMEHQFLIGANYLDYFYQQQIKRGTAQTVIPGQVVIKPELDYHQGNLSIPSEYKYYGFYLQDLMTLNEQWKLLAGVRYDEQKKDGVGGNSYAVSPKFGVIYSPMSNGSIYVNYSKSFAPKGSVTSSEDVNEGDNLKPEYGTQYELGTKWELFNDSLLLTAAVFDITVSNVVIELDSPIPSKKTMTTQGGEQHHRGFEIGAQGQLGDSWFVTSSMMYLDAEYNTGAGKIGGKSLDGKTPIDAPEWSANIWTRYEVTDNFAMNFGAIYVGERFADDVNTITKDGYVRFDIGAAYTMDIMGKDVSLRANVRNLFDTEYLDGGSDRMVTIGQDRNFSVAVEAKF

SEQ ID NO: 13975 - protein, 383 aa, Shewanella frigidimarina
MKKTLIAAGLLSAVAISAHAQSSVTLYGTLDAGLVYSNNQGGHSNWQQGSGSVSNTYFGLRGSEDFGGGLHAIFTLENGFNLNNGQNTESNTMFNRQAFVGLQSDQYGALTLGRQYDSVVDYLAPLSEAGAGYGNNLAAHPLDNDNLDNSFSIKNAVKYTSANYAGLKFGGLYGFSNSAGDFSNNRAWSVGASYDNGPLSVAAAYLQLNQSGSSNLSGAVSQGDGTAAVAANLQRTYGAGINYTYGPATVGFVYTHTQLDGITGVDVGGTTLPGVAGTNLHLDNYEVNGRYALTPDLSLAASYTFTDGKMSGSNGSGDPKWHTVSLQGDYSLSKRTDVYVEGVYQHASGELGNFGSNVAAINTLAPSSTGNQVAAAVGLRHRF

SEQ ID NO: 13976 - protein, 670 aa, Shewanella frigidimarina
MLKLLWKTLLVSPAFMGIVLASNSAAAEGATQSEFQFNQSATEGVELAQAQDELLQKLENYSQEGNSDSNDQVTSVSELRDVSPTDWAYEALRSLVERYGCIVGYPDRTFRGNRATSRWEFAAGLNACLNTMERLIQENVAVLREDIEKLKRLMQEFEAELAALGARVDNLEGRVAFLEDHQFSTTTKLVGEVIMAATAAGGSRSSEDNQAVLQDRIRLSFNTSFSGEDLLVTRLSASTGTGQDRFTLTEPNLRVINPATGQPIGIAFEENTLINPTATQTFNIGPRRNEQDNDVTIDWVGYYAPIEPLNNFKIDTYITAWGGRWHHFVPTLNPFFEDFDGGKGSLSTFAQRNPIYRIGGGAGAGMSFQVGFLESLLGPTSVSFGYLAGTANDPCLNGGGQNPDGSIRGCQSGNADNPATPGFEYAESDGGNGLFNGNYGALAQINTNLFDVVNIAFTYVHAYHKPDSPIFGSGIPFGPGEVGTSFANFSRSELNNAFAGGSIGSPGTSTPDYNSEADGQGLLPVNPFDIGGKVTNSYGGQFTWRVAEWMNFSAFGSFTNVRFIGRGLSAEVWTGGGGFAFPDLFKEGNLLGIFAGVQPYHGGRNRPTTANFFELPSRNPVTAEVFYRYQVTDNISITPGVIWIANPDQFVNIQGADDEVIGTVRGTFSF

SEQ ID NO: 13977 - protein, 387 aa, Shewanella frigidimarina
MLKLKFCIVISFLILGSACSAIPSSGPSAKKVVSLGQQSEAQIPEVELIDVNHAVAQSLYKAQVNQSFTQFGDGYASTGTLNIGDVLDIMIWEAPPAVLFGGGLSSMGSGSAQQTKLPEQLVTARGTVSVPFVGDISVVGKTPGQVQEIIKGRLKKMANQPQVMVRLVQNNAANVSVIRAGNSVRMPLTAAGERVLDAVAAVGGSTANVQDTNVQLTRGNVVRTVALEDLVANPRQNILLRRGDVVTMITNPYTFTSMGAVGRTQEIGFSARGLSLSEAIGRMGGLQDRRSDARGVFVFRYTPLVELPAERQDKWIAQGYGSEAEIPTVYRVNMADAHSLFSMQRFPVKNKDVLYVSNAPLAEVQKFLSFVFSPVTSGANSINNLTN

SEQ ID NO: 13978 - protein, 811 aa, Shewanella frigidimarina
MIISIKVKYNIIFSIFLFFFLQLSSAQTVTVLDEETNAPIPGVALYNFKKSKSLVTDSNGKASLDSFSINETIYFQDFLYEKRQFKKSEIAKSNNVVYLKLKVEGLSQIVISASKFEQSKRDIPQTIVSIDAKEIALSNPQTSADLLENSGNIYIQKSQLGGGSPMIRGFSTNRLLISVDGVRMNNAIFRGGNLQNVISIDPFAIKNTEVTLGAGSVVYGSDAIGGVMSFYTKKPQLSYKDELFLNGNALVRYATANKERTGHFDINLGYKKWAFLTSVSYTDFDDLRMGSNGPIDYIRSEYVVRENGEDVIVENPNPLVQIPTAYDQINLMQKVRYEPSDNLNFDLGMYYSSTSDYSRYDRLLRYRGDNLRSAEWNYGPQQWFMGNFQVTKLSSNSNLYDKIQATVAYQNFKESREDRDFQSSIRDIGEESVDAISLNVDLEKKINTKSSVFYGIEYLHNTVDSEGFEENIETDQSMPDVTRYPDGSTWQSMAAYASLKYKPNSKFVFQSGLRFNQVIAKADFVDNNVFLNLPFDDAEVNTGALTGTAGITWLPSDMIQWKLNASTAFRAPNIDDIGKVFDSEPGSVVVPNKNLEAEYAYSGELGLKLNFDDKFILDMATYYTFLDNALIRRDFELNGETEIMYNGELSTVQAIQNASKAWIYGFEVGLEINFSEQLKLHSQYNIIGGTEDNNGVEEPIRHVAPNFGRTHFTWQNKKFLVDAFLVYNNELSFNQLAVSETSKDYLYAKDENGNPYAPSWYTLNLRTQYQWNDKLSITASLENITDQRYRPYSSGISSAGRNLIVAIKYTL

SEQ ID NO: 13979 - protein, 632 aa, Shewanella frigidimarina
MTTKNTITIKKYTLLTALSVTAFSGWAQGNTATGNKDEMVVTASRFKQPVSTVLAPADVVTRDDIDRWQAKSLNEVMRRLPGVDIAQFGGVGQGSSMYIRGTEARHVLILIDGIPLARTGIVNSVNLDQIPISLVQRVEYIRGPRSAVYGSGAIGGVINVITQTDQEGAQINAGIGSKGYQQYDGSVRQRFGDTLATLAGGYQTSNGYNIKPDSPNPIDNDRDGFRNKNFWAGLEHQFSQEISGFIRGYGYTNNSDYDIGSLSSPAYSGDEERLYNHTYDAGLRYASGAYSSQLIGSYQKYKDYNFSSQYGRYGVATTLDNMDQRNVQWGNTYSFESGTLSAGLDWQQQRLTSSSQTISDTYKRDNTGLYLSGQQKIGNVTLEASGRGDKDEQFGWHETWQTAAGWEFVPDYRVTLSYGTGFLAPSLGQQYGSQRFDIISNSDLKPEESRQWEAGLEGVTGPLDWRLSAYHNKIENLIDYSFDNSIFKGHYYNVNSATIKGVEWTGNLTTGIFTHGVTLQYIDPRNDLNNEVLARRSKQQAKYQLDWTMFNLDIDISYQYYGKRYDNSTSAYSSTQRELSSYSTVDVSAGYPVTSHLTVRGRIANLFDKEYETAYGYKTAGREYYLTGSYNF

SEQ ID NO: 13980 - protein, 145 aa, Shewanella frigidimarina
MLTDNIGIDLLAATPFSHDISLPGVGKIAETKQLSPSLVVQYYFGHAESKLRPYIGGGVNFTNFYDNEFTNDLDGALSDLSMGNSWGLAAQVGIDYQVNKNWLVNASIWYAQISTEVKFNLGGSPTTIETDIDPWVYMVSVGYAF

SEQ ID NO: 13981 - protein, 620 aa, Shewanella frigidimarina
MKKTVLSVSALFLACTAVFAQQQDETENLDEVVISDSRHALKRENSGKTVITISSEEIKKNQGKTVAEVINTKSGIEILGSRSNAGQNLSYFVRGGNNRQVLIMIDGIQVNDPSSISNDFDLRLIALDQIESIEIIKGASSTLYGSGAATAVISITTKKASEDNIALRVNSSFGTNQSQDDSDYNINDFSNSARIDGTVDNLSYVVGFGHQNTVGLSAVIGEESDRFSRINTNVRIGYKFSDAFEASIFGNMDKFKNDFDNSSPRVDANFTGESEQYRFGIAPKYTYKNGSVTMNAAYTKIDREFRSNFPSTFEGETIALDIFNKYNFSNKFYTVVGLNYIDNQTVFAEEQSSSIVDPYVNVVYVSDFGMNVNAGGRLNNHSEYGTHFTYNLNPSYRMPLGKGYVKGFASYSTSFIAPTLSQLFGNFGPNPDLEPEENTTLEGGVEVKLSKKLRASAVYFNRKEENFIDYVVTDFTTFAGEYQNVEDEFTVNGFEFEVFATPIENLTIDANYTFTEKKDVKVLRIPKHKANLNVGYAFSSKTNAGLSYQFTSERLDTDFTTFQDVTLESFNLIGANLNHQFSKRLSAFVNVSNIFNEEYTEITGFTTRGTNVRVGFSLNL

SEQ ID NO: 13982 - protein, 685 aa, Shewanella frigidimarina
MDSEMKFKYSAIVIAFLSAKSAVANEVTELELTKVKTDKEIASEVAGKELELKQVNDLKGALNVVAGVSVGNSTRYGQKTYLRGVEEHSANITIDGVRQDGQLFHHSGNQVVDTSMFKAVSVELGATSVLSGYGANTGAISYQTKDPTDLLAANEAFAGSTSIGMDSATEFKQFNFSVYGRVNQQFSLLAMLTANQSGDIKTPNADPIVNKHSELKSGLVKAVYDIDSAQKLTLNIQSVEDGGNRAFSGEKPGMSELEKEELYNGHNRDTYSMVYINDSIDPLIDLYVNVYLNEKSMNREQSTGKNEVRDAKGQWQVDGTIFYPERDYFYKTTGLDIRNTSHINGLAWTYGIESFKSEQRIEAAALQKTTKANGDVTTRDMSVNNGPNARLMSAYVQTEFGVGGVTFIPGVRYDSYKLGGVYDLSFNEFSPKFTAAWQASRDLNLRLGYGKIFKGPGLPEVLMINNTISQADNVEAEKGAHLEFDINYDLSNILGLQSAAAYANVYQFTIDDSFHPTKNTSLANGRFDMKNNGVEAGFRFNHQQLSGYINYSYNDGERDYNEYKTDDLYSGSHEVNVGLTYQASDEWVFGWYNTLVSNVSLSDTYVNRQGELVSDPIEKVGYGVANIWLSFEPKAVAGLRVNLAVDNVFDKAYQNHKSFGMYWGNAEYNDNEVGRNIKAAVSYNF

SEQ ID NO: 13983 - protein, 110 aa, Shewanella frigidimarina
MMMKKTLLLCAFLVGLVSSNVMALTLDEARTQGRVGETFYGYLVALKTDAETEKLVADINAERKASYQQLAKQNNVSVDDIAKLAGQKLVARAKPGEYVQGINGKWVRKF

SEQ ID NO: 13984 - protein, 261 aa, Shewanella frigidimarina
MNRTISSALLASSLLAAAPAMAGDIFQWQSNSLTYLNGRDFAVNPENQQTFTFEHADSWKYGDNFFFVDKIFYNGKKDATAGDNTYYGEFSPRLSLGKIFGQKFEFGPISDVLIAATYEFGEGDNESYLIGPAFDLKIPGFDYFQLNFYQRQTEGNRPGDGVWQITPVWSYTIPVGKSDVLIDGFMDWVVDNDKTSRGTYHSNLHFNPQIKYDLGKALNYPERQLYVGIEYDYWTNKYGIKDTSSFDTDQNTASLLVKVFF

SEQ ID NO: 13985 - protein, 916 aa, Shewanella frigidimarina
MKTKPSFTVNKLSLAIASLISVASVFPALPVYSQDAVKIEHSEINAQSTETAQSTQSTESSPSAQGESFPIEPIEVISVVGRLRTSASAATEERREQVNVTDIMGAEQIARTGDGDAAAALRRVTGLTLKDGKFIYVRGLGERYSSTSLNGATVPSPDPTRNVVPLDMFPASIIESLSVQKSASANAPAAFGGGHVDIRTKSIPADFFFKASVGGRYNTNDTDDALGYSLDNSGLGKDDGKRAMPDAIANTTNQYGGISPIDIVTGSQGGINYPAAQQLNRELALGMHRDMTVQAQDSSPGFKGDIAIGDRWDLSDEMILGVISAFSYKKQQDNYRKKELELDGDASNINIENQKDIMGTDSIVQVSGMVNLGLEIGYNHKIETFTTYLHDTSDDVSMGIEETIDTLGEPNALQIFGIGYEERSLISNQIKGHHFIEYLNDAEFNWKFSDARSERYAPNEMSYTYNVILDDANKVLSRNLNTQDAPKYVYSRLEDDSQNYGWDVSYPINFDGALVKITTGYEYFERSRESYATRLGFDVDLSPSDVNGGILSQDFNQIFSNANISSDVLGLELKDASTDTEDYIAAEMNDAAFISLDIDFEDVWRVYAGVRYEDFRRVTLPIDPEGKISDEGGRYQLDDYAIAEDAWFPSISVTWKQTDTTQWRLGASKTLVRPDLREVSPVRFQDPVTGFDFFGNPELKSSDIYNLDLRWEYYSDSGNNLSVGAFYKDVDAPIEPIQRISEAGRQLKFYNAESGYIYGIETEFLQQLGFLGDEGSLWEDFFIAGNLTLGDSAIDIASNGEIDPTHHSRVMTGHSKWVANMQLSYDSSDDYHSATLVYNIFGERIAYGGRGGLDDVFEQPFNSLDFTYSFFPTDSISIKLKAKNMLDETTEYKQQGQLVYAKEPGTEYSLQFSYEY

SEQ ID NO: 13986 - protein, 720 aa, Shewanella frigidimarina
MMKMSVLKAALAAGVAMGVMPTMAWAQSAPAEEQATPATDGLVVIGQRQQYRGDVPLSALPQSVQVLDSKTLQDLNITRFDAALELTSGIAKQNNFGGLWDAFAVRGFAGDENFPSGFLVNGFNGGRGYGGPRDASNIEKIEVLKGPNGAVFGRGEPGGTINIITKKARTDETFGSFSLLGGSWNNFRVEADYNLAITDTLAVRLNGAVQDGDSFRDTVHQTKYVASPSILFKPSSDTSLSYEMEFVDNKVPFDRGVLAIGGKLGVIPNSRFLGEPGDGPIRVKVLGHQLQLQQKIGGDWYFLAGVGYRDTSFNGYGTQAELALGRQSLDNDGTNLTRQRILRDYNTTNTSVRGEISGKLYTGPFTHHVLVGADWDRFHIDVLQKRYRPPSYTPGSAFTAANNAINVFDPVYGQLPTVTAVQQNTDEVQKAYGIYFQDQIDITDRLKVRVGGRFDHFDQTILNRTTSKLSKVTFKQFSPTAGALFKITEDLSIYGGYGEGFRPNSGVDFFGNSFAPELSKSYEVGLRFAAPGDAITASVAAFTMKKNNILTADPNPDHTGSSIAGGAAKSRGLEFDVTANLPGDISLIASYAYIDAFWTTESSDKDFGLTIQPGDRLINVPKHSANVVLTKGFLIGGHRFSFGGGVNYVGKRLGETATTFELPGYVLARLTASYEPADNVKINADVTNLFDKQYYAASYSKFWINPGAPRAFNVRATFSF

SEQ ID NO: 13987 - protein, 250 aa, Shewanella frigidimarina
MKKICLLATLVLSQNVFADDIVQWWDVSATVLHGENYDLAPSERQTTITLETAGGWKYGDWFAFQDFINFNGNNNGVDSTTYGEISPRFSASKILGQPVSFGAIKDVSLALTYEEGEGPVNSMLYGIGVDLDVPFFSYLQLNTYRRDAISSGNISDGWQFTPVFRIDMPVGNANIIFDGFIDWVFSADNNGYDENLHINPQIKYDLGKTLFGDHKQNKLLVGFEYDYWQSKYGVAGIDQNTYSIIAQYHF

SEQ ID NO: 13988 - protein, 793 aa, Shewanella frigidimarina
MEHVEVIGQAVSIDEALKDQRSSDSVKSVVHADGIGQLPDDNAAEALQRIPGISVERDQGEGRFVSVRGIAPDLNSVTINGTLVPSPESKRRAVALDVLPSELVQSLSVVKTLTPDMDANSLGGTIEVESLSAFDHDGLFYSISGEGSYDENVEKTSPKFSGAISNRFSLGDGVDNFGVAAALSWQERKFGSDNVETGGKWDFADDGARLEEFEQRDYEITRERTGFGLNFDYKPDDVSSYYLRTLYSRFKDTETRNAAGVEFEDAQLPGETGDAEGWRELKSREETQTIQSYVFGGERMMGLWTLSGRVGYSQSRERNPGGISGATFEGDFADAGFSSSRKPRLTVDSAFYDPASFELDEVEWEKSDTRDREKNIRLDLARDYDIQGYAAQAKFGGKLSRRHKDNDSEVWVYDDFDDLTLADFQGGNVDYALGRFGRGISASAIKGAIAGLDASEFYDEEESRINDFDMHEDINAAFLMNTVDVDRWRVIAGLRYEGTRFRAKGTGMRDDQFESISSSNDYHHWLPGLHVRYQLTDDTLIRAAWTNSVVRPTFGQLAPGFVIDGDDAEFGNPDLKPLESVNYDLGIEHYMGRAGVVSAYLFYKDIDNFIYNTDLAGTGQWAAFDEALSFQNGSSAKLYGLELAYSQKLDWLPAPWNGLLLGANATFSKSDADIEGQGMRRSIDLPNHSDTVGNLMVGWENDRLNLRLAANYKSDYLYEVAGIDDKAHDLYVDDQLFVDFKAGYFITPSLQLTFEALNLTDESYYVYTGRRSYNAQYEEYGPTYKLGLTLTHF

SEQ ID NO: 13989 - protein, 758 aa, Shewanella frigidimarina
MKQNTIKMSCIALAISSALAAQYAVAEDENSTGEKQATLERIEVTARKSIESLQNVPVAVTSVSADDLAENGISVMTEIQQFSPNTTLQTSRGTNSTLTAFIRGVGQEDPLWGYEPGVGIYIDDVYIARPQGAVLDILDVQRIEVLRGPQGTLYGKNTIGGAVKYVTKKMSGDAELNLNATIGSYNQQDYKIAGQLPLIDNKLYIGGAFASLNRDGYGDFITSALPDQDTENYNKDVMAGRVSLEYTPTDNLFMRLNYDKTTDESNSKGGYRMLPSILTDAPVPDSKYDSYTSMPTWNKVETEGWGLTIEYGLNDDWTLKSVTSSRESYSPTNIDFDNTSLRIFDVPAIYDDEQFSQEFQANYDGDDLKLVSGLYYFKGDSCGVFDAILYEYYKAYGGLTREVRGCNNSESYAAYAQGTYNITDKLSMTAGLRYTRETKDATVYNGVMFTTLYPETGWIPGYVRDEDAINASIPKVLDDEETWSKLNPRLGLEYQLSDDMMLFTSYSQGFKSGTFNPRASFAEPAVDPEVVDSYELGMKSEWFDRLRVNATAFYLDHKDRQFVTVLPGENAADLNQRLGNIGQSKATGLELEVEYAATESLNLFATLGLIDASFEEVLSYDDDGNRIDISDTYTITNTPDTTANVGFSYNIDTDIGSFVANGNYYYRSDYDLAVVDNLLSQDGYGLLNLGLNWYSNDGHWHAGLHWKNVTNEEYLVGNYAFVTPDGNGGYTPGLGGDNTLIGYYGDPETISLTVGYNF

SEQ ID NO: 13990 - protein, 280 aa, Shewanella frigidimarina
MMQPVINAPEIATAREQQLFNGKNFHVFIYNKTESISGLHQHDYYEFTLVLTGRYFQEINGKRVLLERGDFVFIPLGSHHQSFYEFGATRILNVGISKRFFEQHYLPLLPYCFVASQVYRTNNAFLTYVETVISSLNFRETGLEEFVEMVTFYVINRLRHYREEQVIDDVPQWLKSTVEKMHDKEQFSESALENMVALSAKSQEYLTRATQRYYGKTPMQIINEIRINFAKKQLEMTNYSVTDIAFEAGYSSPSLFIKTFKKLTSFTPKSYRKKLTEFNQ

SEQ ID NO: 13991 - protein, 756 aa, Shewanella frigidimarina
MPISYLSAAQIAALATTTVQTLSTTKMEGLTRTQVGALSDSAIGVLNATQVSALTSTQVKGLTATQIPAFAQNLLFDVDQLQAFSGAQLNALTSTQLAKLDADRLQALSAIQIGAMDATRFTALDATQIAALSTTQLAQLTTTQIAAFSATDLEELSAEKIASLTGTQISALPADLVPSLQGARLSALSTTQLQRMTATQVAALSTTQIKSLGDTLTALGDTQIGALSSAQTGVLSDAVVAGLTGAQLGALSTQGLSGLSATQVAGLTGTQLAGLKPTQLRALSENNLAEFTAAQMRQFSTAQLSALSTTGLNSLAADRVQVFDATQLTALTTTQIAGLTGDDLAEFTPTQVEVLATTQLAALSPTVLNGLGRDQVHALTATQLKSLSRTQIGGLSETSMAAFTPDQVQVFSTTQLNALSPRAINSLSASQVQALTATQLAGLTTTQIAGLSTTGFDKFSSTQLKAFAPSQLAALEATNFNRLGASTIHALSASQLSAISTTQLNALSETDFARFTTTQVASFSGEQIGALSTTSFNGLSPSQIAALSSTQLAGVSATQMAGLTDTDLAELSTTQFAALTGTQIGGLSTRHLTSLDQTAFQALTAGQVSGLSASQLSTLSMTDMGEFTTTQMAALTPSQMMAISVTNLAALSADQYAALTPSALRGLSSFQLRNISPGAFSQLSQTQVQALNASQLGSLSTAVIASLTTTQVGYLTPTQIPGLTINQLDWLSTTNIAAMTPLQVGAFTPAQVESLG

SEQ ID NO: 13992 - protein, 175 aa, Shewanella frigidimarina
MDVNLTYRLPAMAWGNVTAGLNRTYLTHCDVLPDTTDPSSVTIHNVGRYTQAYGNFPRWRALGTLSWALNDWSATWRIRYVGHNAIGNSDPDQSLSADSSEPTVVRNIGAYVYNNLQLGYNVEPRHTRFEAGVANIANKQPPLYYSNNVGNANTDVATYDLLGPFFYWARATVKF

SEQ ID NO: 13993 - protein, 1036 aa, Shewanella frigidimarina
MLSVWKNNVLKKKEMRIAEKSRQAGVKYGRDSACYRVLTMWLLLGFPITLWAAEDFRTAEYERNGAALDSINAAEAYGLGFSGKGVGVAVIDANGELGGDEFTGRVDSGAGWISSPWDGAFHGYAVAGVIGAAKNDNGIHGIAYQANLLPLGTTFSSQTLVNAQLNVLDRPDIKIVNNSWGYRIFNDTVQTFSVDRQIELLDGIINNNMVIGAEMARQGQLTVFAAGNEGHLTPSIISGLPTLLDAYGIENTIANNWLNVVAYDPSQRPSSAAFIASFSNLGLGSSAYTLLAPGVNIVSTTDANNTDTFSGTSFATPYVSGVSALAAEAFPYLNGKQLADILLSTATPLSGENTPRAVLLIRKNYDDRQNYLNSELDVYATGNAVTFNDEEMTAFLARVREDAFFDNLTDEQIRSAIRARANAQNINVLTTDDYQSLFGQGIVNAYKAVQGPGALNAQRLSNSDLSSGIFNGNYAIYGVDTQGYSSTWSNDIAQVKNTTSGSSLYQLDVGLRKQGAGALYLTGSNTYLGPTIVEGGSIVVGKVAQGSGSLAGDVWVQSSATLGGHGKIAGTVTLENGSTLSPGASVGTLTVGNVVFHSGSIYHYEIDEQGNADGLNVTQDAALAGTVVLNASSQSLGDRFTLLNVGGTLSGNFDGLISNSTQPFLQDTLNYGNKQAYLDVVRNNRAFNDVAISRNQRAVAQTIESQRGGAVFSAIANSRSEDTARAAFDNLGGEIYAASRAALLQRSRYVRDEINGALHDENAQSLWLSTWANNGQFDETAESSRVNHSGYGFLIGNGSPIGESSTLGVVVGAEKSKIKTDARAASTDVTAYHAGSYWGTTYSGIAWRSGLVYSYLDMDTERDIQMPGLISRAQADYHAHLVQGFAEGSHRFAFNDSLSVEPYGNLSYAWLDLAGGQEHGSAAALRWERQGSGAGYSTLGLRSEARWSSHSPIRLYADAGYQRRLTPDRTQTRLSFTQGGEAYTIRSATDDRDALLLRAGIMLAMKPNATLVLGYQGVVSDKMSENSAKMQFGLTF

SEQ ID NO: 13994 - protein, 314 aa, Shewanella frigidimarina
MMNVFCKTLLASALATATLASAHAAEPLTVYGKLNVTAQSNDVGGDATTTIQSNASRFGAKGTFELSNSLEAFYTIEYEVDTGDDTKENFKARNQFVGLKGSFGAVSVGRNDTMLKQSQGKIDQFNDLSGDLKNLFKGENRLAQTATYITPSFSGFKLGVTYAAEGDSDQQGQDGFSVAAMYGDSKLKKSPVYASIAYDSDVKGYEIVRASVQGKIAGLKIGGMYQQQEKTFDDGQAVSNDSDTGYLLSAAYKIDAVVLKAQYQDMENKGDSWSVGGDYKLGKPTKLFAFYSNRAFEGDENDDKFFGLGLEHKF

SEQ ID NO: 13995 - protein, 743 aa, Shewanella frigidimarina
MNKFFNACIVMTASSMFSLSILAQDVEEIVVTSALIDSTEITNPLYVINGDEIVNDATTSLGDAIDGYLGISMADYGAAVGQPIIRGMSGPRVKILKNGMVNRDVSGLGVDHLNDVDLNDIQQIEIVKGPSSLLYANGTIGGIINVVDDCIAAMNFEIPEVKIGYETQSVNDGSSEFVNLKRNINGFNINFGYKNSEFGNYDIPNGAILHEEEHEEEHEDEHGDEHEEDLGYVNNSDFAVEATKFGISKVGDWGYVGLSVDSLKSVYGIPFHGDEHEEEHGDEHDDDHGDEHGDEEEHEEERIFSTTDSESFTIKGSYNVNGDLVKKIDYTYRDSDYTLTEAHAEEEGHEEHEDEEEHEEHAPTNFINNATEYGAIFDMSNDVMTQKFSFNYVDENTSIFGEEAFMNPANNEVLTLGYFVGRDFDPFHLDFGMRLDQIDRSGTVTDEDHGDIDSYNVNENTNSFAISIGRDLTDNLDINLGFSSVERMPSVIELFMNGPHLATGRFEIGDPTLSSETSNNIDISFKFDNGEYFGYASFYINDVDNYITLMDEDDDHEMHGDEHHEDEDEDEHHEDEDEHHEDEDDHGHGNLIHANYIQEDAEFDGYEIEFGRTIDLGKGQLKLSFGRDVVNAKFSDGHNVPRINPSRNVYSLSYAQEDVVFKLDLKDVAKQNDFGESESATDAYQMLDTRITKTFNLNGSSNLKVTLFGKNLLDEVARNHSSFVKNEVPLPGRNYGIKFNLTY

SEQ ID NO: 13996 - protein, 488 aa, Shewanella frigidimarina
MHKNTNALVKAIRLATLAVIAAPASVLAGGFSLNEQSASQMGVANAGAAANPENATTVLFNPAGMSQLSGTNISFGAAVLDIDAEAKRAEARRNVPGVEVMADGELGGDIADPAVLPNFYMTHEVNDSIDVGFGIHAPYGLAADYEDDFVGRFFADKTELTAIAFTPSLSVNNGKGLSMGIGLNVIYAEGRLTRSQDLAGQVYPQALQAALGQGLPMAQADQFARQTVAGMDDPYADIEGDDIGVTFRVGFLYELDDRTQFGLSAQTGTELELKGDAEISGVPVPGQPGVTTTLSEKVEVPLAIPEAITVGARHRLTDDITLLAGATYARWSRFEELDIVSRESGGAVTNAPQEGAILSHITEEWKNTWQFNVGGIWQATPEWALKAGYAWDESPVDDYLTARIPSSDRHWLTLGAQWKDVQSGWTVDVAVGTLLFTDDPSFTERNYQHANPDQVANLPGTNIEDPSYYKAKYELSAWSAAFEVSKAF

SEQ ID NO: 13997 - protein, 727 aa, Shewanella frigidimarina
MSMLSRAPFLYALCIFVSSSVIANTDNEFDDLDALLNMPLESLADTKVVTATKTSLSLSDVPASVHVITSKEIERSSARSIADVLILAPGLHVAKFSDYDWTVSARSKNQGENNTLLVMIDGRSAVNPMYSGVNWDTLPVSLDSIDRIEVVLGPVGTMWGGNAVNGVVNIITKDAESAPKAQLSASTGNFDYKEFKAHHSGQISENTHLSGYIESLQHSPFTDTDEHFKELRHLKVLTERFGMRADYQNLQNTVSVQFGGIQSREDYQWLTYTPAFLEPATHKNDYDVFLTEMNSQELFAGFQYLHEKLNGDQWENQLWVTHSESDSTNEPASFTRIDLDTRYTFNTQDWGILTLGANARIIDEEYAQFSEKEQYFSPYIRTIDDHKFLNQSYGFYANWAIDVTDSTEITLGNRIQYANITEEWYSQPQIRALQKLTDNQRLWMGWGRAVITPSRLELDTQFQENSYCSSCAYTVNPDGSVNYYDYMMSYHYLGNRDLDMESVDTYEIGYRYWQDNQFQVSLSLFYSQHDNVRAYKGLGGNRYFTPDSSEHSSGTIIDDMFAQLVDPLSQETMGGEVSIQWQPIDVLQINANYSYKTIKGDCNGSICSSNELPILDLENTPNHYATLHVMWDIHPTVWVSSVVNYVSASEPDEALIKAYQSYGDDYTIWPEVITVDMSINWQHKPTWPSIKLSAENLGSDQLKEYPEQFGPFANGTQYYAELSWNFI

SEQ ID NO: 13998 - protein, 718 aa, Shewanella frigidimarina
MKPPLVPRPRRTAVAQAAQAAQAALWLLCGSAIAQTAEAPPGAPAASATPTLRQVDVVDSTAGAAATPARRAQSSSRLGLPVLETPRAVSVIDSALLEQQLATTERDVLRNAAGVSSRSEYAGSYSQFAIRGLWANNTYNYLRDGAKFVHLLDPPLFNIERVEVIKGPAALEFGQVAPGGLVNYVSKRPQADPLRSVKIGAGSHGWRNAEFDLTGPLNADGTLRYRLDGGASRGGSFVDGNTPRKQGLAGSLEWQLTPDTRWRAQAEYQSLEGVSTVGLAVPDPQNPRSADVLPVGTFYGEPWLRTDGHLRFYSTELQHRFTDSLEGRVHLSRNETFRNVNMVYPIGPVTGGQVARSYWLAPGQNYTSDTALAELRAQARTGPVRHTLLAGLDWRAIEGVYGARGTGNLGAVDLYQPVTGLVPPAASGGRAAVASDTRNTGLFVQDRIALGNFSLLLGLRHDRLKDAYTKPATDLSKTQPSAALSWQPLPASMFYVSHARSFQANSGTLLWGDRAAPPSEGKQLEVGWKQEWLGQRLLTTVSAFALELTNAPANDPEHPGYSVLTGRQRIKGLEVEAQGRITPGWSVTAQATFLDPKVLADTVPGANVGHRVALAPRRTASLWTQYRLPGVPGLWVGGGLVHQGDKFTANDNRWRLPGYTVVDLALGYQFGGGVRLQANLKNAANRRYYVDASTTAAGFAAVTPGEPRSLYVTLDYTF

SEQ ID NO: 13999 - protein, 218 aa, Shewanella frigidimarina
MQANLKFARPLAVALGLFALGGTAYAADVVQEEPPAPAPVAELPVASWAGPYAGLNVGYGFSGRTKEKDFDVSTDTKGFVGSVFGGYQWQQENFVYGGEAELGYNGVKGDDNGINSKAGFEGSLRARLGYAVTPEILLYGTGGLAGRSLKVEDTVLGVSDRATMLGWTAGVGTDIKLTDNVFGRVEYRYTDFGSKSFDGIGKVKATDNRVTFGVGMKF

SEQ ID NO: 14000 - protein, 782 aa, Shewanella frigidimarina
MTPLRAIRKATPLAIAIQLSLLSTVDITTGMAYAATAPATARYDIAADDLDKALNHYAVRSGITLSVDASLTQGKRSSGLHGDYTVEGGLKALLAGSGLQVKALGDNAWTLEPIPVLAEETLTVVGDWLGEARENDVFEHAGARDVIRREDFAKTGATTMRDVLNRIPGVYAPENNGTGSHDLAMNFGIRGLSPRLASRSTVLMDGIPVPFAPYGQPQLSLAPISLGNMDAVDVVRGGGAVRYGPQSVGGVVNFVTRAIPKAFGISAGVEGQHSPTSSQHNPKETHNLLVGGTVDNGFGSALLYSGTRGSDWREHSATRIDDVMLKSRYAPNEVHTFNSLLQYYDGSADMPGGLSRADYNADRWQSTRSYDRFWGRRQLASFGYQYQPDQQHKFNIQSFYTRTLRSGYLEQNAILTLSPREYWVRGIEPRYSQSFTLGSSAHEVGVGYRYVSESTHEVRYFTSTASKTLPSTNSPIDRETRAGTEAHAWYIDDRVDIGNWTITPGMRFEHIKSHQDNTLKSTGEAVSYNAPLPALNVLYHVNDSWNLYANTEGSFGTVQYSRIGKAAKSGKVEPEKARTWEAGTRYDDGALTAEMGVFLVNFNNQYDSNQTNDTVTTRGKTRHSGLETQARYHLADLSPRLEAVSVYARYAYVNAEILEAGDTYGNQVPFSSKHRGGFGVDYQPGNWTFNLNSEFQSSQFANNTNTVAESADGSAGRIPGFMLWGARAAYDFGPQFSDLNLAFGVKNLFDHDYYTRSNSDDNNKGIYAGQPRTFYMQGSLKF

SEQ ID NO: 14001 - protein, 721 aa, Shewanella frigidimarina
MSSVSSLSRLAVAIALGVSMQAAQAEEEAKELGTVTVVGDWLGEADQAVVQNHPGARSVVRRREMLESGAQNVRDVLRKVPGVQVQDNNGTGGSDISLNVGVRGLTSRLSPRSTVMIDGVPAAVAPYGQPQLSMMPLSIGNLESIDVVRGAGSVRYGPQNVGGVINFVTRAIPEKFSGEIGTTIEHAGHGGWKKLNQAFLGGTADNGLGVALLYSGVKGADYRDGNNDNDIDDVLLKTHWQLTDSDQLAANFHYYDAYADMPGGLTQAQYDDDPFQSVRDWDNFRGRRKDFSLKYTRQVDDLTQFEVLTYYSDSFRGSSIAARNLRTITSYPRDYHVFAVEPRVSRIFFAGPTTQEVGIGYRYLKEAMNERASQLALVDNVPTVRPGSDGHTYQDRTGGTEASAFYIDDKIDVGNWTITPGIRFEKIDSDWRDRPVLGLNGKPVQEKKRSKDYNEPLPALSLMYHLSDEWKLFANYSESFGSLQYFQLGQGGSGNDTAAGLEPEKAKTYELGTRYDNGSWGGEITLFYIDFDDELQYVSNDVGWTNLGATKHQGIETSGHYDFAALDPRLDGLSVYGSLTYTRATYEGDIPSFKGRDLPLYSRQVATAGVRYEVDRWTYNLDAFAQSMQRAPGLSTDSQGNFTHNYITEPSADGQYGDIPGYVTWNARVGYDFGPQASNLKLGLGVKNLFDKQYFTRSSDNNSGIYVGQPRTLFMQASVGF

SEQ ID NO: 14002 - protein, 257 aa, Shewanella frigidimarina
MTLTLRIVLALAGLGLLPLTPAIAADYDPPIYTDQAPDYVPVEVGSGWYLRGDVSYLVQKNFKNDEFAFTPASFDEKEDPIFASIGFGYHFNDYLRDDLNLGYLPGNKIGVGYDDPLSVVPPATSTVASANLKNYAYSLMLNGYVDLGTYVGITPYVGGGVGIVQSTRQLSANYFTNNGDPTDDFVQTDDKTKYSLAYTLNAGLAYQVSKNVSVDLGYQYFSAPDAEYVTAASLTSFPVHKGISNHQIKLGLRYDLW

SEQ ID NO: 14003 - protein, 227 aa, Shewanella frigidimarina
MYKSLFTASLLALAIAAPVAQAHQAGDIILRAGAITVDPREDSGNIDHAVLGKVPGSGATLDSDTQLGLNFAYMVTDHFGIELLAATPFSHDVGVKGMPGAFAGLNGKLGSLKHLPPTLSAVYYPLDKSSAFQPYVGIGINYTWFFDTELSSEAEGKGFRGLDMKDSWGLAGQVGMDYMLTDKLMLNAQVRYIDIDTTGTTYLAGDKVKVDVDVDPFVYMVGLGYKF

SEQ ID NO: 14004 - protein, 796 aa, Shewanella frigidimarina
MKLNIRTRRAISSQASGVAIAVAVAQVFIAASAHAQQAAQQSWHLASGPLDRTLVEIAQAANVRLSYDAGLVQSLKSSPVEGSYTAEAAIRQALRGTGLDLVATGSGGLTIQKAVAKPAAAVPLAASAAAASVGPVDTTLPLISVAASRDSGGTGFVAESSSTYARSDVPLSQTPKSVSVINAAVIQSQAAQSLSDVLRNASGVVTRPGPLGVPTYTIRGFAASNLTSDGLATVGSAPNVTPTIAISSVEVVKGPSAIVNGNSPPGGVINLVKKTPQAEPFHEIQVGYGSYGSEQIALDSTGAITADKKLRYRFIISGERVGQNSMGYDGERNFYFAPTLEWKDSTTDLTVGYERTVNREPVPPFTVGYAKGDIYRNYIDRPLGTPSDHFGAQTDNIFFHLEQKLGTALTFVSKGSYTRTEQTQQAWTTATPLSATNGTLFHNFDSVSDFYSWSFQNYLRAKFDIGAAKNTVIAGWDVLRYSQHQSDTTTSKFISIPNVFGSFTLPSPDTGNVMPNNTTYFTQTGLYLQDQFSYKNFHALASVRRDTYLTHATYAGNPPAGSHQNAYSPSLGLLYELTSEVAVYASYNRGFQPGQALQFGGGVLPPQISQQVEVGMKFNLLDDKLAITTSAYRTSFSNYNVNDPLHRGFSIPVGGAVSRGFEAEINGQPLPGVNVVGTYTYNDFVQPPAAKIGVNLPKNSASLWTTYNFQTEKLQGFGVGAGLFFASGQYIGSGSAYRIPSQVETDLGLFYRKKGYGLNLSIKNVFNRKLYYSSTSAAMIPMGPERTVMLTGTYDF

SEQ ID NO: 14005 - protein, 327 aa, Neisseria gonorrhoeae
MKKSLIALTLAALPVAAMADVTLYGTIKAGVETSRSVAHHGAQADRVKTATEIADLGSKIGFKGQEDLGNGLKAIWQLEQKAYVSGTDTGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGFYKRHNYTTEKHQVHRLVGGYDHDALYASVAVQQQDAKLTWRNDNSHNSQTEVATTVAYRFGNVTPRVSYAHGFKGSVYDADNDNTYDQVVVGAEYDFSKRTSALVSAGWLQRGKGTEKFVATVGGVGLRHKF

SEQ ID NO: 14006 - protein, 327 aa, Neisseria gonorrhoeae
MKKSLIALTLAALPVAAMADVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSGDNSHNSQTEVAATAAYRFGNVTPRVSYAHGFKGSVYDADNDNTYDQVVVGAEYDFSKRTSALVSAGWLQRGKGTGKFVATVGGVGLRHKF

SEQ ID NO: 14007 - protein, 313 aa, Neisseria gonorrhoeae
MKKSLIALTLAALPVAAMADVTLYGTIKAGVETYRFVAHNGAQASGVETATEIADLGSKIGFKGQEDLGNGLKAIWQLEQKAYVSGTNTGWGNRQSFIGLKGGFGKVRVGRLNSVLKDTGGFNPWEGKSEYLSLSNIARPEERPISVRYDSPEFAGFSGSVQYVPNDNSGENKSESYHAGFNYKNSGFFVQYAGSYKRHNYTTEKHQIHRLVGGYDHDALYASVAVQQQDAKLAWPDDNSHNSQTEVATTVAYRFGNVTPRVSYAHGFKGSVYEANHDNTYDQVVVGAEYDFSKRTSALVSAGWLQEGKGAEK

SEQ ID NO: 14008 - protein, 327 aa, Neisseria gonorrhoeae
MKKSLIALTLAALPVAAMADVTLYGTIKAGVETSRSVAHHGAQADRVKTATEIADLGSKIGFKGQEDLGNGLKAIWQLEQKAYVSGTDTGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGFYKRHSYTTEKHQVHRLVGGYDHDALYASVAVQQQDAKLTWRNDNSHNSQTEVATTVAYRFGNVTPRVSYAHGFKGSVYDADNDNTYDQVVVGAEYDFSKRTSALVSAGWLQRGKGTEKFVATVGGVGLRHKF

SEQ ID NO: 14009 - protein, 327 aa, Neisseria gonorrhoeae
MKKSLIALTLAALPVAAMADVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWGNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 14010 - protein, 327 aa, Neisseria gonorrhoeae
MKKSLIALTLAALPVAAMADVTLYGTIKVGVETSRSVAYHGAQADRVKTATEIADLGSKIGFKGQEDLGNGLKAIWQLEQKAYVSGTLEGWGNRQSFIGLKGGFGKVRVGRLNSVLKDTGGFNPWEGKSYYLGLSNIAQPEERHVSVRYDSPEFAGFSGSVQYVPNDNSGKNRSESYHAGFNYKNSGFFVQYAGSYKRHNFTTEKHQVHRLVGGYDHDALYASVAVQQQDAKLTWRNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 14011 - protein, 840 aa, Shewanella frigidimarina
MNNKNTFSRDKLSHAIKNALSGVVCSLLFVLPVHAVEFNVDMIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDTGITGFILDYNVYASQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGIEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 14012 - protein, 908 aa, Shewanella frigidimarina
MLLFKPSLLTLALVAAGASMHGYAAEETKTTASADENIEVISVTGIRRSLQESQSLKMSSSSIVEAISAEDIGKLPDVSIAESLARLPGVSAQRLDGRANVISIRGLGPDFTTATLNGREQASVNDNRGVEFDQYPSELLNRVVVYKTPDASVMAQAIGGTVDMQTISPLTHGQQAIAVSLRGEMNDLGSLNSGSSDKGYRGSISYIDQFADDTIGIALGYARMMSPNQEERWQAWGYPNLDYVDTNPKVLGGAKPFVRSSELERDGVLAVFEYAPNDAFRSVVDVYYTKFSDDQRLRGIEIPAQWGTNGGVTATTTTDGLVTAGTIKGAEVVVRNDVNKRDADSLSIGWNNKYHINDNWSVTADLALSKADRTDIGMESYTGTGRGTGIGAVDNLGFASNGDGGYIFTPNLNYADPNLIKLGDPLGWGSPLGANTQDGFINKPQVEDELTSLRLSAEYLFDEGAVKSVEFGVNRTDRDKTKLDKGYYLTLKGYDGSANYLESVPSQYLLSPTSLAFFGMGDVLSYDSLAFYNDGNYTETDVANVDLSRATNSWAVYEEVTTAYVKANLESEMFGLPVTGNVGLQAVMTDQNSDGTVATVENGKVIITPRNAGDSYTEWLPSMNLGFEVADKQVVRLAAARTLTRARMDKMNSNVNFSYNANPNDGVNWTGGAGNPELRPWLARQYDISYENYFSDQGYFSVAVFYKDLENFVFDQQALFNFGAIFPNQPGNPIGTVTQPLNGQGGYVQGVEASLSLDFGQFADVLSGFGTILSGSYNDSEVKETPDSDPTALPGLSEKTFNATVYYENEGFEARISSRYRSDFLGEVTKISLQRENVNIKAETVVDAQIGYDFSKSGIDALYGLSVQFQVNNLTNEPFISYTGDDQRFVRDYQNYGRNFMLGANYKF

SEQ ID NO: 14013 - protein, 381 aa, Shewanella frigidimarina
MFTKHTHLSVPALPWRATAAALALGLGAGLAGAADEPSVQIYGIVDIGVLTQSKSGTSGRLTQVATSGYRQSVWGFRGKEDLGNGLKVFFNLETHFDVDTGEFHGTGDAAGSGPILFRRQANLGLSGDWGQVAFGRQYGPALLAHLATEPRAFKEQFSNIYLFAYNQYAATLGPAPAGINANNDVGIFLKNAIQYRNAFGPVQVGLAYALGEAAGSLKKNSVVAAGVTYTGPVVLSFSYQNMKDGTTGEPVVKHVGFGGAVPIGDFTLKANYLNVKNADPSGAELSDVDGLSFGVDYDWSPKNKLTVAYYDNEDQRNRSDAARSLVISNDYSLSKRTLLYVQGAYVDAKAGATIKTTIVAAGVPAQDARTTLLNVGINHTF

SEQ ID NO: 14014 - protein, 844 aa, Shewanella frigidimarina
MNKKITILFFLFLFSFLSSTHAQTLKGKITDAETNLPLEAVMISVLRGNTMIDYALTDAKGQFSLPWKHSGTLQLNISLLGYKREMRNINAAGTLNLSLQPEAIVLKEVQIRPGRINTRKDTVRYDLAQFASSKDVHIKDVLKKLPGVDVDENGQVKYKGKAIDHYFVEGMDVTGGRYNQINNNLSAKAVKTAEIMENYQSVKALKGKINSEEVALNLKLDPKARDQWIANTTLGAGWSDDNDKLLWEGGLNALQLGKGKQSVYNYKTNNNGKDLSNEQTILTGSGWQEVPLSGFLAQPGISAPLDKKRLLFNETHTLNGNRMYKWNEDRSLRMQAGYTHDVIRQQRGNTQIYYQPTDTIQIDETYHYRLRSDAANLELRYEDNSNRNYISNRFTMDGEINHGRSEELRQTLRTSRLSAGNYFNLIRNRENSTWEFRSATQYAYQPASLLLEEGKSKFNQHSFYTDNSAAYLRKYNGFTQQYKAGIQGERATMKYIPPTQPNDFNASNLSLYFNPYFQLQRGKGLATLSLPLKAQRYFSQQRSFLFFNPSTYLRYKLDYHWTFSLYGSLKRSAGDFSDLYPGLYQTDYRTWRSGNGLFPTSTTQTYNLYGEYKNTVQEFFVTASLTYSRSNRNTLFEQSVSENAIVYTQRELPNHSDSWNLSSTLSKGIYDWHLKTSLTLLLSRSNGEQLTRLTDSDQQSLLQTYRYDYLKAEPKIIWSPADLFEAEYHATLGYGGSKIGSDTRLSPLLDFVQRLHLTFSIGQVDLRLSGEHYRNDLGEHTHLNTVFADASLIYKRKKWRLEASLNNLFNKKEYAYTTYSATQSYTSRLNIRPREVMATVNYQF

SEQ ID NO: 14015 - protein, 387 aa, Shewanella frigidimarina
MKTRSTVMALMLGCPLAAAAQSSVTLYGVADVNVEYVNRVGAVPVATNGFNPGPGDKVFRMASGGLSGSRWGLRGAEDLGAGWQASFVLESGFSLDSGTMQQSGRLFGRQAFVALQRAGIGQLSLGRQYTSIFEALANFSPTAYATQYEPVVLQAGANFREDNTVKYTGQFGPLTARAHWSFGAGLALPQTVGIATPIGGNGEVPGQFRRDTAYGASLAYGTGPFGATIGYDQWNPTIGTSNGTVRKAVVAASYAFGPAKIMGGYRWGQNKNAADVVIQRDDYYWIGANYQVTPAVGLTLEYNYDNVRSLFGNTQVANPWQLAFVANYAFSRRTDVYLSTAYARNAGLMLESLATVYANSLSLGNSYAAANGQRSMVGVALGMRHKF

SEQ ID NO: 14016 - protein, 1045 aa, Shewanella frigidimarina
MKNVIQSILGTFFFASLAVPVWSLPTDGMAASLREASVESTLEVQQQKGVRVTGMVTDKDKNPLPGVTIVVANVANPSGAVTDVDGLFQITVPAKNSTLEFSYIGFKKKSVSLNGSKLLNVVLEEDASELEEVVITGYGSQKKASIIGSIETIQPQQLQFGTSRTLSNNLAGKLSGVIAIQRSGEPGYDDSNFWIRGISSFSGSNSPLILVDGIARDLNNVDVAEIESFSILKDASASAMYGVRGANGVIVITTKHGQIGAPQVRVHVEHSINQPTKFPDFLDAPDYMTLLNQLAAQDGAILPFDQTRIDRTRSGYDPDLYPNVNWIDAITKDYAYTTKGNLEVSGGSDFLRYCIVASYFNESGILQQDKTLPVDNSTDNNQFNMRSNIDMNVTKTTLMRVNIGGFLNRFRKQRCSTDQAFSEAFETLPFVHPARYSDGSIPREMNRANPWRTATQGGYDFTTSSKIQTLFSVEQDLRQITPGLKAKGIFSFDRWNSSRRSRTSNTPTVHPATGRDAEGNLVYTSYDVGDESMGSETGTEYGNTNVYFEFNLNYSRKFGKNDIDALLLYNQQAYDDGSIQDYRKQGFAGRLSYTYDSRYVAEFNFGYNGSENFAKGHRFGFFPSVALGWLMSEEPWMEPLKNTFDKIKFRASMGQAGNDNIGGRRFAYLTTLKTDASGYTWGTTGQKNYDKGITEGEIGVTNLTWETATKSNLGLEVGLWNALDITVDVFREKRKNIFMQRRIIPTQTGFITNPWANYGKVTNGGMEVSINLHKQLNKDWFTSFYGNFTFAKNRVDEYDEAPSKIGTYRGQTGRSMNELWGLTAERLFTADDFESDGSLKFGIPKQEVGADKLYPGDIKYVDMNGDGKITEEDEGYIGGTEDPRIVYGFGGVIAYKNIDFNFFFQGTADAHRVIGNSTIFLPGSGTTVQGNAYSENLDDRWTDDNQDPYAFWPRLTYGPNKNNYRASTWWKKDMSFLRLKTVEIGYTFPKKWMEKIYSKGARVFVSGNNLLCFSPFKLWDPELGTNNGLKYPMNRSILFGIDINF

SEQ ID NO: 14017 - protein, 377 aa, Shewanella frigidimarina
MSNGIVIIGSGFAARQLVKNIRKQDATIPLTLIAADSMDEYNKPDLSHVISQGQRADDLTRQTAGEFAEQFNLHLFPQTWVTDIDAEARVVKSQNNQWQYDKLVLATGASAFVPPVPGRELMLTLNSQQEYRACETQLRDARRVLIVGGGLIGSELAMDFCRAGKAVTLIDNAASILASLMPPEVSSRLQHRLTEMGVHLLLKSQLQGLEKTDSGIQATLDRQRNIEVDAVIAATGLRPETALARRAGLTINRGVCVDSYLQTSNTDIYALGDCAEINGQVLPFLQPIQLSAMVLAKNLLGNNTPLKLPAMLVKIKTPELPLHLAGETQRQDLRWQINTERQGMVARGVDDADQLRAFVVSEDRMKEAFGLLKTLPM

SEQ ID NO: 14018 - protein, 224 aa, Shewanella frigidimarina
MKKTNALLGLAAAAMVASPAVAQDRAGDVQLKVLGTAVLPDGEIEDVNVDLVGLPAGTDTRATDNFVPTVAVEYFFTDNFSLETIAGVTQHDVDTVSGFPPGTELVSDALLLPATVTGKVHFDAAGFKPYLGAGVAYFMWLSDEPGAATLPLGVTDTDLTDEFGFVLQAGVDVPVGNDGFGVTLDAKRYFIGTTAQWFAGNTLVIETDHNLDPWVLSAGVSYRF

SEQ ID NO: 14019 - protein, 646 aa, Shewanella frigidimarina
MGTKPSLISLALATSLLSSFASAQSSVDEHLVVIGRQADTPLNIAANVAVITAEDIALSGATSLAGLLRGQSAIQISDSGTGPVLAMRGFSAGQAANNTLVLVDGRRLNNIDIAAPSLNAVSLSQIERIEVLSGSAGVLYGDQAVGGVINIITRRSQENTGGASLTGGSFGTLGTAMDVSAALNERWNLFVGGNFDKSDNYRDHAVSESGSVLGRIEYRGDGQRFFAEASYYDDDRELAGSLTAEELAANPRQANAANSSDYQHNLTKAGRLGYEHSLTEHWTLAADFDASDTQVNYISWGGAGETERQLISLTPKAIGRYQTEAGELKLVTGVDLSRGESEFTSAYMERGNTQEHWAAFAQASVPLTKSLSYVVGGRYAEVQDEIRDQSTFPLGGKLDNDAHALELGLNYRPVQGHRFYLRAEDNFRFAKVDEQAYTSQASLRPQTGRSYEAGWDYQGAQQALRLSLYRLSLEDEIVFDPSADTPVGGYFPGANINADESRRYGAMLDWDWQLNDTISLGIDYQYTDAEFTAGLNDGKALSWVAEHSGRMYVSAQFAEYWSAYVDAAYTGERFVEGDNANMGEQMDAFWLTNAAVSFRKDALIATLRLDNLFDETYAASGFYSDWGNGYYPGEGRKVSLTLGLKY

SEQ ID NO: 14020 - protein, 471 aa, Shewanella frigidimarina
MKLSNTAILALAISSITATAYAETQSQAFTPVTVNEKSAQAEATGFLEGQSISGSTRNWYANEQLKRGGKFTYRKDGVATPTDRRINWVQGTIVKYNSGFTEGTVGFSTEVAAYNAIALERDRENLASNNGGAPGTRPGAGNNRTLTREGGEAQGQWSKVGLANVKARISNTTLTAGRMNFSSPQVDVIGNRPLPSSFEGIAIHSEELNNLSFDLASFDRVSPRTEESLSKFRSEYGAIDAEADHVHTGGISYQPFASLTTSLWGTQAEDLWNQYYFGATHVLGDSSVLALTTGLNYYKTVDEGKKKLGEIDNDTYSLSFGLTHQAHTLTFSYQEVNGNEYFDYLHETNGIYLANSLLSDFNGPNEKSFQVAYGLNMAEYGVPGLKFNIYQARGWGIDGTHYKGGGYDGVQSMDGEHHYEYGIGASYAVQSGPLKATTVRATYTAHRASENQADGSINEFRLVTTVPFNIL

SEQ ID NO: 14021 - protein, 192 aa, Shewanella frigidimarina
MKNTILTLAAIISLASVSVYSHAENMKNNDVAENGIYVGANYGYLKVDGKDDFDDNSDVIQGLVGYRFNQYLAIEGGYVNFGDYGNSLSNAETDGYTAALKVSYPIVDRVELYAKGGQLWYSTDYDVLGFSGNKDDEGVFVGAGVAFKVTDRFLINAEYTWYDAGITVENVSNGADTDTDFKQASLGVEYRF

SEQ ID NO: 14022 - protein, 708 aa, Shewanella frigidimarina
MKPSPLATGITFALALASLPAFASAADAPASSVKDLDAVTVHAQLDQARNTLSPDIGSSQYRITAEDIQKQPLGASAPLSQVLLQAPGVVQDSYGGVHVRGDHANLQYRINGVLLPESISGFGQTLDARTIKSIRLMDGALPAQFGERTAAVVDITTRNGAELGNGGSAGLTTGSFGKINPNASWWGNQGRWSWFLTGNYDQHEVGLENPTNSRKPLHDDTHQGKAFADLTYLVNDNTRLSVFAGFANNRFQIPVNPGQTPQFGYLDTTTFDSSQLDETQRETTRFGMLVLQGTLGSTAYQLSAGQRYSDVAFNPDVVGDLVFSGVASQVQRSNRANTLQADFSTPLGNDHTLRYGLYGNYENARANSNSWVFPVDDGGQQSGTTPLLIPDRSAFHASTLALYVQDEWKIGDDWTVNYGLRGDRYKAFGRPEGQLSPRVGVVWNASDSTTVHAGYSRYFTPPASELIASSDIALYDGTTNQQPSGGNNTPLAERSDYYDIGVSQQLGEHLTLGLDAYDRRVARLQDEGQFGAAYIYSTFNYRHGHIRGLEFSADYSNGPFSAYFNAALNKAIGTDVITSQYNLDPEALAYVANHWIHLDHDQKLTSSGGLSYAFAGHNRIGANYVFGSGLRSDIEGVPNGGELPSYLQVNLSAGHDFNADSGHPLHVQLAVINALDRSYQLRDGGGVGVFAPQWGPRRGAYLSLQQDF

SEQ ID NO: 14023 - protein, 703 aa, Shewanella frigidimarina
MKSSNPILATVLMAVFSSGALAEDATLEEIQVNATSDKPGLNLKKQNNTGSRLGLTAKETPASVETLDIQTIRQRGDISIREAVTRTTGITDISTIGNGQSFSSRGFTGNNSVAQAEDGVRLMTGAGTLTYPSDAWGYERIEVLRGPASVLFGDGSAGGIINSVRKQPSRDASLEALVGAGSYGAYRAALGGTGAIGEIGAFRIDASVLGGNGYISRGDYDSKKLMTSFSFAPTDNLKIGFTLDHAEDSPTANLGSPLINGHLSRSLRSRNYNVADNKLDFVDSRARAKIEWEISPQLTFRNESYWFKSDREWRNAEAFMFQPATHTVRRSSFTAIEHAQKQIGNRAELISQQDWFGHQNRFSAGWEIMRSEFQHRNIHGNSSATDTIPAAGFNPGLFISLNPVTRNYDGTIRQQAFFAEDAFSLTNRWKLIAGVRKEFIHTDSEDFRNAANEVRDNFSPVTWRLGTIFDTSENTSIYGQISRGTDPVTNLLGLNLDNARFSLTRSRQAEIGIKQSLESIKGEWTLALYHIAKDDIITRDPVTPSTSIQGGSQSSRGIEFATTFYPVERWRVDFNATLLNARFDELREAVGSPASSVSRAGNTPLNVPEKVANAWVYYQAPAWEAGIGARYVGKRYANNANNVSLAGYTVYDASAAWHVNKQMTLRANIRNLTDKFYAALAYGSTQHIIGAPRQLEFTAEFRY

SEQ ID NO: 14024 - protein, 575 aa, Shewanella frigidimarina
MLFKLFWITISNVKKIIQCFSFILYICFCVEDVFAMYNNEECGVSNAQSVLENPAVAHPNTSPEFFIITEDFEKTEEEENTGCCPTISSEMYSESCPNPFCHPLEFYGTMRSFFSEGCHAQCSSFETVLTSGCIVFQWVGNLISSLFSEEDSSTGECQREKSCYEEGNFVSTPVITPPNPLGQQGSSSRCSSGSKIFSSSSGPIKESVFISSGYNYQDQRNALASMRHVLLDVSTQLSMTLRDLVLKGYQERLNTGEAYALTYNRGARLTRKPVKQMKYFSTSGSSMRHFNVFQALKLYQANGSIDSQKYSIEDKISPEQVGCIVDITSNVSLGIVYGHQKGKVKEYKGNVSSALGILGTTLDVDSFSTMVMFDLDKVGIMGSLSTCYGWGKAKNIRRFSRGGKEVHTKGSSSISSVGGLIHIGYPIDIRHGVSMTPYIEYMVSMVQRGGYQEKLGLLPCSFTDDMKIIHEKRIGLCSNWKPTPLTCLQIWIAGTSGMQKTKGVYSTLSVIPNQYMYTVSFPVQKEQYLQAEFGLSYQTALTETAHFYVNGTSYIKKVQKNYGGQHVFFQLRYTF

SEQ ID NO: 14025 - protein, 1061 aa, Shewanella frigidimarina
MHLNRVLRETGVVVAAGLLYGSAAFAQSSTIIGTVIDAQSRQPAADVVVTATSPNLQGEQTVVTDAQGNYRIPQLPPGDYTLRFEKEQFKPYARSAIQLRLNRTIRVNVELLPEALGEVVEIVGAPPTIDVGSTTMGVNVDQEFIKRIAVARPGGKGGATRSFESLAELAPGAQNDNYGVSINGSTSPENGYVVDGLSTNDPAFGVNASPLSIEFVQDVNIITGGYMPEFGRSTGGVINAVTRSGSNEFHGSVFANWTPGTLEGTRKQIREEGTVITGQNQLQNLGDFGATLGGPILKDKLWFFAGFAPSFTRYQHTRTLNALRVDDEGNTIKDETDFTVADAIPGSARKYYADSRTIQYMGKLTYLINQDHNVSFALNGTPTSTGGLGKLSVNPQSGGLPGVLATRPGDFGLTETKANTTSLALKYAGAFADKKVLVDANLGWFHQTASTLPGDGSNLGDRTGLAGYSRMVYTTPRALTLFEALPEGQEGACGSTPEEQLVRSPVTGYGVGGPGFMSDQTLDRYQANAKATYLLNALGTHVFKAGVDVELLSFDQVKAYGGGVFFQEGSNYGVAGQGPAVHDARRYGYQTGPDSAVTQFTQVAKTTSTTVGGFLQDSWSIANRVTLNLGVRYDVQALYGGNGDLSLLLGNQWSPRIGAIVDPFANGRAKVFVNFARYYEQVPLNLMDRAFPGENRISARRSLAEPGQGTATSCDPSSFESQQATCNTDSNLLAIPESSRNVNRFYTGGTVGGTPVDPDIKAQSSDEIVVGAEYEVLANTRLGASYTHKDMNSVIEDMSRDDGNTYFLGNPGSGFAGEFPTPVRNYDNVTVYLNRTFADGWLAQANYTWSRLYGNYPGLFRPETGQLDPNILSDFDLIELLENRTGLLPFDRTHQIKVFGAKEFNISNALSASVGVSYRGSSGTPINYWGSHWAYLQDESFVLPRGAGGRTPWINTIDSNIGVNYRVSKDSVVSFTLDVFNLFNFQGVNTVDQTYTLRDIKPIPGGTPADLENLPGRVEFQDQAPRDEPFGSVDGDVNKNFKNPLSYQAPRQVRFGIRYTF

SEQ ID NO: 14026 - protein, 244 aa, Stx2-converting phage 86
MKSIATLVVCAISGIACVNLSAHAAEGNHTISLGYAHFQFPGLKDFVKDATAHNRETFSHFVNRNYFSSLGEYTDGRVSGYEGKDKNPQGINIRYRYEITDDFGVITSFTWTRSLTNSQTFIDVQSADHTRKIKNPAASARTDIRANYWSLLAGPSWRVNQYMSLYAMAGMGVAKVSADLKIKDNINSSGGFSESNSTKKTSLAWAAGAQFNLNESVTLDVAYEGFGSGDWRTSGVTAGIGLKF

SEQ ID NO: 14027 - protein, 1364 aa, Escherichia coli
MNKIYYLKYCHITKSLIAVSELARRVTCKSHRRLSRRVILTSVAALSLSSAWPALSATVSAEIPYQIFRDFAENKGQFTPGTTNISIYDKQGNLVGKLDKAPMADFSSATITTGSLPPGDHTLYSPQYVVTAKHVSGSDTMSFGYAKNTYTAVGTNNNSGLDIKTRRLSKLVTEVAPAEVSDIGAVSGAYQAGGRFTEFYRLGGGMQYVKDKNGNRTQVYTNGGFLVGGTVSALNSYNNGQMITAQTGDIFNPANGPLANYLNMGDSGSPLFAYDSLQKKWVLIGVLSSGTNYGNNWVVTTQDFLGQQPQNDFDKTIAYTSGEGVLQWKYDAANGTGTLTQGNTTWDMHGKKGNDLNAGKNLLFTGNNGEVVLQNSVNQGAGYLQFAGDYRVSALNGQTWMGGGIITDKGTHVLWQVNGVAGDNLHKTGEGTLTVNGTGVNAGGLKVGDGTVILNQQADADGKVQAFSSVGIASGRPTVVLSDSQQVNPDNISWGYRGGRLELNGNNLTFTRLQAADYGAIITNNSEKKSTVTLDLQTLKASDINVPVNTVSIFGGRGAPGDLYYDSSTKQYFILKASSYSPFFSDLNNSSVWQNVGKDRNKAIDTVKQQKIEASSQPYMYHGQLNGNMDVNIPQLSGKDVLALDGSVNLPEGSITKKSGTLIFQGHPVIHAGTTTSSSQSDWETRQFTLEKLKLDAATFHLSRNGKMQGDINATNGSTVILGSSRVFTDRSDGTGNAVFSVEGSATATTVGDQSDYSGNVTLENKSSLQIMERFTGGIEAYDSTVSVTSQNAVFDRVGSFVNSSLTLGKGAKLTAQSGIFSTGAVDVKENASLTLTGMPSAQKQGYYSPVISTTEGINLEDNASFSVKNMGYLSSDIHAGTTAATINLGDSDADAGKTDSPLFSSLMKGYNAVLRGSITGAQSTVNMINALWYSDGKSEAGALKAKGSRIELGDGKHFATLQVKELSADNTTFLMHTNNSRADQLNVTDKLSGSNNSVLVDFLNKPASEMSVTLITAPKGSDEKTFTAGTQQIGFSNVTPVISTEKTDDATKWVLTGYQTTADAGASKAAKDFMASGYKSFLTEVNNLNKRMGDLRDTQGDAGVWARIMNGTGSADGDYSDNYTHVQIGVDRKHELDGVDLFTGALLTYTDSNASSHAFSGKNKSVGGGLYASALFNSGAYFDLIGKYLHHDNQHTANFASLGTKDYSSHSWYAGAEVGYRYHLTKESWVEPQIELVYGSVSGKAFSWEDRGMALSMKDKDYNPLIGRTGVDVGRAFSGDDWKITARAGLGYQFDLLANGETVLQDASGEKRFEGEKDSRMLMTVGMNAEIKDNMRLGLELEKSAFGKYNVDNAINANFRYVF

SEQ ID NO: 14028 - protein, 368 aa, Stigmatella aurantiaca DW4/3-1
MENHLQKTGNRTRNSHIKKRQWINMKKTLLALAVLAAAGSVNAAEILKSDAGTVDFYGQLRTELKFLEDKDPTIGSGSSRAGVDANYTVNDSLALQGKVEFALKDSGDMYVRNHILGVKTNFGKFSFGKQWTTSNDVYGADYSYFFGGTGLRYGTLSDTLHDSQVKYVYEADSFWVKAGYGFPEDNAKQELAELYVGATFGDLAVHAGGGQNRDKAFKVGSNTVGTTTTDIKADVTNSYFEVTGEYTIGDALIGVTYYNAELDVENNPLVIDEDAISVAGTYKVADKTKLYAGYEYVMQEANTGADEDGTLVYLGVEYKFASWARVYAEYGYGDGTTLGYTNKGSDAEVKATKVDSANNFGIGARIYW

SEQ ID NO: 14029 - protein, 749 aa, Stigmatella aurantiaca DW4/3-1
MKLRSDEPKLSKISTALCSMLAAGPAFAQSTAGTAPPDKEGRLEPIAVQGQADHGFKTDHSASVKFTAPLLDTPKSVTVIPQELIQSTGASTLTEALRTVPGITFGAGEGGNPLGDRPFIRGYDAQGSTFVDGMRDIGATTREVFNIESIEVTKGSDGAYGGRGGAGGSINLITKTPHLGNSADGSAGLGTDRYRRFTADGNWQMADHAAFRLNVMSHNNDVAGRDAVNNERWGIAPSFTYGLGTPTRVTASYYHLTTDDLPDSGIPYFYTTTNKPANVGTIYPADVDRHNFYGLIDRDFRKTTSDVGTLRIEHDINSDLTIRNTTRYTKSTQDYIWTQPDDSQGNVVNGMVWRRANTRASDVYSLANQTELFGEFKTGFLKHSFTTGLELSRETSMNDSYTVAAATGAICRTKGIGAASGYNCTSLWTPNPNDPWAGAVNQTNDPSRQRTVTKSLYAFDTMELTQRWQANVGLRVDDYSTDFRNTKANGGNSVSRDDTLFNYQFGLVFKPASNGSIYASIATSSTPAGALLGQGSETQSLTPGRGGVGANADQLSPEKNRSVELGTKWNVLNNKLSLTGALFQIDTTNARVTLPNNEYAMVGNKRVQGFEFGVAGQLTNKWQVFGGYTYMKSELRDNGRTTSDNGHQFPNTPKNSISLWTNYDVLPKFTIGGGAFYMSQVYGDTANLRAVPSYWRFDGMAAYRINKKVDLQLNVQNIFNRTYYDQAYPAHYASIAAGRSAFLTLNAHY

SEQ ID NO: 14030 - protein, 275 aa, Stigmatella aurantiaca DW4/3-1
RCYQRKDIHITDFYFLNTSGTGGGIENLSVGNQKLSLAIIQDGEDQNGAGYIADARLANIGLWEDASLEVALGINFSTESKNGKYDGDDGLLASGIIHQNMSNGFNQTVVQVGTAGYGIQMANFWGAGAYYDRSGDQNDASGYRVINWGVMNLGENWEMGHQLAYLAGSDLGTTKYDSSQYSIVARPMYKWNDTMRTIFEAGYNAGEVDDVDFGGAKFTVAQAWAMGDSFWARPEIRVYGSYLMDLENDSFGEVKNDTGVVTAAGTDNDFVVGIH

SEQ ID NO: 14031 - protein, 786 aa, Stigmatella aurantiaca DW4/3-1
MKRVLIPGVILCGADVAQAVDDKNMYMYFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRLDWLTSHIDENNKSAFNQGSSGSTYFSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGDVSHQPYFGAEYIYSDAWTERHNQSESYVINAAGKKTNHTIYHKGKGSLGIDNYTLYMADHISWRNVSLMPGVRYDYDNYLSNHNISPRFMTEWDIFADQTSMITAGYNRYYGGNILDMGLRDIRNSWTESVSGNKTLTRYQNLKTPYNDELAMGLQQKIDKNVIARASEAHDQISKSSRTDSATKTTITEYNNDGKTKTHSFNLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 14032 - protein, 200 aa, Stigmatella aurantiaca DW4/3-1
MNALKTLFIATALLGSAAGAQAADNFVGLTWGETSNNIQKSKSLNRNLNSPNLDKVIDNTGTWGIRAGQQFEQGRYYATYENISDTNSGNKLRQQNLLGSYDAFLPIGDNNTKLFGGATLGLVKLEQDGKGFKRDSDVGYAAGLQAGILQELSKSASIEGGYRYLRTNASTEMTPHGGNKLGSLDLHSSSQFYLGANYKF

SEQ ID NO: 14033 - protein, 99 aa, Stigmatella aurantiaca DW4/3-1
MSAFSSGKSAVKLSNGMVAQSSSTRSMIGTLGVNAGYRFVLKNGVEMKPYVSASVDHEFAANNKFRVNQEMFDNNLNGTRVNTGAGLNVNITPNLSVLK

SEQ ID NO: 14034 - protein, 302 aa, Stigmatella aurantiaca DW4/3-1
MQLRKPATAILALALSAGLAQADDAAPAAGSTLDKIAKNGVIVVGHRESSVPFSYYDNQQKVVGYSQDYSNAIVEAVKKKLNKPDLQVKLIPITSQNRIPLLQNGTFDFECGSTTNNVERQKQAAFSDTIFVVGTRLLTKKGGDIKDFANLKDKAVVVTSGTTSEVLLNKLNEEQKMNMRIISAKDHGDSFRTLESGRAVAFMMDDALLAGERAKAKKPDNWEIVGKPQSQEAYGCMLRKDDPQFKKLMDDTIAQVQTSGEAEKWFDKWFKNPIPPKNLNMNFELSDEMKALFKEPNDKALN

SEQ ID NO: 14035 - protein, 742 aa, Stigmatella aurantiaca DW4/3-1
MDAPKQKPRQSVQRAQASPSRAVQRRAETRNRPPPTTAPVPYVTPSTGTIGAPPAPYAGGQVASGGGLGLLGNRGVMNTPFNQTSFTAQLMQNQQARTIRDVLINDPSVRVTQAAGGGADGLFIRGFFYDSGDYALNGLAGIAPYYSTGANFIERVELLKGPSALLNGMTVGGTGASSGGAVGGSVNLITKHAPDVDITQLTGTYASKSQFGEQIDVSRRYGEHKEWGVRLNSSYSNGNTPWNRQTDELGNVALGLDYRGENARLAVDIGYQADNLKPPLRFFGVGAVTQIPDPPKAGLNFQVPWAYYAPTDFFTTVKGEVDLSDRITAYASFGYHDSNINYSYPSPTLNSNAGALSAVPGQGKETYETFAGEAGVRVKVDTGPVNHAINVGYSIVDRTYNQRVLWPVSRPGAATAAAAGAISTSWNLYTEPVNAPAPNYNYVRLNQMTGVDLWSVGVSDTMSLFNDRLQFVVGARRQTAGTEVTDYVAAANSRPFKDASVWTPAYAVIVKPVDRVSLYANYVEGLQTPVIVPGTFANGGTVFPPTSTKQTETGIKVDFGRITTTASLFDISQRNAITVVSGSSSTQQLDGMQRNRGAEFNIFGEITPEFRVLGGVTYIHAVQEKTTNGTYDGKRAIGVPQLAVNLGAEWDTPFVRDLTLTGRVIYTSAQYVNQANTLSLPDWTRVDLGARYTFTSPWNGKPIVVRASVENVFNKAYWASAYSGVITLGAPRTYLVSTTFNF

SEQ ID NO: 14036 - protein, 372 aa, Stigmatella aurantiaca DW4/3-1
MFAPYYLQDNPTEHIVTLMKDITSALGMLSKPNLKNNSTDALQLNTYTQQMSRLAKLSNFASFDSTDFSERLSSLKNQRFADATPNAMDVILKYSQRDKLKNNLWATGVGGVSFVGNGTGTLYGVNVGYDRFIKGVIVGGYAAYGYSGFYERITSSRSNNVDMGLYARAFIKKSELTFSVNETWGANKTQISSNDTLLSMINQSYKYSTWTTNARVNYGYDFMFKNKSIILKPQIGLRYYYIGMTGLEGVMDNALYNQFKANADPSKKSVLTIDLALENRHYFNTNSYFYAIGGVGRDLLVRSMGDKLVRFIGNNTLSYRKGELYNTFASITTGGEVRLFKSFYANAGVGARFGLDYKMINITGNIGMRLAF

SEQ ID NO: 14037 - protein, 275 aa, Stigmatella aurantiaca DW4/3-1
MKISVPLTALALTVALNAPMVSAEIWGNTEVQLQALGELERVGTGGTADTTIITFQHAGGWEYGDNFFFMDYSRYSVNNDANFPVADSSELYGEWYSNFSLGAISGNDLSFGPVKDIGVVAGFNFAPEVDSAWVLPGVRFALDLPGFAFAQIDVTGYIHQGGGSADSPVFTVVDEDSSFMVDFAWAYPFKIGSTSWSIEGHLEYIDGRTQVNNFGTTELESWILFQPQIRLDLGEVLGQKAQRLFVGIEYQYWKNKLGEKGTDDNAAQLLAVWRF

SEQ ID NO: 14038 - protein, 375 aa, Stigmatella aurantiaca DW4/3-1
MAARPRKNNVSVPNLYPLYSRKVNKVYWRYKHPVTGKFHALGTNEAEAIAIATEANTRLAEQRTRQILAISDRIATSKGKAITTSTWLDRYQAIQDDRLKSGDIRLNTYKQKAKPVSLLRERAGMKLISAVDVRDIAQLLDEYIAAGRPRMAQVVRSVLIDVFKEAQHYGEVPPGYNPALATKQPRRKITRQRLSLEEWKKIFDIADATHRYMGNAMLLALVTGQRLGDISRMKFSDIWDDHLHVIQEKTGSKIAIPLSLRLNAINWSLRDVVARCRDYAVSAYLVHFFRSTSQAERGAQVKANTLTMNFSKARDLARIDWGEGSPATFHEQRSLSERLYKEQGLDTQKLLGHKTQQQTDRYHDDRGKGWSKVAL

SEQ ID NO: 14039 - protein, 958 aa, Stigmatella aurantiaca DW4/3-1
MRIATAPTCITERTTARRRKPPTQQTSRNGGRRQSITAPVYRTRVSPSNHASPNMQSFRPFHRLSCAIAAVLCAPSLAYAAEMTTTTLDSVNVQATHAAAPGSLNEQRLSNSVNSVMSKQQIDAIPSGGIADVVAHMPGLSSYSDMHLGQATTGENAYVSIRGMDASYNAYTLNGFGMPETDSSTRAISLNMLAPFGIQSVQVSKSPTPDMPGDSIGGAIDMRTPSAFDFDQDVYAKSTAQGQFNALANHLGGKDSGGTFQQELAWKFGQGDAFGIYASAYYGKNNNMAQAPAPNSKYVPADPALAAATDLRDVGPLISTRYKYSLYASQIERYGGNLSLDWQGDTSALYAHAIYGSYGVTGTQDQSSARLETYRNQPTAVRGGYFNTHDIDETLATLQLGGQTTLDRLHVDYGTSFGRGTRSRPDYVSASLYGFTPGSFAFDLSDPTYPSIGPSSPALKDFFYNLDSSLLWKVQGHDAGSHDNRFNAHTDIAYQVDGAVLDSVKLGLSADHSERDAYDHPFFHKDGNFVTNGPYFGGPNYAFPTAGGPPLSAIPGRITYNAFDGHYAGPFKLLDRGWMRAQALPYKYVDDPNGAGIYTANDYNANTTSSTEALYSGYAMAALHLGKVSILPGVRYELTQYSADSWQSSGDGSTGRFVGSGSTYGKVLPGISVNYRPDDLTVYRASLRRSFSRPAFGLVSGETVYSIDDTQKVVGISKPNPNLQASTADNADLSAEFYDHEGGVLSASTYYKRINGFIYTSQSATSNDSTLGGLVPTGTTFENGVPVTMPQNGGTAKLYGLELAASKRLQQLPGLWSNFGVTANLTLQHSQADSKRSDQPEKTWLPRAPERIYNLDLFYDDTHLRTDLSYNYTGLQLLGLTTDRLNYYLQPVKSLDFNATYHLPHHIDVGVSAKNLLNAATFYETQGKSKRYMAYDPGADGAYVQTGRTYMLTLGYTY

SEQ ID NO: 14040 - protein, 1742 aa, Stigmatella aurantiaca DW4/3-1
MWTVNKQRRFLADATGGRARLVVMFVLFAMTLLAPGWAMAQASTYCPTLNATVVQGGSVQIDVTTCDGTGVDDIGVGWNGVQPAHGTIVVPNPSGAQGTQIVTYTHNGDNATSDTFPLEDGRSDIITVNITITPSQPTLSINDVSVNEGNAGTSNATFTVSLSQPAGAGGASFDIATADGSAIAGVDYVASSLTGQTIPAGSSSATFTVLVNGDTLSEPNETFFVNVSNVSGAGVSDAQGQGTIVNDDALPSLSIDDVSVNEGNSGTTTATFTVTLSAASGQTVSVNYASADGTATAGSDYVARSGTLTFAPGTTAQGVAITVNGDTALEPNETFSVGLSGASNASIARATGAGTILNDDVVVTVGPASLPAATAGSAYSQNLSASGGTAPYSFAVTAGALPAGLTLSAAGVLSGTPTATGSFNFTATATDSGGSPTSGNRAYTLTVAGATVTLPATSLPAGTAGQAYSGALNPATGGIPPYTYAVTAGALPAGITLNGSSGALTGTPGSVGSFAFSVTATDSTSGTPSQGTRGYTLNIAAPPIVVAPSTLPAATRGTAYSQTLSASGGTAPYTYALASGALPAGLTLASNGTLSGTATVEGSFNFTVTATDAGSFTANQAYSLTVAGPNLVLPASSLPAGTAGQAYSASITPATGGTAPYSYALTAGALPTGVVVDVATGGLSGTPTVAGTFNFTLTVSDSTPSPAAQASRSYTLTIAAPVIVVAPTALPAATRGTVYSQTLSASGGTAPYTYAVSAGNVPAGLTLASNGTLSGTATVEGSFNFTVTATDANTFTASQAYAVTVAGPNLALPASSLPAGTAGQAYAATIAPATGGTAPYSYALSAGVLPNGVVLDTATGGLSGMPTLSGTFNFTLTVTDSTPSPAAQASQSYTLSIAAPVIVVAPTALPAATRGTAYSQVLTASGGTAPYTYEVNAGSAPAGLTLASNGTLSGNPTVEGGFNFTVTATDANNFTASQAYVLTVASPNLALPASNLPAGTAGQAYTAAISPVTGGTAPYSYALTAGALPSGVVLDAATGTLSGTPTVSGTFNFTLTVTDSTPSPAAQANQSYTLSIAGATLVPSQPTLPPAVRGTPYSQVLTATGGVAPYTYSVASGTLPAGLTLASNGVLSGTPTAEGSTSFTIAVADAGNATATQAYTFTVSTAAPVAVADTAATMSDAAVTVPVTANDTGNITAIAIATAPTNGTAAVNGLELVYTPAAGFVGTDVVSYTVTGSGGTSAAATVTIAVNARPIAVSVTAEAVPGAASQVDLTRDATGGPFVAAAVVAVLPASAGTATITQVGGAAAAAARTSGFVPAATAQASSPSFMLTFVANPAFVGQATVQFTLSNAFATSAAASVTFTVAPRRDPSVDAEVRGLIDAQSESTRRFAKAQIDNFQRRLEATHRGGSTLSNAVTFQPTSHCRQADRGISAQPCSPDTQDADNEFRDAPAMATGGTGGAQGQGDLGLWVGGAIRSGSLDRQANTNGVDFQTDGLSVGADYRLAPSLAVGAGLGWGRDDSDVGRNGSHSKATAYTMALYASFHPGKAFFFDTLVGYQLLSYDLRRFVTDDASMAEGSRDGKQWIASLSSGADLQRGNLQITPYARVDVARATLDGYVEDGIAPFALRYDDMDVATTTGNLGLRLEWRRDVAWGRLTPQVRVEYQRDFQGRGDATLGYADIIGGPVYRTGQNAFDRNRLMVGIGAALLTEQGLSTRLEYRGITDGDSGNDQTWMINLEKKY

SEQ ID NO: 14041 - protein, 903 aa, Stigmatella aurantiaca DW4/3-1
MERLMFKQSVISLAIATACLTASHTVSAEDVTAEKSVERIAVTGSRIKRQSATASPIQNIDLETLNANGSLSLGDALQELPSVGSSLNGNGSAGSSHGSSSLNLRNLGANRSLVLVNGHRWVNGAGSRGFRDFVDMNTIPQAIIKRVEVLQDGATAIYGADAIAGVVNLYTYDDYEGLEVKTTYGETTKSDRETFNIDILSGVNINDGNLMFAASHVDQKPIYTQDRNITAVPLNGLTSATPEGHFFEDNLATVNGLTPSSGGITRDPGKDGNNIDNWRKVNSDDTYNRYYNNYVTGPSERSSLYTQLVMPIGSVNFKAEALYNSRESDQQFSPALSPIRGSRGFVIADDARVNPFGVEFSGSDFKHNAFFMNNGYRVNEQKVETTRFAIGLDGELSNDWSWDSFASWASNKGEFTSNNQMNLDKLALGLRACDTTGIDADVTDLVSGCVPVNIFAPLTDDMVNYINFTGHDKNEASQLDFTANITGSLYELPAGYIGAAFGIEYRKEKGEDTPDSIINSDPRINTYRTTTSSPREGTIGEYDLKEAYAEFSIPLLDDKPLAEYLELSLAVRYSDYSTFGSTTNSKVGLLYTPFEQLTLRANWAEGFRAPSILELFEGERLTYKAVNDPCSTDNNLAGCSGVPTDYSQPFSNVQVTTGGNRQLVPETSKNKTVGLIYESNLIENLSFTLDWYEIEINNTISEFGAQNNLDLCAYQNKNCDTITRDSSGEIIDILDGPVNLNATRVSGIDFVSYYTLQTDFGDWSFNANVSKLNTLTEYSTLSDGSIEQEDLVGTAASRESYPEWRGTFSSTWKYNGWTANYNLRHIDSTTEQFLGEPRGIGSVTYHNISGGYQFANNLSVKLGVNNLGDKQPPASLTNLNINFDQNTYNPVGRYMYLQLTYSL

SEQ ID NO: 14042 - protein, 931 aa, Stigmatella aurantiaca DW4/3-1
MDAAGTVDGNYVNYSGFVYYNNANGDFDQTFNGDTVNGTISTYYLNHDYNDATSNELNISNSVIHGSITSMLPIGYYDRFDTLDHDGYSEYYRFNNGTDTVDGNWYDGDVFTLNIANSTIDDDYEAFYFTDSYKDGDVTKYTNETFDVSEGVAVNLDVESNINISNNSRVAGIALSQGNTYNNTYTTESHNWDNNINVFDSTVTSGSDYILDSAYTTDTGTFGTGHFGNSDEPSDYTGAGDVALSFTDDNGASDYAMKNNVYFSNSTLMGDVKFTSNWNANFDADGDDTNGDGVPDTNHGWADDGLNVDELNLTLDNGSKWVGQATYTVDTTSRMYDVETNSLTPGATLEDNAWNRIVGNEVFQSGVFNVTLNNGSEWDTVGDSTVDTLAVNNGSQVNVSNSDLTSDTIDLTNGSSLNIGEGGYVDTDHLTIDSYSTVGLTESTGWSTYSNLYANTITVTNGGVLDVNVGQFDTEVFSTDKLELTSGNTADHNGNVVSGVFNIHSSDYVLNADLVNDRTWDTTQANYGYGTIAMNSDGHLTINGNGDINNGDELDNSSVDNVVAATGNYKVRIDNATGAGSVADYKGNELIYVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 14043 - protein, 733 aa, Stigmatella aurantiaca DW4/3-1
MIKRRNFTLSPLASAIGQLLLGASAVLFTGPAGALTLVDDEQQIGASTPVDSYRVNDGGRLVAEGATTQQIDVRTGGGLQLEGSTVSATGVAAVMVNGGASATIANGSRLTSNLFGLDVLRSATAGSTVSVTGSHIEGGVGGARVAGSSHLSLTDSTLVSTGAAGAALLFGDARLDATNSQLTSATDGIRVVGDALSTEAASLNLQGSRVEGQNGAAIRVGSANQAPGDAAITISGGTTLVGSNGNLLEVANGSNATMLVEGSNLVGDVLVEDGSSAKLTLGNQASLTGRLTNVESLALNDGGRWNMVEDSEVAQLAMAGGAVRFGEATQYQRLTLGNLSGSGTFIMDADFSTGETDFLDITGTATGNHSLLVGSSGNEPTQENSLHLVHAAAGDAQFSLLNGPVDLGAFSYSLVQRGNDWFLDGATKTISPGTEAAMALFNTAPTVWYGELSSLRSRMGELRLDERNAGLWARSYGNKYNVSASTGTPYSQVQQGFSLGADTPLPWGDGQWLAGVMAGYSSSDLNLTRGASGEVKSYYLGLYATWLDAQTGYYLDSVVKLNRFDNQAKVSLSDGQRTEGDYDNVGVGASVEFGRHLALNDGYFVEPFGQLSVVGIQGKDYHLDNGLKADGDTTHSVLGKAGATAGRTLKLEGGQWLQPYVRLAYVHEFANNNLVKVNDHRFDNDLSGSRAELGMGVAVSLTERLQLHADFDYSNGKALEQPWGANLGVRYSW

SEQ ID NO: 14044 - protein, 802 aa, Stigmatella aurantiaca DW4/3-1
MIPMHTSNALSLAISVALTVCSFAASAQSQSAQPQKTLDTLIVTGTRVSDRTVAESESPIDMISEESLQATGATDVATALGKLLPSLNFPRPAISDGNDAARPATLRGLSPDNVLVLVDGKRYHTSALVNYNPYVGRGSAPADLNSLPMSAIARIEVLRDGASAQYGSDAIAGVVNIVLKHGAGTGTNSMSVNGGIMDKGDGAQNGIDGSIGLPFGTTSGDTAPGWVRLSWNYQNSMDTNRSENTNRATTLAGAANPSGVPYQRHGDPDARFYQGLAAFGYDVTPNLELYGHLSVSRREVTSNGYYRAYDNTDRNVQAVYPNGFLPQIYNPINDRSAVLGVKGATASDWHWDVSATYGKNDMTFNILNSINSNLYWSTGRSPTNFNSGGFETEQGTLNADFNKSFDWGLAYPVNLAFGAEHRQDRYEIVAGSPASYFFDPDTINPDTGSPYPGGAQVFSGLEPSVAGRFGRHSNAAYAALEANLTDKLSGGIAGRYENYSDAGATRSGKLSARYAFTDTFSMRATVSNGFRAPSLAQQNYASVVTLPENGQLIQVGTYRTSDPIAVQLGARPLSPEKSTNVGIGSVWQPIANFTSTLDVYQIRIWDQILYSDQIQLAQPIGQVGAVQFFVNGATSRTRGVDWVNSYLADLGAGGSLNLSASANYNKTTILELSNPNFGRASEGLLTESTPRTKYMLAADWTLGGFSLNGNATRYGAIKRISDPADGSQDQTYSARWILNLAANYTWQALTFTVGADNVTNQYPTKAQLTNGYDDRASGLQYSSLSPFGFNGRYWYGRVTYRF

SEQ ID NO: 14045 - protein, 763 aa, Stigmatella aurantiaca DW4/3-1
MPLAPPFAFRPWQVLMLLSPSLALADSVVPLTPTTITATRTEQAVDSVPNTVNVQTYKQLDRQNINTVKDLVHYEPGVSVGGTGQRAGISGFNIRGIDGDRILTQIDGVEVPNNFFNGSYAQTHRNYIDPNIIKSVEILRGPSSALYGSNAIGGAVSYFTLDPSDIIKDGKKVGARLKVGYSSANDSWLTSATVASRADSFDALLHYGYRNGHETASHGSHSGTGLSRTKANPEDFDSYSVLGKLGWDYTEGSRFGLVLEKFESNTDTDQKSAYGGPYFNGQPIVPPSLLPAGMYQWRKGNDRITRERYGLENHFLFDGAIAERIQWSLNYQLAKTAQSTHELYYPIRRKALRTRDTTYKERLWVFDSQLDKSFSFGQTDHLLSYGVNLKHLKVSSLRSGNAIDLDIGDNSPGDGLLPTSDFPNPIMKTFAVFTQDNIEWNDWAFIPGLRHDYTRLAPHITDEFLRSVQQNDNDNDVVDDSTKKWHRLSPKLGVTYDFTQHYTSYGQYAEGFRTPTAKALYGRFENLNTGYRIEPNPNLKPEKSRSFETGLRGKSDEGNFSVILFYNKYRDFINEDAVTPGCDKLTFQSNNIKQAIIKGAEFKSRLELSAFGAPQDFYIQSSIAYAYGRNKDNGQPINSVNPLTGVFAFGYDEAEDNYGGQFSWTLAKCKTRVDDSTFYAPDGTSDRFKTPGFGVLDLSGYYKLTKDLTLNAVLYNLGDKKYWLWDDVRGYDSAGEAAMLAPANLDRLTQPGRNFTANLVWNI

SEQ ID NO: 14046 - protein, 245 aa, Stigmatella aurantiaca DW4/3-1
MPARHLYFIMTNTWNRLALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 14047 - protein, 945 aa, Stigmatella aurantiaca DW4/3-1
MIVVSGSAPGLGANLATGPSTAFSLETLETAPSINRDVKDIVRIDPRVYLDANAGGTQGNDGILCAGANPRFNSLTVDGIRLNDAFGLNSNGYPTERIPFTYDAIDQVAVELAPFDVEYGSFTACNVNAVTKSGNNEFHGSVFIDYNDDTLIGNRADDEAFPTDGFTNKRYGGTLSGPLLKDKVFFFLAYEKQESSNLFGGNTPEAKGVSEADFARITQIASDLYGYEVSRLPTALANEDEKFLAKIDWNITDRHRAAFTYNYNDGFNNDPSDGDGNELPEFNHFYERGAELNSYAGSLYSDWTDTFSTEFRVSYVDLQNRQNSLGGLDQWGEVQIEVGDSTVYLGADDSRHANQLSYELWTYKAKADWVLGDHILTFGAEREDFDVFNLFVQEVKGEWIFESIDDFESGLFDSFRYENAAGTNNAADAAAEFGYAINTIYAQDEWQVNDKLNIVAGLRFDYYSSDDEPEYNPDFEAAYGFRNDETLDGKSILQPRVGFTYEYNPDLLFRGGIGLFSGGNPNVWISNNYSNNGVTLFDCRNRGRSGDCVGDGTLNNINDFTYTTDPRGVFYSVPDEFIQAVEDADGGGPVNALDPDFEIPAQWKANLGFTYDFDTPYAWAGGNYTLNVDLLYSKTHEAALVQSLDALFGSTSTAPDGRTVYGASSLNDFVLTNADDKAEAFSFSTWINKSHDFGLDWTLGYAFTDAEDVNPMTSSVAFSNYTNFATADANDPGTATSDYEISHRFTFNANYTKNFFSDLDTSFGVFGSVSRNLPYSYVYGNSAFDGSPLGDAFLTRQLIYVPDGADDPLVASAPQSFLDFISQDDCLDDNRGEILDRNSCTNDWWTQFDVKFAQELPGFMPGHNSEFFLVMENVGNFINSDWGVLRDQNFPGNRIVDVALDSGDVDSDGNTNEYVYTNFREDPNDGFVLPEPSLWSVRVGLRYEF

SEQ ID NO: 14048 - protein, 210 aa, Stigmatella aurantiaca DW4/3-1
MSGWETALAYRAESSASTSIDANVIVDQTIPDPGLALAVTTIDSFQPEIWVVGTQYKGDGWRIGGSVEQQNWSGLEDKFTSDTIKDQNSLSPAARMQFEDTLTPRLGGEYMLNDNFTFRAGVAYEESPLKTTRNPEINYLDTDKISVGLGLSATYNRTRLLAYPVRVDLGYQYQMLQERDFTIVDFNGNEEDVTADGDIHVFSGSITLRF

SEQ ID NO: 14049 - protein, 863 aa, Stigmatella aurantiaca DW4/3-1
MRTSVLFCTVSLVTLSFSAAALAQAEPRAEAVQPTSDDAHADRPELGDIVVTAQKREQSLANVGMTIQAASAATLSDRGVQGPADLVKIVPGFTYTEGIYATPVYTLRGIGLFESAFGGAPAVAIYTDEVPRNVPIMSGALDLDLERVEVLKGPQGTLFGQSATGGAINYIVAKPTDHFEAGGDLGYERFGKMSASGFVSGPLTDSFKARLAVGAVQGGAWQRSISRPDDENGATRRLQGRLSIDWKPVDRLRVQASLTGVRDRSDPIASQYAGTNFNIYSASALAAANADPATANPYGYVDEARYAGITTPGSPNYDASFLGRQALIVARMNGVAPIPSIPDLAEGSRELLGTPLATNARQAEWTPGFLRRNHNDYYQGIVRADYDLTDDIALTSLSALAKQKMNYVADLDATAARGIDSILTGNVRSFNQELRLAGKTDALHWIAGATYDNIRASQGFLYDFAHGTLNAPVGLPIEYTQGDIRTSQKTYAAFGNVEYEVAGNLTVQAGLRYTKNKLTGSYCYFEPSFVTTPNFTTTFGLLSDVLRGLPPFTTQVRQGDCLPLGDGQNGTTLNAPQISRLNLKLNQDNWSFHLGANYKFDQGTLIYATIKQGYKAGLFSAIGATVTDEYDPAVQEKVIAYEAGFKAPLLNGRLRVNGAAFYYDYTNKQVRARLLVPIFGLLEKLVNVPKSYVWGLEGELFAEPVDGLTLNGSATYLKSRVSGTFRTTADGLPVYNNQGYTGDFKGSALPFTPKFSANADVQYEWTAGGLKPFVGAGIRYQGGSNATFENRILLAGDFRIPGYETVDVRLGLGAEDDSWKLTAFGRNVFNKYYVVARNIGLDTNFQTAGAPATYGVMLRVRIR

SEQ ID NO: 14050 - protein, 663 aa, Stigmatella aurantiaca DW4/3-1
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVYSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLAAVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIVGSLDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKLLSDLPFHTANGTLDWKPAQLEDWSFYVSGKYTGRKRADSATAKTPGGYVVWDTGAAWQATKNVKLRAGVLNVGDKDLKRDDYGYTEDGRRYFMAVDYRF

SEQ ID NO: 14051 - protein, 729 aa, Stigmatella aurantiaca DW4/3-1
MPRPTSRRTRPARRQAQPAFVPALFMLALGAVAAGARAQPAAAGVPDTQGVAQMPAVTVNAAPVDDTLEHLEAPVDTGALGRRTQLETPFSTTVVTARDMEERQVNKLGDVFALDASVTDNSASYGAWASYLTVRGLPLDWQNSYRIDGRPFLSYVTTLPFEHFEQIDLLKGASGFMYGFGSPGGLVNYVTKKPTDEAVRSVELGYVSKGLLREHVDLGGRVGQSGAFGYRLNATHEEGNTYNGGSLYRDSVSLALDARLSDRLTWDFQSIYQDRKAIGQEPTIYAGTMAGSELPSPVRNDNDRLVGQGPYADNAFRYYSTGLKYQLADEWTLSTNYSYSSTRTRRNESVLFLRDQAGDYDDYRSDYGEAYGYNQWQAMLEGKFATGPLKHHVVAGASWQKQKNDYSANGVYQLQGTGNLRARNTNTYYSEGQLHLYRAAEITQKALFASDTVDLTGGWSVLGGLRYTNYAQQGFDATGARTSRYDKNGVLTPTFALMYKLTPRTMAYASYIESLEPGSSVGAAYANFGALLDPLKSKQYELGIKTEQDGWAATAALFRIEKKAEYANAANELVQDGKTLYQGLELGASTRIARDWNVGGSLMLLDSEYKKGSDFTGNRVAGAPKFVAAAQLAYSVPQVPGLKLRADVKYTGNTMLGASNRVQVDDYAIVNIGATYDTQIHGYEATFTAGINNVANKRYWLYQSSDYVKAGDPRTYGLTSISRYPDIWI

SEQ ID NO: 14052 - protein, 450 aa, Stigmatella aurantiaca DW4/3-1
MRLTRRAVYFAPCLLALGGIATSAHGAAFQLQEQSASLLASAFAGRSADAGDISHMFFNPATLGVHAGRGPEAELVLSYIDPTFDFEADSDPGWSAVGGDTGQLSASGGESALAPVFYAGFDLAPDLRAGLGINVPYGLETDYPEDWVGRYDAVNTDLVTVDINPQLGWRLDEQLALGLGVSAQYADATLSTMAPETDFSTTPATPTPTPTPANDGKLTVDGDSWSYSFNLGAHYAVTEDTQLGVAYRHGLGHTLSGEAELVDDGGVTVDETGGEADLDIPASLNLGVSHQLDPQWTLLADATWTQWSDFEELAIEFDDGIVGIPQGQNSYAVTDEQAYEEYDWDDTWFLSLGTRYDASEQWDLRAGLAYDQTPTGDSNRTPRIPDEDRTWLAVGGTWSPAQADQLRVDFGYTYIWLDDADIEVAEDFGGVTGEYESNVQVFTTSANWRF

SEQ ID NO: 14053 - protein, 695 aa, Stigmatella aurantiaca DW4/3-1
MTDQFATVTVVPSDEIRRNGAATLGDLLNDKPGITGSSYVPGASSRPIIRGLDVNRVGIVENGIGSNGASDLGEDHFVPIDPLSTNQVEVIRGPAALRYGSTAIGGVVSASNNRIPERMPCRPTPWQTYGYGVKPPAAANGCLNVETRSALSSVNNGLEGGVLIDAGADNVAVHADAFGRRADDYAIPGGRQANTANRSAGASIGASYLFDGGFIGASIGQNNVLYHIPGDHGAEFKERIDGRQNRVAVKGEYRPDSALIDAVRLWLGAVDYKHHERGLEEADDPSSDGIHQTFTDRSQEGRLEVQLAPYMLGAIPVTTAMGIQGGHQDLTATSPENAGSLYNGLFAPNSNSRVGTYIFNEFQLLPTTRAQIAGRVEHVWLNGTMPDFPASFMPDGSAQIPIARDLSFTPASASVGLLQDLPGDLVASLTGQFVQRAPKPAELFSRGIHHATTTFDIGNPNLKIESAQSVEIGLRRAKGPLRFEATAYYTRFNNFIYRRLTGAFCDDDFASCHTHDHDDHDDHDDDHEEEHGHGHHLNQAVYSQRDATFRGGELQFQYDAIPLWNGMFGIEGQYDIVRATFTDGSNVPRIPPQRLGGGIYYRDANWLARINLLHAFAQNNVSDVETPTPGYNRLRAEISYTTMLPGNNWLGGQTVTIGLVGDNLLNEQIRNAAAYNKDEVLLPGLNVRLFANVKY

SEQ ID NO: 14054 - protein, 1051 aa, Stigmatella aurantiaca DW4/3-1
MGWIIRGILPALFITTMFGAEHYGYVRSGKKPIPGATVTASLDNVKLVTTTGENGVYVFSIPDKGKWVFTAEMFGFMPAKEELTLVGAASVLDFDLQLQAAGLPETPVAGTATGFQTVDVKEQSDNQAQIEQQLEAAASPSAGPAMPGASDVNEAFLVNGSLTGGLQAVQQQNFFDQLDKDQSIAAKPKKAKGDLAPGEKRAKKAAKKAKKKKSLGDTVNSFGATKQGAQIKGNVLYTFRDAVADASPYSLSGQPLTRPGYQQSRIGAAAGGPLPGSAQTTFFVNFSLVRSDSPYANFDTVPSVEQRAGNFTKPTIAGPVVLYDPISHLPLAGNIVPANRIDKIALGMLSYIPLPNLPGGVQNYQITSAVPFNTSDFSGKLNHTLNERNRFSLTFNYQNRDSNQAQLYGFQDHLSGNGWQSDLGWTHNFGPRTVNSFHWTFARNRSNYIPYFAYGANVAGALGIQGTSPNPIDYGPPNLTFTNYGNMVDGSPVVRREQSSALRDGLTLVRGKHNLTFGGEYRRLQLNPITDTYGRGAYTFTGLLTSGFDNNQRLLPGTGLDFADYLFGFPNSAKVRYGSSSNYFRSSAYSAYVVDDWKLRSNLSLNVGLRYEYFSPYTEKYDRMANLDLATGVTGAAVVTPGQTGPYTGVFPRALIDGDPRNLSPRGAIAWRPTNRKHIVLRAGYSIFYNGSIYAELPGRLASQPPFAHSNNILASLDYALRLATGFTSASTKLINNSMAIDRDYRDGYAQTWNAAFETSLSKTWTLELSYLGTKGTHLDVQRAPNRAAPGSPLTAEDRRLIGDAVGFTYETSNGDSIFHAGQARLTRKLSKGLSVQGLYTFSKSIDDASVLGGGAVVVAQNDKDLAAERGLSTFDQRHSFTLGFTEQSPVGKKTALGGPVLTGILRSWIVSGNIVAMSGLPYTARVLGNLSDSGGSGNFGASRADATGVGVSGGSGFFNKAAFAPPSLGAFGNAGRDTIPGPSRFSMNLALTRSFHATERHHIEIRVEGSNVTNTAVFSNFGTVLNSLNYGLPTVALPMRSFRATLRYKF

SEQ ID NO: 14055 - protein, 182 aa, Wolbachia endosymbiont
VRLQYNGEILPLFTKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELKVLYSTV

SEQ ID NO: 14056 - protein, 161 aa, Wolbachia endosymbiont
VRLQYNGEILPLFTKIDGIKNAAGKEKDSPLKASFIASGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFD

SEQ ID NO: 14057 - protein, 161 aa, Wolbachia endosymbiont
  misc_feature (5)..(5): Xaa can be any naturally occurring amino acid
VRLQXNGEILPLFTKIDGIKNAAGKEKDSPLKASFIASGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFD

SEQ ID NO: 14058 - protein, 189 aa, Wolbachia endosymbiont
VRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 14059 - protein, 174 aa, Wolbachia endosymbiont
  misc_feature (11)..(11): Xaa can be any naturally occurring amino acid
VRLQYNGEILXLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGQNKGEL

SEQ ID NO: 14060 - protein, 190 aa, Wolbachia endosymbiont
PLAAVADVSLYGEIKAGVEGRNYQLQLTEAQAANGGAGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGV

SEQ ID NO: 14061 - protein, 189 aa, Wolbachia endosymbiont
VRLQYNGEFLPLFTKIDGITNATGKEKDSPLKASFIAGGGAFGYKMDDIRVDVEGLYSQLSKDTTIINTSEENVADSLTAFSGLVNVYYDIAIEDMPITPYVGVGVGAAYISTPLKPAINEQNSKFGFAGQVKAGVSYDVTPEIKLYAGARYFGSYGAHFDKSEEVDKAGGGKETKVTKDAYKVLYSTV

SEQ ID NO: 14062 - protein, 189 aa, Wolbachia endosymbiont
VRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTV

SEQ ID NO: 14063 - protein, 160 aa, Wolbachia endosymbiont
VRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYITTPLEPAVNDQKSKFGFAGQVKAGVSYDVTPEVKLYAGARYFGSYGA

SEQ ID NO: 14064 - protein, 186 aa, Wolbachia endosymbiont
VRLQYNGEILPLFTKIDGIQKTKGKEKDSPLKASFVAGGGAFGYKMDDIRVDVEGLYSWLNKDADVVGDTVADNLTAISGLVNVYYDVAIEDMPITPYIGVGIGAAYISTPLKTAVNEQNSKFGFAGQVKAGVSYDVTPEIKLYAGARYFGSYGAHFDKSEEVDKAVGGKETKVTKDAYKVLYSTV

SEQ ID NO: 14065 - protein, 189 aa, Wolbachia endosymbiont
VRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFCAHFDKDTAAASKDKGELKVLYSTVGAEA

SEQ ID NO: 14066 - protein, 188 aa, Wolbachia endosymbiont
VRLQYNGEILPLFTKVDGITYKKDNSDYSPLKASFIAGGGAFGYKMDDIRVDVEGVYSYLNKDDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVA

SEQ ID NO: 14067 - protein, 180 aa, Wolbachia endosymbiont
VRLQYNGEVLPLFTKIEGIEYKKATGIHNPLKASFIAGGGAFGYKMDDIRVDVEGVYSYLNKNDVTDAKFTPDTIADSLTAISGLVNVYYDIAIEDMPITPYVGVGVGAAYISTPLKDAVDDQKSKFGFAGQVKAGVSYDVTPEVKLYAGARYFGSYGANFDKSGGEKDKGGHTVLYSTV

SEQ ID NO: 14068 - protein, 187 aa, Wolbachia endosymbiont
VRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLYAGARYFGSYGASFNKEAVSATKEINVLYSAVGAEAGVAF

SEQ ID NO: 14069 - protein, 404 aa, Alkalilimnicola ehrlichei
MSRVPACPAASPLHPAGLDPVRSMTILETSMKTKLAALAALAGCSALAHAQSSVTLYGVIDTGLLYQTTSAASFSPSAPNTGKVFRMKDGGIYSSFWGIRGSEDIGGGYKINFKLQGSFDSSTGKLQLSDTPGAVAIFNQVASLGVSGPFGTFTAGRQIVPMIYAMADTDVRNAQFFGSVLTAWLGLNTAAGWPGTSTNGAIGALYDSNALVYQSPTFAGASIALEYAPGGVAGQFQGGTRESVVLRYANDGLNLSAVYYNGHDTNPAPGVAPTGVDNNRFVYAGAKYTIRDFSVSASYGNGRNPSHADKVNLDMLSAGVGYRFTPALQVTSAMYYLKDRNRSENRSTAVVLAADYSLSKRTMVYAQVGHVNNRGTMDQMLVYGQPVAPGVGTTAAMVGLRHNF

SEQ ID NO: 14070 - protein, 869 aa, Alkalilimnicola ehrlichei
MRPLTFKKSVLATNIALLMSGALSVSAMAAEADAKAAAADENIEKIEVRGMRASMKASINAKRFSDSVVDAVTAEDIGKFPDGDVGESLGRIPGVAVNRQFGQGQQVSIRGASSQLTRTLLNGHSVASTGWYDQQAIDRSFNYSLLPPEMVGAIEVYKSSQADIPEGGIGGTVIVKTRKPLDLDANSVFISAKGDYGTISEEVDPELSGLYSWKNEDENFGFLLSAAASETNYQRNGIESLVGWGDIVPTTFEQERERTAINGALQYRPTDNLEFGLNIMTLDMKANNANTSLFTMFPDDKEAACEQTNASGTCTFYRRDGKGENPGWAQTWARKASMDSNTYDLDFKYEADSYTLEGRVGNTKSEGGTDMTANYGFWLGQPGDYAGTYDATGEQIKIDIANKSFDAGDFGGPLSPAGWSLKKQPNSDEETYAQFDVTVPVDLGAITSFKTGVRWADHDVKQETFPAIVNADVTAKDASAYYSGTVSSGAGFTLPKPNLDAMLADANAAISGFSKEGTVYKSGYGTITEENLALYLMANFESDGVRGNFGLRYISTDASSDYYKLQSDGTYADNLSTRDASYNDVLPSVNVAFDVAPDVIIRTSASQVISRPNYGDMFASSALAGYNDGTAGNEVVNTGNIALEPFKATQADLGVEWYFSPDGLVAATYFIKDISSFVTSNQILDQSIGIIDPDSGEDSWTKSTKKNGTGGQIQGVELQLQDSFENGLGYSANYTFADSDAPADNYPDEVSVFSDSSKHTVNLVGYYEMEDFSARVAYNWRSEYMIRELPGFYGNREHQDYGTVDLSANYNITDYLSVTFEVVNLLEEDSVQLGVAPDSAEVKPELKDGYPAWSFEGEARYKLGVALRF

SEQ ID NO: 14071 - protein, 1228 aa, Alkalilimnicola ehrlichei
MDRKKAVKLATASAIAASAFVAANPNASEAATDVATVVSQAKAQFKKAYYTYSHTVTETGEFPNINDVYAEYNKAKKRYRDAVALVNKAGGAKKDAYLADLQKEYETYVFKANPKSGEARVATYIDAYNYATKLDEMRQELEAAVQAKDLEKAEQYYHKIPYEIKTRTVILDRVYGKTTRDLLRSTFKAKAQELRDSLIYDITVAMKAREVQDAVKAGNLDKAKAAVDQINQYLPKVTDAFKTELTEVAKKALDADEAALTPKVESVSAINTQNKAVELTAVPVNGTLKLQLSAAANEDTVNVNTVRIYKVDGNIPFALNTADVSLSTDGKTITVDASTPFENNTEYKVVVKGIKDKNGKEFKEDAFTFKLRNDAVVTQVFGTNVTNNTSVNLAAGTFDTDDTLTVVFDKLLAPETVNSSNVTITDVETGKRIPVIASTSGSTITITLKEALVTGKQYKLAINNVKTLTGYNAEAYELVFTANASAPTVATAPTTLGGTTLSTGSLTTNVWGKLAGGVNEAGTYYPGLQFTTTFATKLDESTLADNFVLVEKESGTVVASELKYNADAKMVTLVPKADLKENTIYQIKIKKGLKSDKGIELGTVNEKTYEFKTQDLTAPTVISVTSKNGDAGLKVTEAQEFTVKFSENLNTFNATTVSGSTITYGQVAVVKAGANLSALTASDIIPASVEAVTGQDGTYKVKVAANQLERNQGYKLVVFGKGATAPVKDAANANTLATNYIYTFTTEGQDVTAPTVTKVFKGDSLKDADAVTTLTNVDAGQKFTIQFSEELKTSSGSLVGGKVTVEKLTNNGWVDAGTGTTVSVAPKTDANGKVTAAVVTLTGLDNNDKDAKLRLVVDKSSTDGIADVAGNVIKEKDILIRYNSWRHTVASVKAAADKDGQNASAAFPTSTAIDTTKSLLVEFNETDLAEVKPENIVVKDAAGNAVAGTVTALDGSTNKFVFTPSQELKAGTVYSVTIDGVRDKVGNTISKYITSFKTVSANPTLSSISIADGAVNVDRSKTITIEFSDSVPNPTITLKKADGTSFTNYTLVNVNNENKTYKIVFHKGVTLDEFTQYELAVSKDFQTGTDIDSKVTFITGSVATDEVKPALVGVGSWNGTSYTQDAAATRLRSVADFVAEPVALQFSEGIDLTNATVTVTNITDDKTVEVISKESVDADHDAGATKETLVINTVTPLVLDNSKTYKIVVSGVKDAAGNVADTITFYIK

SEQ ID NO: 14072 - protein, 386 aa, Alkalilimnicola ehrlichei
MKRLSVCCALFALPVIANAQSSVTLYGVLDEGLMYTSNVAGGKKVSLDSLSGLFGSRWGFTGVEDLGSDLQAIFTLESGVNLNNGQFGQGGTAFGRQAFVGLRSAQFGTLTFGRQYDMVFYFPEPLTAGSLVGGPVGMHPGDIDNAANTVRLNNSVRYMSPVRGGFSFGGEYSLGGVAGNFTANSGYSVGAGYSGGPLKIGAAFEYFKNPTATPGNGFFTAYANGASPLAYSLNKAYVQAQAYQVAIVAANYAVGAATFAASFSNVQYANLGAAFHNGKAIFNNVDVGFQYQFTPAFTTGIAYDYLTSNGVTTESDTTVGNQHYHQVSLVADYLLSKRTDLYVGAGWQHASGTSSLGTPAVANIDNLGDSSNHQQLLFRLGMRHRF

SEQ ID NO: 14073 - protein, 812 aa, Alkalilimnicola ehrlichei
MSTQNTNQVLAKNVLSFMVASAIAGFAHAESTGLALEEVLVTGLPTQQTKMDASVSSTTLSPERVENSVARSTTEIFLAIPGVRSEASAGESNTNLSIRGIPVASGGGKFMQLHEDGLPVMQYGDVIVGNADNYLSYDWTVSQIQAVKGGTSATLASNSPAAVINFVSKTGEEEGGSVGFSTGVDYDSNRMDFEYGSPFSDGWMFHVGGYYRTGEGVRDTGFNGNKGGQLKLSIKKEFDRGYVRVYGKVLDDKTTTYLPMPMRAGGDSITGFDALKSSNIPSELLAIQTGDGGTGVRHSSIGDGSSVKSQVIGGQIQFDITDDLILSEKFRVAQNSGKFVGAFSANIGAASDPSGIASGLGSANGLAYASGKNAGELLSASDLANLNGNGLIQNIRTFDNDINSLNNFSNDISLTKQFDSWDITAGYYTASQAIDINWYWQTYIADVADETRLLNAYEDDAQLTTGGLVAYGAPDWGYCCYRDTALETNLDAVYIALNANINDDLSVSASVRSDSGDAIGHYAFGANNSVDFDGNGEISLAESQAQTISQASIAGSQYKYDWAYTSYALGANYLLNDYSAIFANISDGGRANTDRLGDGGFIVDGTVVDGAVENRVRQYEFGYKREGDYAGIFATAFYVQTDDVNSEGTNGSTLTARVREYESTGLELETFANLGAVTLLANATWTQAEIVSSNDASLIGNTPRRQADLVYSTTASYAWSDHSAGLTLIGTTDSYAQDANDYTLDGYNYVNGYVNFGLADGFTVSLAVNNIFDQIGVTEAEENTPISISGADYVRARSIAGRSTSLSVKYQF

SEQ ID NO: 14074 - protein, 744 aa, Alkalilimnicola ehrlichei
MGSVRTLVGVRALRTMALTGASLMALTLAAAAQQATARLEELSVEGSGRGAGATGGPPAQRGADGRAAPEDPRGPVAGYVATRSVTATKTNTPLIETPQAITVIGREQIEAQGAQTLTQATQYTAGIYSGVYGADERVDFFTLRGFVASDYGIYKDGLQLLNYGFGTLKTETFGLERIEVLRGPAAVLFGAGNPGGLVNQVTKRPTLAPFGYVEIAGGSFGQVYGAFDVGGPADDSGHLFYRLTGIGRQGGTQVEGADSDRAYIAPAFTWRPDAGTTFTVLTSYQRDSTAVTANFLPYAGTVRPNASGLRIDRSLNVGDPRINSFQREQVFAGYEFEHAVDDVWTVRQNFRYSFSDATQNSYIGQLGYADLPQTQLSRYQFQYSDKVSLFQVDNQAEARFSDGLVAHDVLFGIDYKNYSLYDNQASLFPAPNLSIINPLYGQIVGRPLPYQVDVNSFRQLGFYAQDQIKLTDRLSLIGGLRYDIANSDVLKKLAPDTSTSRTDTALTGRIALLYNFDPGIAPYVAYSTSFQPQIGVDAITGGSLSPDRGEQIEVGLKIEPVGERFSLNIAAFDLVRDNPPFPVIVGFGSTQLGTVRSRGIEGQFVASLAEGLNVVAAVTHYDLEYTRVRDAALGDLVGKTPTNVPETFASVFADYTIPLGDWRGFGFGGGVRYVGRSYADQLNNLKVPDYVLFDATVHYNWERWRMAITAANLGDRRFVTSCQSANSCFYGEARRVLASVSYRW

SEQ ID NO: 14075 - protein, 998 aa, Alkalilimnicola ehrlichei
MSGNRLKLSLIALLILNAGGLFAADEKDVKLDSIEVIGTTPDDDVKTKKVGETKKSAETLSKQQVSDSRDLVKYETGVTVVEAGRFGASGYAIRGVDENRVGIMIDGLRQAETLSSTGFKELFEGYGNFNNTRNGVEMENVKLATITKGADSIKTGSGALGGSVMFETKDARDYLIDKDWYFGFKNGYQSRDTQNFRSVSAAARFKWFDILIINTLRDGHETKNYFYDIYNGDEDRSHVGKTREKADPYHIKRKSTMVKVGFQPSDEHRFSVMHDDSTLSSRGEDLSYSLRTWSQGQEDTKLGERRTNDKSTRKNTQFTYENFVETPFWDSFKISYSTQKIKNKAKTDEYCNNDGCNNVRNPSGLNLVYDKEAGVYKIVDKNNKELSFYDKKNKKRVSGDRHEAKYADAEEFMDSNGNVLEWKNNGGDPDYMLMDCSKIDCSKKFRVSRLINTGRVDADGDDIWEHTFADRDIITKEYHGIKYGVIKKDDPAEELRFVTPQSEGFAENNYHDRDLNTDTKQFDINFDKEFELFHTSHSLKYGGLLDKTKKSMVDQDGYIDVSSKWWATDFFGYDNWGTIPRPDKWPTTNKLKKNTSTKQTYLVPVETETKAFNIGDNINLTDWLGLDLNYRYDIVKHSPSYDESIPVPPGMIIGVFKPLIGYNPYGNSQGYKHPIAQQNLKENLDILLQNREFKSDSYSLGLNLDPLEWMRVQFKYSKGFRAPTSDEMYMTFKHPSASIRPNINLKAEIAKTKEAALTFYKNQSFVSFDVFKTDYENFIDLVYIGEFPIDDSSQLGYPFWQNKNRDNAKVDGFEITSRLEMDEILPSLRGFRLGYKFTHQKGRMRDDEGNTIAMNAIQPTTSVYTLGYSTPGDKYGIDLYITDVGEKKAEDTYNMYWKQQEKDPNYLVKGKPVTDSAWGWRSGNYTVFDLIAYAKPAKNFAFSFGLYNITDQKYMTWDSARSIRGFGTTNLIDQNTGAGIKRFYAPGRNFKFTWEIKF

SEQ ID NO: 14076 - protein, 686 aa, Alkalilimnicola ehrlichei
MIRQILASRFKVLTLAIGIALANEGYAKQEEAHDSSLLSMSLAQLLDIEVTGPTRDEQTFRLAPAAVSVFTHTEIAAMGLATLDQLVNFAPGYQSNRNGGSPIYAPYTSRARRISGSSSEILLLVDGQRINDPRTSGASSIVPQFPLANIERIEFIRGPGSALYGSNAMQGVINIVTLSNQNRASLEVGSFDHTALNFFNSQQVAHIQIDSFLDIQQDGGDNYNIPSSTSPDGTVATQDPKSRLSLNIKAQKNNTQLKLQHYAAEAEDFYLNGGIANGVNKHKSELSALELVQTFRLDNSSSMISANYTRSSTLRIQQLLPAGSMRDMSTPSSDAPFTGGTKDNVYSEYELQWTNNWQLNSANKLQFGASYRHIDSPELQVTTNYDIKAFIAREFPITYYGKQTDGPPAQHASTRDILGVYLQHQTTVADKLHITLGARHDEFSNIGNRLSPRLALVYTPTDANTFKYLYAEAYRAPSEAELNLTDNPQFLGNPNLQPEVVTTSEIIWIFQCEKYSLTSGIFEHQFTNAIVQQSIGERTQQNFNMDQSPVRGAELELALQATPKLFVRANTTAIWDKPETSYREASRLASLMVSYQHQQWNANVGAYWHGETEMATNGDDSQRTQVDAFTLATAKLSRAINSQLNVYLKAYNVFDSNIATAPESSSLQQGIPNRGRSIQLGFTYHF

SEQ ID NO: 14077 - protein, 1060 aa, Alkalilimnicola ehrlichei
MTYAAESYAQKTMISLEVRNETVGTVLEKLKKESGFDFFFNNKHVDLKRIVSVSANNNNIFKILDQIFAGTNVKYSVLEKKIILSTEIVQGIQQGQIKVTGIVKDANGEPIIGANVIVKGQSTGTITDIDGRFVLDTPKDAILQITYIGYVSQEVKVSGKKELNIILKEDTETLDEVVVVGYGTMKKRDITGSVSSVNTSVLTAGSTPSAADALQGRIAGVNIQKNAGRPGGSYSIQIRGVSSIKNKNSGPLYVIDGIPTSEGMNDLNPSDIETIDVLKDASATAIYGSRGANGVVIVTTKRGEKGKVSIQYEGNVGFKEASHLPEMMEGDEYVKFRTDLYHQLGRSTDRSNAEFFTPEEWNRIDHGIYTDWVDLVLRKGFQTSNTITASGGDDKGTFSIGLGQLKENGTIEGQDYDRYNMHLNINRKFTDKWEAGGSLYFTYSIQNEGSYETLRSAFRLPSVAAPYDDEGNMLFRVFRNDAVTNPLYESTEDGEWREKKRFRAFGNIYLKFEPIKGLNFRTQFSPQMLNKRNGEYYGMWCKNGGAGKTDNTSAVYETNNHWGYVWDNQATYDKRFGKHSLNVNLVQSIQYQQWESSYQKARNLPYNSKWYNLDAVASTDIQASQTDYQQTSLASFLGRIQYSFMDKYLFTVSGRYDGSSRLADGNKWAFFPSAAFAWMLGEEEFIKKVDFISSLKLRLSYGVTGNDAVSIYGTQSNVSNRNYDFGGDVSTSYYKNGLANSKLTWERTQEFNIGLDFGFFRNRINGSLDVYQRTSKDLIMERQLPSTTGWTFVWDNIGKVRNTGLELSINTINVQTSDFSWQTNIIFDTNKNEILELYGGKKDDIGNKWFIGEAINVNYDYEFDGIWQTSEADKAAIYGQTPGQVKVKDQNHDNVIDAKDKVILGQQLPKWTGSITNTFTYKNWDLAFNVYTRQGAQLNSTFVSSFMAYDGNYNQAKVDYWTETNPTNKYPQPGNKGKYFSSMCYQDVSFVRVGYITLGYTFPMSLLKPIGIKRLKLYATANNPFLFTSFKGFDPEWATQNTWGEATSTRTFLFGVKLAF

SEQ ID NO: 14078 - protein, 112 aa, Alkalilimnicola ehrlichei
MKRDGAMKITLLVTLLFGLVFLTTVGAAERTLTPQQQRMTSCNQQATAQALKGDARKTYMSDCLKNSKSAPGEKSLTPQQQKMRECNNQATQQSLKGDDRNKFMSACLKKAA

SEQ ID NO: 14079 - protein, 140 aa, Alkalilimnicola ehrlichei
GKVFIGTVDSFRDNQDSQYGFEVQFEQGLTRYDFKPVAGLLRTRDASHYLYTGVSRTSAFTNSGTGLSLTFSFGPGIYLHGDGEDTDLGYWLEFRTSAGLLWTFADDTRIGVHFAHLSNASLAQTNPGTELLTVTYELPF

SEQ ID NO: 14080 - protein, 1003 aa, Alkalilimnicola ehrlichei
MKRRKLNVSKLLTLGLLLSYSANIAANTTSETTSIQQNSSYKVTGVVSDTSGEPIIGASVVEKGTSNGTITDLDGKFTIEVNAGATLNISYIGYKNQEVKVDRNGLSLKLTLKEDTETLDEVVVVGYGTVRKADLAGSVAVMDNKSFKDQPVTRISEALQGRVSGVQVENSGVPGGDIRIRVRGANSVNLSNEPLYVVDGIVREGGLSGLNTDDIKSIQVLKDASSTAIYGSRGANGVVLVTTKTGVAGQTQITFDATLGVSNVYKHYDMLSPYEYAEAYNFWYPGNGYSAEEMDALKTGKKGINWQDEMFRSGLVQNYKLAISGGSEKTQYYVSANYVNEEGVLRYSDNERYSARVNLNSAVTNWLTITTDVQFNHGVRNGNTYIASKTNPIFNALNYDPTMDMFTEDGKYNVGKNTTGSNPLGSIAASNSELRTYAATGNLALQFKIIDGLTFTTTNAFDYQDNKSYSFSSAKASPTAISSMGNSDAFRMMLQSTNNFTYMKKFGKHNLTATAVWEATSTEYRNMNIGGNNLSTEAVGWWNVNMASTKTLGNSYSRETLLSGVGRVIYNYNDRYTLTATFRADGSSKFSKEKWGYFPSVAVAWDLSNEPFMEDFKAMQNMKLRASYGVIGNQGIGAYSTLGLLGQAYTNYGTSSQLYYGYWPTSLPTPDVTWEKTKQFDLGVEFAVWNQRLSFSLDYFYKRTVDCLMQEPIPGYNGGGNYLANVGRIDNKGLDFSINAHLIQTKDWQWNSTLTGTYLKNEVKSLGSNEYIYGKTPADKMADEATIVMPGYSIGSFYGYVWEGISEDGKNVYADLNENGSIDAGDRTVIGNANPNFTFGWNNTVNYKNWDLSMFLTGAFGMDRLNLVRYAMSTSISDASFINTKEAYEYNWDVNPENAKFASLLNGGTNYANSTQWVENASYVRLANLSLGYTFPKSKTKFADIRLSVSCQNLFTITKYKGMDPTASAFTDDSSKSVDVSSGVDIGGYPTPRTFTFGIKMNF

SEQ ID NO: 14081 - protein, 757 aa, Alkalilimnicola ehrlichei
MPASRYARVTPPLAAFLLIGSAPALAQQASATLDTISVEASRARQPAPGPASGGPLATPVAAPSGPAGAVGVGSATSGGGGGPTGVVGYTARGSAAATKTNTPIIETPASVSVVTREQLNDRNVQTLNEAIAYTPGVSSNVFGFDPRFDAFYIRGFEVTNVGIYRDGLRQPSAPFAIPRVEPYGLDALTILRGPAAGLYGLGAPGGIVDVTSKRPTSVPFGEIWLQRGKYDRYQGAFDLGGPIEQSDGQLSYRLTGLFRQSDSFLPGGREDRNVIAPAITWRPDAETSLTVLAEYLDNTVPGNASFYSNFADPRFQKTNLFSGDPAFQDYTTRQYRVGYAFEHRFGPDVVFRQNFRTYNVFGDLRYTQIDTISPDLQTAGRSNGRITNALDTLSLDNQLETRFTTGPVAHTLIGGIDYTNSRYTDRRGFLVVPDLQIGGLIRPNYGAQFIPTPALTGASRQRIEQLGTYVQDQARIGSLILTLTGRHDQVSQLAESYSAPAATGPTIANDRAFSYRVGANYLLTDFIVPYASFATTFAPQLGFDRNGAAFQPTTGEQFEAGIKTQMPGRNVFLNMAVFDITQSNVLRPDPVNPILFQAAIGEVRSKGAELELTANLGPGINVLASYSHVDIRTTRNPGAPETVGIPLSGIPANTVTAFANYAFQPDTDLFGLSLGGGIRYAGTSPANEVPGSFGNSTVTLFDAVAAYDFVKADPRLKGMRLQVNVNNAFDRRYFNCQAGACYRGQPRQFFASLIYRW

SEQ ID NO: 14082 - protein, 229 aa, Alkalilimnicola ehrlichei
MSMQWRAFCSSAALLAGLCVASQSFAADLDMISYEPGAPVQQPVEVGSGWYLRGDIGYNLSSKVKVQTETSFWSASQSYDLDKNVVPSVGVGYQFTDNLRGDVTLGYSKQSFDDYDVDVRSWDMMANAYVDLGNYYGFTPYLGAGLGFANVRYSIDTAYGNYKTDDDYRLAWALMAGVGIDVASNIKLDIGYRYGVIEGADIASAAGLTLSDKDIQSHQLRAGVRFTTW

SEQ ID NO: 14083 - protein, 810 aa, Alkalilimnicola ehrlichei
MPGQSRLRLTLGVSAVALLAALPAAAQTQDRPRDDALTIETLVVTAQRREETINSVGMPIQAFSGATLQQLRITDPKDLSTIAPSFTVSQSYQGVPTYTLRGIGFNTINLSATSTVGTYTDEVAYAYPFMNTGPMFDLERVEVLKGPQGTLYGRNTTAGLIDFVTNKPTEQFEASLTGEAGGDKTHNVEGYVSGAIAPRLQGRFAFRSEDSDEGWQVSNTRNERQGEVHRDGWRLSLAAQPTDKIDIDFSYAGWRNDSDTVAAQAIGFTPATAASPFNAPGLVAYVASHRPTKASQGDWAPLSTRGADIGAGLGIGDPARENDAFDAGKLRIGWDLGDKVRLVSLTSYNKLTRDAVFDWSGAPYEILVQKAKGEIESSAEELHLEGATNKGSWLVGAYVAHDEILDSNRTLLGQNANVGTIRFYGAGLLASPFNSGGYTPLQMSQAFRTYEDVGSIETDTWSLFANADHALTDTLKLTLGIRYSQDKQDYVGCSRDFNGDMLPNVNVVNRALFFAAYGLVAPIVQGGCNTFDPATKSFGFVKSKLDEDNIAWRVALDWRASEDVLVFGSVSRGAKAGVTPINAANISTQNAPARQEMLTAYELGVKAGLFQRRVQANVSAFYYDYTDKQLNVYFADPIYTALARLANVPDAEAHGVDGDLTWRASRSLTLIASATWLHTEVKGYTGVNSAGQLQNFDGQPFLYSPKFQGGLTAMFDRPVGDGLRLRAAVNGRWQGKSQADLEGNPLFVIDSYGLLNASVGVASDKGWELSIWGRNLTDEYYWSAVSSNANTVVRFPGKPRTYGAALTWKF

SEQ ID NO: 14084 - protein, 803 aa, Alkalilimnicola ehrlichei
MHFKSFLLAATSVAAFAGAAHAQDAATPADDSTAVDQIVVTGTRVARSRLDTVSPVDVVDNKALTRQGTPELAQALANLAPSIDFPRPAVTDGTDSVRPATLRGLSPDQTLVLLNGHRAHTAALVNINGSIGRGSAPFDLNTIPVAALDRVEILREGAAAQYGSDAIAGVINLRLREASHGGGASATYGIYDTKVQTSRDTDGRKAHDGPTYSASLWQGFALPNEGFLTVTGEYSFRNPTNRADRDPRVTPSKVTGVYGDPQVETKTIYANFGLPLNDAWSLYGLAGYQNRKGESSAFPRLADNANNYTSVYPTGYVPRITTKIDDYNLAFGTKGVIGGFNIDASVTYGNNKVEYGTINSLNASLGSTSPTRFKDGSMQYGQTVAAIDVNRPLELFSFAKPSTLAFGVEYRDETYKIEAGETASWINGGNGKGAGAQGFPGFRPANAVDVSRNATSLYVDLDNQITDKLDIDLAARYEDYSDFGSTTTGKVAARYDFTDNFALRGAFSSGFRAPALQQQYFTTTSINIVAGGAAVDVGTFPATSATAAALGAKPLEPEKSKNYSLGAIYHKGPFELTVDAYQIDIDNRIVLSENIAGSATGTPTQRAIFNLLQPFGVTTARFFVNGVDTTTKGVDVVARYRLDADAAGRFDFTLAANYNQTDVNKVPTTSTLSGLPVPPPLFARVNVLTYEQGTPDHKFVASGDWSNGPWGATLKGTAYGSVLVPNATPALDYKSGAKTVWDAEARYTFLKDITWALGVNNLFDEYPDRAPAPVNTTGVVAFPSYSPFGFNGRFLYTRLSYSW

SEQ ID NO: 14085 - protein, 305 aa, Alkalilimnicola ehrlichei
MIMTEIVADKTVEVVKNAIETADGALDLYNKYLDQVIPWQTFDETIKELSRFKQEYSQAASVLVGDIKTLLMDSQDKYFEATQTVYEWCGVATQLLAAYILLFDEYNEKKASAQKDILIKVLDDGITKLNEAQKSLLVSSQSFNNASGKLLALDSQLTNDFSEKSSYFQSQVDKIRKEAYAGAAAGVVAGPFGLIISYSIAAGVVEGKLIPELKNKLKSVQNFFTTLSNTVKQANKDIDAAKLKLTTEIAAIGEIKTETETTRFYVDYDDLMLSLLKEAAKKMINTCNEYQKRHGKKTLFEVPEV

SEQ ID NO: 14086 - protein, 390 aa, Alkalilimnicola ehrlichei
MKKRFALGAACLALGAGNARAVPYQDVLLAAVPEYNGRLTEGVALYGSLDMGINYQTVGGHSLWQTQSGGEWTSKFGFFGRENLGGGWRAEFNLESGFLANNGAQQDKQSTYNRQSWVGLSSDSYGRLRLGKQIGTALPLFVDVFGTVGTNSVYTWLGAAVVQTSRGVSYNSDLGPGATQLPARVDNAVTYRTPIVAGTTSLMLMYAPSNVAGRAPAASAQGALLQWYNGTTYLAASYNQVWGVNGASTVRNDLYGLGAVYDTGRIVLSASFNQYAPKLAGDGIARVYTVGAIVPFGVNAIRASVVYRDTSGVRDAAGQPAKDSALGAMLGYDYLLSKRTGLYARAGFIRNYGISTVLLNGNPLPTEPGGTAPRTGTTPVTVSLGMYHNF

SEQ ID NO: 14087 - protein, 387 aa, Alkalilimnicola ehrlichei
MKKIITATAVSATFACAAHAQSSVTLYGIVDAGLTYVSNEVSKDSTVTSDGRVTGGKAMFGMTGGNIQPSRWGLRGVEDLGGGLKTVFNLESGFNIANGNQAVSNKLFNRQAYVGLSNEYGTVSFGRQYDSVVDYLAPLTAAGSWGGTYFAHPGDNDNANSSISVNNSVKFQSANYAGFSMSGLYGFSNNAGFADNRAYSVGAGYRNGGLQLGAAYLQYQGMDLNQSNGAVSGGTFAASAVSGVQNQRTWGLGGSYAFGPFILGTVFTQSRFQDKFSDISVRYNNYEVNARYNLTPELGLGAAYTYTQALRAAPGTSDTNTGAAHWNQFGLQADYSLSRRTDIYAEAVTQLGANNGRGLNAVQINGTSAPSTASNQFLVTTGIRHRF

SEQ ID NO: 14088 - protein, 944 aa, Alkalilimnicola ehrlichei
MKHPIQRPASRRRSTLASSITHILTGGTLLLVGAVASTSAFAQEKATNLDRITVTGSNIPRTNTETPSPVQVVTRQEIDRTGKTTVAEYLQTLTADGSGSIPKTFGNGFAGGGAGISLRGLGAGSTLVLLNGRRMATYGLADDGQKVFTDLSTIPLDAVERVEVLKDGASAIYGSDAIAGVVNIILRSDFQGAILRGSYGVSGDGDGDAKKATLTAGTGDLATDGWNAFFSLDVAKTDAIKISDRKNRKWIGTGDTRPWGYGNNAQFLGGAFLSGKTRGGVGPNGSVYDDRNVTKENPAFLVALPGCAGLTTIPGQTEASAQAQGCLWDPNQLYRDLTPEEKYINVFGRASFAFGEGGEIYTEIGYSKKETTFSNTPSGVSGSWGFPEGPVNGNSGPGAVVLGPNHPDNPIPGQASRLRYSAWDVGPRVTNNTNEFTRFLVGVKGNWGDWSYDTAYLHSGTDLVNKRTGFLNYDNVRCALANPNCAGGVWRIGDNAGMNSQALYDFISPDISARAKSSLDMFDFTVSRSLMDLKGGPLGLALGTEWRKTSNSLTPQTYTDKGQIIGLGYSAYDGTQNVYAGYVELSAPVLESLELSGAVRYDKYESGEGKATPKIGIKWTPADWIALRGSYAEGFRAPNPAENGDGGLAAFSNASDPVRCPGGNPAPGANGDDCGALPVAIITRPNKDLKPEESKSYSVGIVLQPTSTTSLTIDAWQIKRTNEIAQGSTAEAIAAGNVLRDTNLLNGVPGTGSILAVNTQYINAASTRVRGIDTDIRQTFDIGPGQLEMDLQWSHVLKFERTDADVTVDYAGTHGNCDVTNCIGTPKDRINFGTTWRQGPWSVSGVANYISKMDNKDFRGPDGSYLFAYADGTDVKKISSFTTFDLSGRWNITDAFELNASVQNVFDRIAPLDPSTYGGVNYNPLHFSGAIGRYFTVGAKYTFK

SEQ ID NO: 14089 - protein, 382 aa, Nitrosomonas eutropha
MNKKLLTTAILAATASAAHAQSSVTLYGLIDAGVSYVNHSKSASGSDKLFKYDDGIAQGSRWGLRGAEDLGGGLKAIFVLENGFNSGNGTIGQGGAIFGRQAYVGLSHKDAGTLTFGRQYSFTTDILGANYSTGGNTVAGNYAYHVNDIDQLTSSRINNAVKFQSANYAGFTFGALYGFSNSTSFAGAPATTTGTTTTPGSSRAYSFGLNYANGPIGLGAAYTDIRYPSQATPAFTTNIANLTISNVRDLRSFGVGGRYIWGPATLWALWTNTRLEPVTGGSTTYNAYEAGGKYAFTTALSAGVGYTYSRVSGANSGHWNQVNGALDYALSKRTDVYLLAIYQEASGKNLQAQIGSSTSYFNTSGTGSKNQFAARVGIRHKF

SEQ ID NO: 14090 - protein, 183 aa, Nitrosomonas eutropha
MKSIAAKMVAVTIALGASSAACAAVNLHGEAGAEFTNLSASFGAGEPGMTFSSQWAHSDNDGDSVGLGMGYNFNLGPFLMTLGGKAVYLNPKDGDEGYAIAAGGGAELPLGQYFTLFGEGYYSPDSMSSGVEDYVEANAGVRLNVLPSLNIEAGYRYIDMAGKDGNRDNTLADGAYAGVNFRF

SEQ ID NO: 14091 - protein, 782 aa, Nitrosomonas eutropha
MVFGCFVSRAFSGVRSIGLTAGCSLLPLMAPGALAQVAAPQAGDQNDDIVVTAQKRSQNLQDVGITMAAISGDKLRDNAITTSTEIAKIIPGISVSGVAGGQFTTFVIRGVTQSDFGDHTEAPTAVYLDEGYIASGQGQSFALFDLERVEALKGPQGTLFGRNATGGLVHFISRKPTQELDGFVQGTYGSYNQTRLEAAIGGGLGDKVSVRAAGLFNSHKPVLKNLYLRADGRRADGEWTDHTVAGRFHLEFQPTETLKILFTAHAGESRKSTSPYDQRASVPVLDGSGRVIDSIFAAPTETRFAIIPPGAINVDPSLIGIRPVPGGDWGGYRGGDPEALTVTKNFSDRDGNRFRMWGGSAKVSYELGDLNLVSITDYKKVTKRVYMDIDASPRNDLVFPALAETANFSEELRLSRDSGRFRWIVGAYYLNIDTNAETGFLINAPLDATIRELIPNSVYIRDLTSLRTKSYSLFAQAEYDLSDVLTIIAGARGTQENKDFTYRTDQLVRATFASNLRNFADGDNRMLWSGKAQLNWKPVEDVLIYGGINRGVKAGSWNAPLAGNPVITDAQLAYKPEVLTSYEVGLKTTFWDGRGRFNAAAFYYDYHDYQASLFLGLAQRILNADATIKGLEAEFAIKPVPGLDIQISGAFTDTNVEDVNVNGIVRDRESAYAPRWTGNASARYRVPVGFGQVYAQVDASYSGRFYYSLTNFTSTRVNRYVIPNAEIGFTSLDGRFSLAAFARNFTDKRYIAVGADLSGFGGYSEQSYGNPRWLGIRAGYTF

SEQ ID NO: 14092 - protein, 751 aa, Nitrosomonas eutropha
MKINLAMSSIACAVLFALGNHTAQAEEANQTTNNKVERIVVSGTPAGMGVRKIDASYAVTNIDEEQIIKLSPKSTADLFKAVPGVWVESSGGESGANVFVRGFPGGGDAPFLTLSMEGSPIYPAPTLSFLENSSLFRIDETIETMEALRGGPNPVVSNGQPGLTTNFRLKRGSEDSKGLFKYTTSDYDLQRVDAVISGEIADDLYFMMGGYVKSSPGIRDAGFTSEKGNQFTINITKVLDNGEINFYTRQTDDHGAWYLPTPLNVEGIDAKYTQLGTLNRKATIFTGPNNEAHQIDMGDGRGWEGHVSGGSIKLEFANGWAFSDRFNITKGDANTLGLVPAGSATTLGAVADNSSTAIGAVTGTVYTANTPVQQLGRWVVLKEISSFTNDLAFSKQFGDLSTAFGYYSATTSANDWWSLGNTAYHVLEASGEMLNGIACNQNPAGCDFNYDINSSGDARTNAFYATAQYKFTQLLTFDAGLRNESHEVEYSVDEDLDGIFNKTVQYDENKTSWTIGINYSLDDDMGVFARINRGYKMPYFDDFRDNYGAYQAGEKLIKEVTQAEVGYKLMTKSTDFFATLFTNEVKGDTFVRRPGEPAEILTNQAYGVELDYSYNHESGFSVNLNSTFQSTEITQSPANKGNEAQRQPKWQMRVTPSYDFELDGMYATIYGTISAVDDRFGNNENTVVLDGYEKIDLGLILEPMEGIKLQLAIDNLSNEQGITEGDPRNADAPNGRYIMPRTTRFSVSYEF

SEQ ID NO: 14093 - protein, 624 aa, Nitrosomonas eutropha
MNYRTIALPTAAVVLLAAGSVAAETVKGSPSSYALGEVVVTADRLDEYIKNYPQEVTNVTRAEIIKRNHSNLEEILKTMPGVDVYPTSGMGTRIAIRGSGKSSGVLILLNGRPMNSNQSGGMELNAIPVELIESVTVFKPPVPVWLGPGGSDGAINIITREIKRDTKGETLKSSIKAAGGSYGLLQTSASQALAVGDGNLLLTGTFNHRDGRRINSDRNDGSAALNWNRSIKNGNKYEVNGRYYQAEYGVSGPIDNETPNARQQYRKGSIDGRISGALLETGSYTLNSYGDLLNLKDRSQQGYTATLDDRKVGLKLDTSWLDEQEKWEFRLGGMSEFDNYEHSLAGRHNRFRNGLNAQFDKRFGDITATAGARGDITNDFGFTPGGVLGLGWAATQNTLLKMRVGYVTNVPTFEQLYQSTHGSIDQSRGNPDLKTEKVLSYDMSLEYRFAKNRQIQATLFRVDTWDLITSQRGADLIYRPINIAGAERQGIEVTAKSSWESGFSGDLSCIYQSSKNRDTGKDLPYTPDIKLKATAQYTIPDVKTRLEASLRYEGVRYSPAENLVMQKMNDYLTADLRVTQPLTYKKIKADIFAKIDNLCNVRYQNHYGHPDDGIRALGGVQVRF

SEQ ID NO: 14094 - protein, 719 aa, Nitrosomonas eutropha
MSRNFFIVVLLTIGSFSGWGQVDTIADQKLQEVVIMAKLPTVEMKPGKMTYRLDASITQSQGNVYDVLTSLPGIVIQNDGTIFLNGQNGANILMDGKPTYLSGQDLVNLLKSTPASITDKIDLITQPSARYDASGNSGIIDIRTKKILRRGMNLSVNGSYDQGKYGEGFASTTLNLRTNKFNFYLSYSYSRKNDYDDLYVERSYLEGWRPEGETGQMTQSSYRTWKNKSNYYRFGIDYQMSEKTTIGLSTDGNLAGSKVEGDMNSSIPKRSPQTGGLLRTLNDQNRSRDNFTAVLSLTHTFNSDGGVLDASMDYLRYRYEEDQYLNSQDTLFGDMGGGIHLYSGQVNLVWPFSKSFTFHAGAKTSFVSIDNNADYNRLQGDSWQSDHDLSCDFQYDENINAGYIQLDAKFSSVSLEAGLRLENTRIEGEQSGNAYQRDSSFTNHYTHLFPTLSVQYALRNGNSLSLTYGKRIVRPNYRDLNPFVYIHDEYTYDKGNTLLRPELSDNLELAYIYGDLFRVGLAFNYTKDVIIKSYLDQGNYVVYVSPENLSSRVSVGPRLSTSQLPLTSFWNVNVSASWIYNRYRLPENYQVKVNERWTPNIGISNQFNFARTWSAELIGFYNGKMAAGQATIYPLWQINAGIQKKIWKGRGTIQLFARDIFHSNVSRMSVMTPTQHAFIKERMNRTVVGISLTYRINRGLEVKESRRKHSVDESKRINL

SEQ ID NO: 14095 - protein, 694 aa, Nitrosomonas eutropha
MVGAAFAQENTAAPTSATTDMLPAVSVSASAGRDPGEGYNPTNAVSATRIDAPLRDIPQTVNVVTAEVMRDQHANSLQDVLKNVAGVGFSTGDGQRDQVTIRGFSAIADQFVDGIRDDALYFRDLSNVDRVEVIKGPAAVLYGRGSSGGLINRVTKKPGVGVTNLGVSYGSWADRRVEADVGRVLANGAAAFRITGAHEEAKSYRSQQFLNRTAVAPSFEFRIAPKTTVLLQADYLEDRRVTDFGIPAYKGRPVDVPASAYYGAANAGEVDYSRSRVYSSTATIKHEFNEQWSIRNATRYYHYSLDRNNTLVGSVNEANRTFTLNHGNVYREEHGWFNQTDLTQKATLFGMKHELLYGMEFGQQNKDLVNYSTPVAGANGKPMNFDLFAPALPTLPLHTSTTPAANNLGIFKTLGFYTQDLISFNDQWKALVGIRYDRFEQETLDRRPKQPGLSRTDTAWSPRLGLVWQPTRAQSYYVSWSRSFQPSGEAFSLAANNAELAPEITTNTEIGAKYDWLGGKATTTISVFRLDRSNIKITNGAGTALIPIGEQRTDGVELSGAAELSHGWRVLAGYAYLDATVTNSTAALQGKRATLTPRHSGNLWLTKNLGGGFGVGGGLNFVGARMADPQNTVTLPGYVTADMMAWYAHGPMSLQLNLYNLFNKGYIVSAHGSNANLNLPGAPRSVMATLRYEM

SEQ ID NO: 14096 - protein, 722 aa, Nitrosomonas eutropha
MTVTAPKARNKKPRTVARRATAPVRSTVASRVAAPVRSPAVPYLTPSTGTIGQPPAPYAGGQVGTTTRVGMLGNRNVFDTPFNTTGYTSKLIRDQQANTISDVADNDPSVRTNSPRYSGIDGFLIRGFPVFSSDFAFDGLYGVSDSRRPAMEPIERVEILKGPSALLYGISPFGNVGGTVNLIPKRATDDPITRLTTGFVSNGNVGTAIDFGRRFGEYKEWGVRLNGAYRDGRTPIAFQTDGFGVGAAALDYRGERFRATVDLGFQKQNLKAPTRVRRVSPGFPIPDSPSLSINQQQPWEYYKSNHQYAALRAEYDLNDFWTLYGAYGHSKSDETFFGGILNVTNALGGFTSQPALTVQDADRETGEVGVRGRFATGAVKHSTVISATGLWQDNGNANTNVGPLITSNLYNPVYVAPRSATGLSHNAPLISRRINQSVAIADTMSVLDDRVLLTVGGRWQGIDVANFDRTTGAVTSRPQNEAITPAVALVVKPINNLSLYGNYIEGLTSAGTAPVGTVNAGQVLPAIVAKQIEVGAKYDFGAVGVSLAAFEITQPNGFTNPTTNIFSVDGEQRNRGLEFNTFGEVTPGLRLLGGVSLIDGVQTKTVGGQFDGRAAVGVPDIQFNLYGEYDLPFWRTSGVATLTGRVIYTSRQFYDQANTQQIPDWTRADIGARYVTKVDGRLLTLRAAVENVFGLDYWATTGRGFLTPGIPRTYRISASIDF

SEQ ID NO: 14097 - protein, 363 aa, Nitrosomonas eutropha
MKFGTMGAALLALAPTLAAAQSVTMYGVIDTGVEYVNKVGAGGDSLVRMPTLTGTVPSRWGLRGTEDLGGGLKSVFVLESGFAPDTGGANQGGRLFGRQALVGLSGKWGQLSLGRQYTMLFWANLDSDILGPNVYGAASLDSYLPNTRADNALAYKGTFGGLTIGATYSFGRDAVNAGPSPAGTNCAGENPASKSACREWSALIQYEHKGWGVTAAYDSLRGGPGAFGGLGNKSLSDDRLSLSGYVLLSRAKLGVGVIRRDNEGSATPRSQLWYGGMAYDITPAFTLAGQVYYLKFHDSANKAMLYAVRGAYAFSKRTSVYATAGFIDNGGQLAQSVSAGAAGSNPRPGASQFGTMVGVKHVF

SEQ ID NO: 14098 - protein, 710 aa, Nitrosomonas eutropha
MKGRALCSALFLGITTAPAVMAAEKENSPLKNEETMTVRADASSADQTVTSGYQPLSSSTATLTSMPLLDIPQVVNTVSDKVLEDQHATTLDEALYNVSNVVQTNTLGGTQDAFVRRGFGANRDGSVMTNGLKTVLPRSFNAATSRVEVLKGPASTLYGILDPGGLINVVTKRPQTQFGGSISATSSSFGGGTGQFDITGPIEGTQLAYRLIGEYQHEDYWRNYGTNQSSFISPSLTWFGDNATVSVLYSHRNYKAPFDRGTIFDLNTKQPVNVDRKTRFDEKFNITDGESDLAQLNAEYRFNSAWTAKFDYSFSQDKYSDNQARVMAYDSATGNLTRRVDATQGSTQRMHATRADLQGNVDIAGFYNEILTGVSYENYDLLRTDMIRCKNVKGFNIYNPVYGTLGKCTSVSASDSDQTIKQESYSAYVQDALYLTDKWIAVAGMRYQYYTEYAGKGRPFNVNTDSTDQQWVPKFGMVYKLTPSVSLFGNVSRAFMPQYSIASYIGDLPPETSTAYEVGAKFDLFDGITANIALFNIDKRNVLYNEIVDGETVAKTAGRVRSQGVEVDVAGSLTPNTNIIASYGYTAAKVTEDPDYKGKPLPNVPRHTGSLFLTYDIHNAFMGNTLTIGGGGHGVSRRSATNGADYYLPGYFVADAFAAYKMKLQYPVTLQLNVKNVFDKTYYTSSIATNNLGNQIGDPREVQFTVKMEF

SEQ ID NO: 14099 - protein, 850 aa, Nitrosomonas eutropha
MKQFPLALIGLLCASSAWAAQDVEQQKQFSRKNLSTQADNSSDGIRVSGANGEHAGEQLAQAADEQVQTGKSSNSDNLNEQKEKDSGEPAGQNETVFREMVITGEIERDSHFTSPSMRVTRAQVEQQNAQTTEEVLKYMPSLQIRQRYVGDPNGVLGIRGADMFSTARSMVYADGLPLHNFLQASFNGAPRWSLVGPNEIDSVDVVYGPFSAEYSGNSIGGVANIRTRMPHKQEFYFEGSLFIQPYKNYGEDKGTFIGDRQYFSYGNRIQDKFTVFLAYNRLEAQGQPMSYFIDNTGLSNVPGGTPVTGGIRTPDTRGTPSIIYGDTGPEKVNTHLFKGKFGYDITSDLQALFTVAYEERTRNQNHPSNYLYTANGDYFWGGNAPTCNSVATCSTPGNASLDGTRFDVVRSGFGESRDKRETLNLGLSLRGALTPDWDVDTTFSYFDVLKDIRATAFFNHADPGNTGAGQLQDFRKFNWWNYDLKLSTPMLLGYDKLSFLAGYHFDQYNLSFRQYSLTSYEDLTRGALQANRNNDGRTSTHAIFAQSMFRFMPDWDITAGVRQEWWEASKGVASNVAVPDRTETATSPKVSLGYEPGQWKFRYSFGRAHRFPVIAELFQSLGTPTSILVANATLKPENGVHHNFMMEYGLPKGYVRVNVFRDDIKDAIRQITSASGALTTSAFQNIGEVGTTGVELIFEQRNILGSRFDFMFNGTWMNSKVEDGPVVRFTESTGVPANYSLTGKQVIRLPHWRVNVFGTYHVTDAWDVSLSGRYTSDSYNDPDNRDYKNNVFGAQSDFFFMDFKTSYRYRFNNGLKSRFSFGISNLNNDKAWVFHPYPQRTYLLEAAFSY

SEQ ID NO: 14100 - protein, 283 aa, Nitrosomonas eutropha
MSPPVYSDISRNINDLLNKDFYHATPAAFDVQTTTANGIKFSLKAKQPVKDGPLSTNVEAKLNDKQTGLGLTQGWSNTNNLQTKLEFANLTPGLKNELITSLTPGVAKSAVLNTTFTEPFFTARGAFDLCLKSPTFVGDLTMAHEGIVGGAEFGYDISAGSISRYAMALSYFAKDYSLGATLNNEQITTVDFFQNVNAFLQVGAKATMNCKLPNSNVNIEFATRYLPDASSQVKAKVSDSGIVTLAYKQLLRPGVTLGVGSSFDALKLSEPVHKLGWSLSFDA

SEQ ID NO: 14101 - protein, 680 aa, Nitrosomonas eutropha
MMAIVAAISFGGIGPSQAQEMDSEDIDARKKVIELESLTITANKRDQKINEVDGSVLVRDGKDLEKAHVTTVADLERVFPGLMIQSRGSRSYANFSLRGVNSPDFYNPSIQVYVDGVPQDSTFFTQELVNVERVELLRGPQGTLYGGNAYAGVINIVSRKPDNAVKGMVGGMVSTAGGETETSLAGPVVRDALYGGLSAKWSQAFGRIDDTLTGKDDIDSSKGGMVRGQLRYAPTGSPWDITAAGQYDHLVSNEEIPVEDPHKLVYSSALYGIPEYTRKVTTGSVNASYEFDRGTLSSLTSYQDRSLERFAYAMEQPEFQTTLSQEVRYAFGDKDGPLDGVVGAFFKDTDFTRKTAQYYTYQGPSENAVASRSYALFGEMTQALTPVLDVTGGLRYSYDTSEIDFTRQGASFYPALDFENSADFHNVSMKLALGWQINEDNRVYGLISRGYKPGGFNHAVMSAADRQAFDNETSTNYELGWHGTVVEDRLWVNASAYLIEAENKQIYVTADSMTGLQALRNLGDSRSYGLEVDVTARPLDSVQVTLGGTFGRSVFVSSTDPVTGEDYDGKTLPYAPDYTLNAAIEYTLPLSSFPGEISLRGAGRYVSASYFDPSNSLKQDGYPVLDLSVNLATDTGIKVAVFADNIADQGYRTYSYSAGATTYSTAGQGRTVGMRASWAF

SEQ ID NO: 14102 - protein, 319 aa, Nitrosomonas eutropha
MPQPPFTRSATPSTFLMPLLFAAAAALPCTSVLAQPPAAEDSAQGEALSPPASPKEGKGAYFSDWFNQDLTLIGSKDISFGPKPNDDIYLEYEYFGRKGPFELYGYVDVPKILGIGNDNDKGVWDHGSPLFMEHEPRISIDYLAGRSLAVGPFKEWYVAFDWIYDHGSNSANRANTLYSGIGTDIDTHSRVNLSANFYGRYQWENYGASNEYSWDGYRAQLKYIVPISKFDNGASLTYIGFTNFDFGSDLKNDPARTGNSTVATNVLLYAFTHLRFTLVGRYFHNGGNWQDGSELNFGEGNFRARSDGWGYYAGVGYQF

SEQ ID NO: 14103 - protein, 242 aa, Maricaulis maris
MPHTFKIGVLAAAVMAVAPAAQAFEAGDFILRAGAAHVAPDASSEQIKVGGAAFPTANSRVDVDANTQLGIRGTYMVTSNIGIGLLGATPFKHNITGAGDISADAKLGETKHLPPTLTLQYYPMHSSSAFQPFVGLGVNYTTFFEEKTSSTLTNVIDGALTSTNVGSTKLDLDDSVGVAVEVGMDYMLSENFGLNAAIWWADINTDAKVSVYDTAGNFVAATDKFEVEIDPMVYMVGFTYKF

SEQ ID NO: 14104 - protein, 992 aa, Maricaulis maris
MRDIEGSVADKESGMPLLGVNVIVEGTSQGTTTDFDGNFILPSVQEDATLVFSYLGFKTLKRKVAGKFQFEVQLEADTEALDDVVVIGYGSSSKRKITGSISTVNSESIQDLEPINAATALQGTSAGVTVTPQSGAPGAESNIRIRGVSTNGNSSPLIILNGAQYDGGLNSINPQDIESITVLKDAQAAIYGSIGANGVVLIETKRGERNQSAVITYNTYVGIQETTRELSLLNANEYVLLTNEKYANAGQDLPFTNLSQINNNTDWQDQVFETPTVVSNNVSIRGGSENTDYSFSASHLDQGGIVAPDKSNFKRSTASISINTDVRDFLNVSANVFFTNNRSQGINSFGLGSVLFNAINIAPVINRNQNNLDGTIDLGNEVVNPLAQINNTFNDFESNRLSGSFKAELEYIKDFKLTARYGFNSSKLNNREFFPEFNFGNGKVFNRPFNQVNLNQQDFYDYTFDLFNTIEKTFFDDLDVNFTLGTTVFRAHGEGLFGSRTGVPRNSFQFADLDSAIGVGDNQTNGSFVNEFRRLSYFSRVEFSYLDRYLLSGIIRRDTSSNFGPNNASAWFPSVTAGWIMTEEDFIGTNNFINFAKLRGSYGQLGNDQIGNFLFLSRLNGEATYVFGEDQSLTEGQALGPLANPNVKWEISTKLDLGLDLEFLNRDLRVTFDYYRNEREDLLIPSIPTSGIFGTSAPGSLAPTINAGTVVNKGIELSLNYSKEVNDDFSFSVNYNLSTVDNEVTQINGAPFLEGGQFSVGQLPPSRMEVGLPIGYFYGLKTDGIFQSQAEVDAHPSQALLGATARPGDIRFVDVNGDGTISQDDRTYIGDPIPDVTMGFNLSFNYKNFDFSAYSFANLGSEIVRNFERDQVNVNMLSRRLDRWTGPGTSSTEPRVSAGATANKLFSDYFVEDGSFLRIQTISFGYSLPTEALKTVGLTSVKIYAKVDNAFTFTEYSGYDPTASTGAPIGGGIDLGFYPLPRTYTLGLNVKL

SEQ ID NO: 14105 - protein, 965 aa, Maricaulis maris
MINQGTIKGKIGIENNNGFTGTITVKTFENKKNIDGHIYMGIWGGNGGTISIETFNNEGTITTSNNDGVIYNDGVIYFEGTTHIKTFKNTGTIESKNGKNSITVKAKNSQTPTLENFINDGTIKGKIGIENNNGGFNGTITVGTFENKKTIDGHIYMGIWGGNGTINIENFTNEGTITSNNNDGGVYFEKGNIHIETFRNTGTIKGDDDGKNGQGVYFKDIRVVKTFENTGFISGSGDNSQAGGLMTGGGVSMSGGTIDNFINKGTIKSTGKTNDPAGVKLNWATVKTFENTNTGLISGINGFLTTKGTIETFKNSGTIESTSTGNGEAAIKIQTVNGNFSTITHFINEGTIKSDSNGVLIESGDKIGTLTNQGTIETKLNGISFFDSGPEGSPGEADLGKIVLESGSSIKAGKNGINIDHETTARSIRVDSIEVKAGASVSGNEAGIYLGKGKEITAPITVSGTVSGGNAGIVNEGRMAKGITHDGEAELVISNQGLVDKGDDGNTVTNDGSGSVRIKEWLVTTDESTHRLRTVHVGGKNKANVRVTNITVDQSGLDLNQLNDITNIISGVSPNNIADSVKTNGGGEISLSFDPLSGRLSTDVQLNASIAGASFRSSLATASKRATFIDNVMANAMQSFSLDSSGKAQKIALSEKGNLYADASDYIKNDLTRDYIKNDYIKSDLTQANYGLNKEHALFILPYLSSQSVELSLNEESKGHTKGTIIGYSTLKDSGIYGVYAGYEDTKMDSTYFDVNNISYYTGLKYFNTLFTTAKGQEVYIKAQAQAALIKNDFTKRIGKNEAKAKAHSYTYGIHTAWGMNFIADKNIFSPEAGFAYEGSYTEAFSMQDTRGQATVRGGERTYANHLNLFSTKTSFTWFRDWLPNLKTSVELGAKFNVNPKVKARARFGNMKVNDEFHLPRVRKFASTSLIVPVNEAFYFSLNYNGMFDEKGNTHTGFAQFNYLW

SEQ ID NO: 14106 - protein, 118 aa, Maricaulis maris
MFYGNLSGGRKFGNWSLNAGLEGGAMVYAKATDDHWMRSLRFADKFDIGGMFGAKAGIAYDLTDNASLYLDGAYEYTSFSRGDKTATPFGSSTGLVYNNAGGGDMQSLFVGAGVKGRF

SEQ ID NO: 14107 - protein, 663 aa, Maricaulis maris
MFRLNPFVRVGLCLSAISCVWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 14108 - protein, 667 aa, Maricaulis maris
MTVKDAGAATNASINLRGIGTYAFSIGVEPSVSVIVDDVPVVQQAQAFNGLSDIERIEVLRGPQGTLFGKNSSAGLVNIVTKGPSQEFEGYIEAAATDDDELRINASLSGPIGDRAGYRINAYTQQRDGYINNFTLGEQYNDDEGFGIRGKLVIDPTDNLSIQFVGDYSERNIKGGVSTYRDIPEGSLLFGAFPTDLFTEGLVPGEDNYNTRLDYAPVSDNEQLSASMKISYALGDFNLVSVTSYQDWSYLFEQDVDGTEFDIAGAFTGGALSGGIYQIAPFEADQITQELRLESPQSDSFDYIVGLWYSSADTTRVFDRQPLFVADWDAGTGNTNMALFGQFNWHLSEKLDLSLGGRVGREEIDVFFNDTAAGTSYTGDDSETFTVGKAAIQYFLRDDLSAFASVSTGYKGQGYDVSSGFNQDRADNPVGSETATSYEAGLKGAVIDGRAQFSLVAFMTDFEDFQAQSIEVTQEDGIVVALNNVGELRTQGIEAEFAMQLSASWRLDASAAFVDANIESFSGANCYPGQTEAQGCIGGVQDLGGEDLANSPDWKYNLSLTYETPLAGMPFGLFANANYSYQDDVNFDLFANPRTVQDGYGIANFTFGIAENDGKYRITAFINNAFDERYASFINDNSGFYGGSPVMTHILPRNSQQYAGIRARWSF

SEQ ID NO: 14109 - protein, 1041 aa, Maricaulis maris
MMKNVVKKNQKIPFLFMLMLLACMSASAQFQVKGTVVSANDSEPMIGVTILENGTHNGCITDLNGNYSISVESSNATLEVSFIGYKSQTVKVSGRNVINFRLEEDTEVLDEVVVVGYGVQRKSDLTGSVASVKADELKGLSTTDAAAALQGKASGVQILNGSGKPGQGASIRVRGYSSNSNNIGPLLIVDGLQVSSIQYLDPSMIESMEVLKDAASAAIYGAEAGNGVVLITTKSGKKGRSSITYSGKWTNQSLGDVPSLLNATQFKDWMTMQLGAESVNAALADAQTQYGWDPNTNTDWLKAYFEDTWAQQHTLTLEGGNDRGSYFLSVNHVNQDGIVKGSKDKYERLTAQINADYMIKDWLKVGTNTSIEKWSTRGISEQGYGSSFEMLLLIDPLTPLYWTKPEQMLGEYRDYYNKIQAGDSNYTLFGDENGYYATSYFNQRLAGGNPFSQRDRSESRNSGVNVNGTAYMNVTPVKQVTFTSRLGYRISFNNESDYQYPYYLNGQTKGDNYIISGASRNSTWYQWENFANYNDIFAGKHAVGAMAGMSYRQSDSNFVSANASGLDILKAYSSNFIYLDCVNANEGTTKNIGGIKGTTRALSYFGRVTYSYDNRYSVQANFRADAFDSSKLSKDNRWGKFFSASAGWTFSNESFFKDNVNPSIMSYGKLRASWGQNGNVNVLSNYAYTAGISTNSQFYNYGSTSAVTFGSMPNGIANPNLTWETSEQIDLGADFRFLNDRLSVGLDYYKKNTKDLLVSAPTMPESGVSSMTMNAGKVENSGFEVELSWKDHIGDFKYGISANMATLHNEVTYLDPSIERISGATVEGASPEVVRCYFEQGEPIWYMRGFKYAGRAADGTAQYYTKDGELTNDPQAYDMTNIGSGLPTLTYGITLNAEYKGFDFTLFGTGAAGNDVYYGLYRSGYNNLSEGIYKDFKSGKLPDAASVTGSGTFWRSSAMVYDGSFFKIKQIQLGYTLPKRITNKVFIDNARFYVSLDDFFTFTKYPGLDPETCTNEYNCPGLDKGAYPIMKKMVFGVSVTF

SEQ ID NO: 14110 - protein, 214 aa, Maricaulis maris
MRIKSLVAAMAAVASLAPIAAQAQTQAVEDDNPWMVRVRAVDLLFQNGQTNTVSTLNVKAQNQWIPEFDVSYFFTKNIAAELVLTWPQQVNITAGSGNTNVGKISALPPSLLVQYHFTDFGAFKPYVGVGVNYTIFGNRQNFPALGNSVQVDQSSVGVVGQVGADYMFDKHWGANIDVKYATMSTNVNTVQGNTNLGKLTLNPWMPAVGVTYKF

SEQ ID NO: 14111 - protein, 1017 aa, Maricaulis maris
MSNITIRNYIKGLEMRRTNFKKSVLATSIAVVLTSSSPSLAIAAEETNADDNIEIIEVTGIRASSKASINQKRFATSQVDGITAEDIGKLPDVTIADSLQRITGVQITRSAGEGGTIAIRGLPQVGTTMNGEVFLSATTIDTSGANFGDLPAQLFSGLEVFKSAEASRSAKGISGSVDLKTRRPFDMDTGWTFNAAAEASQGSISEETDPNFNGLVSFNNDKFGVLFSAAKQQATLATDYNGYFDTSEDGGIGAANNSHTWGAGPNSGDIRHVVPQGFAAFNKQEERDRDAFQLSVQADLGEGFTLTADAFYSKQERFNNRSGFSQNNRWQSFNDYAFPSDGFTDDAPFTDDDGNEWRGVNAFDMKSYRMQSFTQVNINEEESQNYNLQLDYDNGGALTGGVRMTRAKAEASMRHAYGEGDILSIDQGTLVTGPGGLAPASYCNNGEEIVGDQGGCFAQYSQGIQDQFMLNYDARGEHPHFSGFNQMVNGGKGMRSVGDYMSDLDSYHVGAFSSEGNTDDVGEINTFSTAWNYAFDDMPFITSVDFGVRYEERKVDHDQFTYTSEFGGGCDIAQWKAVDQFYGDECVGVDGAGEMVDGEWTPYTLLAPTRLDEHTSVSYQTDFGNVTGIPGVWVIDPENFRDPRQFQKDVFGNVQRVENAGRTYDVNLNEFSYFLQANFEEGIFSGNFGVKVVETEQYVKQNLVGPSLPHSGLNPDIGDVVTERDYTDVLPSINVAAAVTDDVILRAAYAKNMMPLNLGALGGGKSVGKVFNEECGCLRVVEGSLAGSPDLDPWRSTNYSVSAEWYNGDASMMFISAFNIDIESFVGSGTVMIDEPDDDGVKRGPWPFSTPVQAEGGSIKGLELGARVAFDDFIDVPVLSNFGLDANYTYSDSTQDSDLAKDVYGSDLPFPGMSEDTYNFVLWYEQEDFSTRLAWNSVSPRLITTGGAGVGGQTLYQDTYSQLDFSATYNLNEMFSFYVYGSNILEEYQQTYLENSSQKAFQNVYEARWTLGARMTF

SEQ ID NO: 14112 - protein, 695 aa, Maricaulis maris
MTLKPPAFALSLLSLSLLPLLGHASETRDPLLNIADVIVVRGEKPTAEALATTHWRIDAEDIRNSGAQTLDQVLATVPGIHVRTGGEGTPRIDIRGLKTRHVTLLINGVPAASAADGQFDPSVIPTSQIAAVDIAVGPASVLYGPGGAGGVINVITRSGDEASVSGKLEFAGSDTLNADVALGGGGDNWQGFVSAGKQKRESWPLSDDYQEAPNQPAGDRLNADREVDNFYGQGSYWLSDATQLTANINLREGDWGKPGRDGSGSGRAKFERVDDYRNISSQLGLAHRFGNGMTLRGYGYYNRTETLESAYTDISFSDLDSQQRGESTVQGLNLQLVTELGRHSLLTLGAGAEEQRWDELATQYSTSDSGSGSGSGGGSGGGSGSGTGGGSGGGSGGGSGSGSGGGSGSGSGGGSSSGVPTETGFDDSAWVYSLAAEYQYQRDNWGATLGGAWYQRDGDTSVDEPSAMAALYWQALSQTRLSASAARKVRFPSMENLYSLSAGNGELTAETSEHWELGLEQGFALGSFEVYGYETGADDYIAKGTDGIYANLGDYRFRGVDARLLISPLQALDVSLSYSFLDSEDKTPDSTEALQYRPRHQYGLTLDYRFDTDTRVHLSWQKVMDQIYFERSGKTMVERNLPDYDLLDLKLSQSFYDDKLALYIRATNLLDENYAESESLPQAGRQWFIGMDWRL

SEQ ID NO: 14113 - protein, 1020 aa, Maricaulis maris
MKKTHYSKLKLGAAPLVLSVALVSAPAYAQDAEEGATGSSEIVVTGTLIRNPNLEQSTPVNVTTADTIELKQSNVAEEVLRELPGVVANIGSAVNNGNSGASYVDLRGLGSIRNIVLLNGNRVAPSDVNGRVDLNNIPLALIERVDALTGAAVTTYGADAITGVVNFVTKRDFAGLEVTASNQITEEGDGHIFRVDATIGANFDDGRGNAVLSIGYQQADPVYQGARPFSNDTLDSYSNQFIGSGTSVPSRFSGTRPLDPVTGQPSTDPTVANGGLRQVNAAGAAVPTFATYNFNPFNIFQTPFERFNIYAQANYEVSDSVEVYTRGMFSKNTVSTIIAPSGSFGGTVTVNLNNPYLPSTLRNQFCAFNVAAAGSGLYTPRFTPAECAAAATATGRTDPNYREVTVTLNRRTPEVGPRISDYQTTFFDYRVGARGGITDTIDWSVEGAYGESENIQTIQNYTLQSRFREAALANNTTTCQSGNANCVPVNLFGPEGSITPEMADYLSENSSTTNRTSLAQVRAIVSGDLGFASPGAVQPIGFALGGEYRKYTAQQASDLLAKTPGELGGAGGAAPDIDGAYDVYEAYAEIVAPLIEDKPFFESLTLEAGVRYSDYSIEGAGGYDTWTWKAGGSWEPGAGVKFRGNYSRAVRAPNIGELFTPQTVGLTNLGIDPCAGAAPTTDANLRAVCIAQGAPAGTIGSITNPTAAQANITVGGNLNLQPEKADTWTIGLVWQPDFLPRFNMSIDYYNIKINDVLGTPLPGDIIAACFDNVTAASASDPACTSIRRNPITGGLDGDPSTTPGLFGLTNNQGRLFTDGIDLLMNYSTDLGFASLDWSFVGNWTNSSKFNANVANPDSLNRECVGYYSVNCSFTGSIQPEFQFSNRFTLGFDKVDLSLLWRWIDRVDFEPQQLQDDIDAAVAAGTSPTTGCPDPTGTDPNGCVVDPQFRSVKAQHYFDLTARFNVSENLVFTATVQNLLDNKPPLLGNTIGSTTYNSGNTYPSTYDALGRRYAVSAKLKF

SEQ ID NO: 14114 - protein, 885 aa, Maricaulis maris
MKTQFKLGLTALAVAQCLNISIASAQEAADVDKQVDISETEVITVRGFGSTLTRSLQHKKLADSTVEIISTDDLGQLPDVTITDALARLPGIAADRDRGNASQISIRGMGPRLNLATMNGREIVSGEPSRSVRYEQFPAELISSVEVFKSPLASNIEGGISGLVNMQFVEPLTKDERAVNISGHLMSYPLADDIPTADSQGYRANFSYIDPISDTFGIAFGVAVQDQPSLQKDVTSWEYNNVPADQGDVNGNGIPEAAPWGAQTATKGGDNQRIGAMTVLQWLPNESLELKYDLFYSKFDIEEREDQIWFDGWGNWGGLNNWNVANASNPPQIITKPDGSEQIVAGGMLWGGSHTANNSTWFQENELVSTGLNAEWLGDVWKVNADIGYSEASITSRWVNIQSWYWDADADANGMDYSWDTTAERLSIGTGYDMSDVTDYGLDYMQVDNDRLLEDEMITAKLDFSRPIEWGIIDAMSFGGRWTDREKDNDVVSWQQSVANSSANVDAFTYELGEGYGVPALYSIKNWSEVAQEAFGGIDNRNQHTQTNADILNSWNVQETNTALYVQFNLLGEIGGISYTGNVGVRYINTESTSTGFQQADGGELTAVSIDHDYSEVLPALNLRFDITDDSQIRFGLSRAISRPPLIEMRTGLQINTSSTVNSASGGNPQLNPFIADQVDLGYEYFFAEDAALTVSLFFKDLKSHVGAATDTLNINGESYQFTGPVNGDGGQIRGVEVMYQQAFNMLPEPFDGLGIYTNYSYTDTNVTEFEPENNPLTMGGLSKNVGSLTLWYYKAGIDAKVSYNYRSAYTSVGSWDPGAVFTIDDEATVDASIAYEVTENFKVMLQGQNLTNEASTSYFDNDPTRPRQYAEWGRRYLLGFQYAM

SEQ ID NO: 14115 - protein, 779 aa, Maricaulis maris
MKPNLKIFLLLLFFSNPLMGWAQEFEVSGTLRDGERNEPLSFVQVALFESLSSVDPIAFSDTDDQGKFTLKADQGSYVFKAFFIGYKDLVRENVNVNGKVSLGEMEMENEAANLDEVVVQTSKMPVRSSLEGITITPENNLANAGGTLLDVLRNTPSISVSEDGSISLRGSSGTNILINGRNSSLTQNLDQLPASAVEEIKVINNPNARYDAAAEGGVIDIVLKKGQDLGTHGGVEGTYGTRGRSNIGGRINHRTETFNVFGGYNYRNWKQVSRRSSIREIFEDQERLEQTTNGSDREKSHNLNLGADYYFGDNVLSYEGVYQYGHQFQTNTLYSELSSLDPNESESSYDYVRRNNEDEIDEGLDNALIFEHNFDDKGNLLRVTASHSYRNQYKTQRIDIFGNSLETNPENLTGQEKAFTDEVRNITVLQADYIKPWETGQFETGLKSNIRKFDNDYQYFRFQETSGSFVEDPAISNQFIYQDQIHAGYGIFSSKKEKFEYALGLRGEYTRVDTYLKNTDEENQQRYFNLFPSVQGMYNLNENHSLKFTYSRRIDRPTAWRLNPFPDITDSLNIRRGNPNLKPEMINSFEVGHLANFDKSSFTTNLFYRKVNGQLDFITIVEDGISYSQPANLLSSQSYGLEFIGVSEINDWYSLNGGLTLFRIAVDGSNIGEDFTNSGFSWNAKLTQDFKLPYGFNLQLVGNYDSPEVEAQGRDLARYSMDGSIQKSFLNEKASLLLSVRDLFDTQRFAGETLTSTFSQDFRAKRETRIVLLTARYNF

SEQ ID NO: 14116 - protein, 370 aa, Maricaulis maris
MKKRLAWPCLFLVLAGAGHAQSSVTMYGLLSEGVMVTSNAGGHRQWQLASGVQQAPRWGITGKEDLGGGNRAIFTLENGFNLSTGTLGQGGRLFGRQAFVGLANERLGQLTFGRQIDTMAQTLAPYEAAVQFATYGPPIGDSDNIFPTFRVNNTVQYKSPEVAGFRLLSAYALSNMAGGFSVNRDFNAGLTYANGPLSAGIAYHAVNRPNDAANPSGAVSGDYGFTSPFATSATGAGVDKQQMAGIGGSYALGPAKVSLMLTHVLFDYVDQSRLRLTNYELTVTDFLSPTVLIGMGYIYTTGRYQPTGKSPKWHQVDAGIDWFLSKRTDLFLVGIFQKAAGDAQYAQIYYNSPSSSRQQISASIGIRHKF

SEQ ID NO: 14117 - protein, 340 aa, Maricaulis maris
MRSKRAAREFSDTLLDLSQLQVLEVKLEAINAQSQAGKERQTQEEQEKIQGKQKELISRYSNSALSELSATVNSMLSVQDELDRLFVDQAQSSVWTNIAQDKRRYDSDAFRAYQQKANLRQIGVQKALANGRIGAVFSHSRSDNTFDEQVKNHATLTMMSGFAQYQWGDLQFGVNVGSGISASKMAEEQSRKIHRKAINYGVNASYQFRLGQLGIQPYFGVNRYFIERENYQSEDVKVQTPSLAFNRYNAGIRVDYTFTPTDNISVKPYFFVNYVDVSNANVQTTVNSTMLQQSFGRYWQKEVGLKAEILHFQLSAFISKSQGSQLGKQQNVGVKLGYRW

SEQ ID NO: 14118 - protein, 189 aa, Maricaulis maris
MIKTLSLSTLALVTLGFNTAAKADIADFDSPRIYTGVGYGQYSFEFEDSDKDTDFDDDAQMLKGYVGAQFNEYLSLELAYQNFDEVSDVDSKAEIDGVSLAARLGYPITESFSVYAKGGWLEWDAEYTQDLPVGSVSASTDGGDAFYGAGIEYALTTNVQFRLEYERYKLDDDIDPDMDVASVSVQYMF

SEQ ID NO: 14119 - protein, 415 aa, Maricaulis maris
MKLFQRLLVAPAALGLMAPLAANADVTAVSNDSDLSSEVIQARVDGVEAQLGEIMAGQFSSSTKMSGKAAFITGYVDDDAESDTDSITMEYMYQLNMNTSFTGEDMLYTRLKAGNVSDHFVDKGQGTYLSAGKNTSDSLTVDKIWYQFPVGDDVTVWVGPKIENYYMLASSPSIYKPVTKQFSLGGNGTVYGSSTKAGFGAAYVQPTEDPSAGRFAVSVAYTNQSGAKSGKDQGLFGEDGKSALLTKLEYGTPQWQVSGAVALKENGWSDSYFTTAAGKARSAAGSETAVGLRAYWRPDTTGAIPEVQLGYDVSTIDDAPTGFADEASGWMVGLGWKDLLIDGNRAGVAFGSRVSATSIVGGTSDPSEDNSVWEAYYSFKINDGVTVTPAIFGGSDVESEGKDVSGAVVLTEFRF

SEQ ID NO: 14120 - protein, 118 aa, Maricaulis maris
MRMAKIRVLLRHQTGYLRPDWLVYPNWYLNTQLNWIADRKRAFGDPRTALDDYTTVNLTLRRKEIREGHWNFAMGVRNLFDIDSREPSVGPGQDGIITIPHDLPLAGRNYFMELRYRF

SEQ ID NO: 14121 - protein, 282 aa, Maricaulis maris
MSRMIRPIFASVALALATSANGADLYVPPEAPLPPPPVIEQQPVSVGGWYLRGDIGYRWSDLRGTEYITYGPPPGTSEFTTTELDGAMSLGGGIGYQITRHFRTDLTADYWFDSDFRGTTAGFCGGVPCTSTDRSSYSALLLMANAYVDLGTYYGFTPYVGAGIGGARIKWDRLRNTIGDDDFYHDGGKEWRFAWSLMAGTSYCLTQNLQLDAGYRYTRIQGGRMFEFGSGVGPGFDDGFNVHEARAGLRYSFGGANANCAVPQTIAYQPAYEPPVEPVIYK

SEQ ID NO: 14122 - protein, 364 aa, Maricaulis maris
MRRRAWLLAASAAAGWAGQAGAQSSVTLYGRLNTALEYARANTATDGTHLGGTGRLTNNRSVFGMRGEEGLGGSLKAIWQIESNLSLDNGQGQIAGRNSRIGLQGKAGTVFMGHWQTPYTEATAGYDPYYPTTAGYMALMGNGSASSTDNVQDTSAFDRRQKNIVVYKTPSLAGFSGAAAWGVNEEKISVPRNPGLYSFSAAYDSGPLNVVLAYELHQHYQTAGRNDDAIKAGVSYKFPSTTVALVYERLHYRTATGDLTRNAYYASLVQKLGPGSVRVGVALAGNGAGDATETVGFFRSGAETGATQVTVGYDYPLSKRTALYAYYSRINNKRNAIYDFAINELGVSAGADPQTFALGMRHVF

SEQ ID NO: 14123 - protein, 859 aa, Maricaulis maris
MSSTFTPVARQRARLTLSLLTIAVLGASLQLTNASAASESTHATRPAATYPFSISQQPLVSALNEFSRVTGWQVGMSAGLAQNVISPGASGELSAAQALDSMLSGSLLSYRNLGNNSVVLEKRAPTAGVMALDQITVSATRQAQDVATVPSTVSVHSREELDRDNVNTLRDLVRYEPGVSVGGAGQRAGTTGYNIRGIDGNRILTQVDGVEVPDSFFTGPYAQTHRNYVDPEIVKRVEILRGPASALYGSSAIGGVVSYYTLDPDDIIKPGRNVGARLKTGYSSADESWLNSATVAGRQGEFDGLLHLSQRNGHETESYGSTGGSGLSRTQANPEDARSTNVLGKLGWNYGDGSRLALAYEKYKDDRDSNLKSAVGGPFTNGTGLGMYQSREGNDTITRERFGIENSFALDSLLVDNVKWSLNYQIAKTDQSTRERYFPFSRDVIRERDTQYQEKQWVFDAQLDKAFSVASTDHVLTYGTTIKRQKVTGLRSGSGTCARVFGSCRAVGADSPSDRLAATSDFPDPTITSYALFAQDQISWNDWTFLPGVRYDHTRLDPTFTSQFLRSVSLTDPDQANDETRTWHRLSPKLGVTYALSDAYTWYGQYAEGFRTPSAKSLYGRFENPTAGYVVEPNPNLKPETSKSYETGLRGRFESGSFDIAVFYNKYRDFINEDAITPGYSELTFQSNNIRHATLKGAELKGRLNLDSLGAPNGLYSQASVAYLHGRNDDTGEPLNSVNPLTGVMGLGYDRDHYGGLLSWTLVKRKNRVDDSNFHTPDGTSSQFRTPGFGILDLTGYYKVSDDVTVNAGLYNLTDKKYWRWDDVRGYDGVGEAGVTAPANLDRLTQPGRNFSVNVVWDI

SEQ ID NO: 14124 - protein, 721 aa, Maricaulis maris
MSRFPLIRLHLSGIFMKIISVRQRLYPALLLPLTFSPVLQAASASNEQTMIVTATPQTVSELDTPAAVSVIEGEDMRLATPRVNLSETLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGLNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 14125 - protein, 656 aa, Maricaulis maris
MAAKTAVLRARLLCGTALSVWIALPVAGQDLEDEVFSLDPIYVRQQDDRGNAADRASSVYVADAELERSRMGDVKDLFAGIASVSVGGAIPLAQKIFVNGVDMLNLAIQVDGVSQNNRVFHHVSANAFDPGLMKSVRVDPGVAPADAGPRAMAGRVVMETVDAEDVLTEGQSIGGVARLSYSDNGDTAQGSLTLAGESNGFEILAYGKRATGDNYKDGSGVEMTGTAANLTTGLLKLAYESLQGHRVEFSAQQIEDNEIRNMRPNFGPSVSGEYAYLTTRSNFSLRYENVNNTGLWDPSATLGYSVTDIDRPDDAYGSSTFSTSRTYSVVLQNEFHLSQNNTITAGVDFQNRETSIEGSWVAPDRAREKSDNIGLFAQARLEPTNRLSLSAGARYDWQDFTGYQWLSTDAVHNSSHSGASGNLSLAYDLTDDFSVRAGYSNVFGGIDLGDSFEFWLTRDYSGLRASRAQNIIIGADWTPGAWTVSGEVFQTEFDDARDGTTTVDFKSQGVNLGATYGWASGFARLTYSYSEAELNGVPSSNYDLRDFGAPLGHIIALEVQQELQQYNMLVGGSLQAAASYDPQGSYAGQAIPGYQVVNLFAEYSPPSLNGVTIRGSINNLFNENYADRATYGGEFTGFSTMNEPGRTLLIEAVARF

SEQ ID NO: 14126 - protein, 480 aa, Maricaulis maris
MKRVARAVVLAWGLPMLAGVSIAGAARADDAAPAAPAQAPLAATLAQQATTPNALVNADATQAVLPQPPMSSQAKSKGFIADSHFDVLLRNYADVLDAKGGPHRHAWVQGVMANFESGYTGGLIGFGVDASIYAALKLDGGAGGGNMVHVAKGGGGSNQLAWAFPGIYDVKARISNTVIKYGLQAVDNPFMEQHDNRALPPTFLGATIVSNEFKNVMLEAGSFTKTNARGHTTLTNLTTQYGGTRVDRFTYVGGTWDYSQTGSASFYAGQADDVWRQYYGSVKQSYGSPQTVKWTGFGNFYSTHDTGDARQGKIDNNAYSLSLAAQHGPHELLLGYQQVLGDQFFDYLNETNGIFLVDSMDVDYNAPHEKSLQLRYTFYGKEAGLPGFKAMVWGVTGWGADGSASAALDPTRSSIYWKDGAPVQGRHHEFGFIPSYTIQSGKLKDTKITFIAMWHVGSAHYSDSTNQEYRLVVNVPVKVF

SEQ ID NO: 14127 - protein, 546 aa, Maricaulis maris
MKHLGILALLSAALFATAPASAQSSGGLLMDRDIVTPSDLFELSQTTFSLGTARSMAMAGAFTSLGADLTSMAINPAGLGMYRHNEISITSLMSFARAENNAPAFNSNSKNRFSIGNFGFTANVYEGSGPLVSVNIGFGYNRLQDLNYQYSYYTQGNVSSIADVFSDMLQYSGINRDQITGGFNWSNFNPRLWGSILGYKAGFTDQIGSRWQPTWIGNNVDIGNYTTVVSNGSIGEYDISAGFNLNNKFYIGATFGIQSLYQRKTYYYGEDYVYPGNGTDPNLDYQLLYSNFNQEVILDGAGVNFKLGMIYRPIQNLRIGFAFHTPTYYWIDRTYQAYTDSGVHVNNPNDPDGLKPGPDGNQYTDALSPVLEDTGGYNWEFTTPARLMFGISYAFGNRGLISVDYERDWYNGMRMKNNPAGGDNEIYNDTFRSWYKGANIVRIGAEFKPLPFLAIRGGFGYMGSMLQDEEQVSAAPMTKQMLYYSAGLGFLLSPGVALDLAYNYSSTEQTDYNLYYFESPSGINGSGIYNTKLKRHFAALSLSFRF

SEQ ID NO: 14128 - protein, 977 aa, Maricaulis maris
MKRLFFGVVFLAILSVQLIMAQSFVVKGKVVSKTDGMPLIGASVLQKGTTNGVVTDIDGNYQLQIQGKDAMLRFSYIGMQPQEFKVNAQTNVLDVTLVDNTEMVDEVVVVAYGVRKKGTIAGSVSTVKSEKLENVPAAGFDQALQGQTPGLMVISGSGEPSAASTFQIRGTNSINSGTSPLFILDGVPISSSDFNTISPSDIESISVLKDASSTSIYGARAANGVVVITTKRGRSMDGAKVTFRAQYGFSQLTRSKWNMMNTEERIQYEKEIGIDAGKDYDVLRRTNVNWLDQVFNDSAPLQNYELSVNGATEKTNYFVSGSFFDQDGITTGSTFRRYNMRANVENKATKWLKLGTNSMFSYDETEQAESGNGYALNAPIPAARFMLPYWNPYREDGSLASINDGSWTGTGENPLEWMANNPVKYKKYKVISTLFAEATLLEGLTIRSQFGIDFSHQSAFMQSFPSYKPNNLQGSSGRSSTDILNLTITNTANYRFMLKDIHSFNFMIGQEGVDFRQEGFMVSTRGQNNDFLTNVTSGTRATSWSDVAAAYAYVSFFGRGEYNYDDRYYADFSVRTDGSSRFGVDGRWATFWSVGLMWNLRKEKFIQKYDWLTNAQVTFSTGTSGNSTIPNYDHLALVSGGLDYMGEAGIAPSQRGNEKLGWEQLWTTNIGLHLGLFSRINFDFEFYNKRTSNMLMEVPVSYSDGGYSSRWDNVGVMVNRGVEMSLNTDIIRTKDFTWNINANVSYNKNELKELYNGADEYIVGTTASKLTVGHSVSEFYMNRYAGVNPANGDALWYTKDGEVTTELREADKVMTGKSYIAPWQGGFGTTLTWKGWSLNTQFSWMADRWLYNNDRYMEESNGQFSMYNQSKRLLYDRWKKPGDITDIPRHGVYAQHDTRFLEDASFLRLKNLMLSYTLPQNWLKKTKFISSARLYGQAQNLLTFTKFTGLDPETNSNMYQAAYPMSRQFSFGLDITF

SEQ ID NO: 14129 - protein, 998 aa, Maricaulis maris
MFARKALVRAIASASVIGGVALSMPSYAQETSAAVRGVVTGANGQPIAGAEVEIKSLSTGVTKSTTTDSTGSYFVRQLPAGVDYSVVVRAPGEGTASTARLPLTVGESVEMDYRLSNTLEEVVVLGRSVAVAETAIGPTAVFSASDLQDSPAINRNINDVIGQDPRVYINQSNSADAIQCNGANPRFNSLTLDGIRLNDGFGLNSNGYPTQRMPFPFDAVSSVAVEMAPMSVVYGGFSACNINAVTKSGGNELFGSVFMDYTSDSLQGDSLEGEDVQVPDYDETRYGVEVGGAIIKDKLFFYGAYEKYEGVDFNNRGALGSGAINEVQVTQAELDEIRQIANDVYQYSPGSDSPGVNDFEDEKYIAKLDWYATDTQRVALTYMYNDSFNVTESDGDLNEFEFADHFYNRGAELESIIASVYSDWTPNFSTELRVARTDVDFLQAPRAGNEFGEIRVELENVDVYLGGDDSRHANELNYTIDQLVFRGRYQLGAHTITGGIEREEYDIFNLFYQHVDTEIRFDGIDNFRNGLADRVYYGNAISNNQDDIAESFSYAINYLYLQDEWQVNDKLRMTFGLRYDRYETDDAPNLNQDFADSYGFGNDQTLDGRDLIQPRFGATYDFSDDLVLRAGVGLFSGGNPNVWLSNTYSNTSTTAVQARIDGVDLFSQNYVNCEDGVPSGPGYCVPQNIADIVGSGDGSNFEIIYLDPDFDIPSEWKYTAGLTWYAPMDWVVTADLQISRGEDTAIYKRADLERVGTNDLGYPVYESVREAAFVLTNSSNGNESESLSFSGFKSWDNGFDLRVGYAYTQAEDVNPMGSSVAFSNYIFRAFEDPQAETLGTSDWQVEHRFTTVLNYTADFFGGYETRISLFGQYNSGLPYSLTLDGADGTIGAYGFQPFLDFEPNVLPIGGTRNGETGSSFSKVDMRITQELPGFSPEHRGSLFVVVDNLTNLINDEWGIFFEPNRPGVTQADLDNGAEEQRVGGTSLWSMRVGVNYSF

SEQ ID NO: 14130 - protein, 147 aa, Maricaulis maris
ADHDVKKGDLGIVWDPGLKWWEIGGYHFTVVGEAHAAYWAVREDHATHPDIWEFGLTPVLRFVRSSGWFRPYIEAGVGVRLLSHVRETQDRTFSSSFQFADMVGVGAQFGDHQNYQAGFRFQHLSNAGLEHPNPGINFSEIYVQYNF

SEQ ID NO: 14131 - protein, 423 aa, Maricaulis maris
MVVYMRINKVALAVTALLAASQVHAAGFQVSEHSASGLGRAFAGEAAIGDDAASLARNPALMATFDKAQLSVVGSYVDPDISVKGVTGYPLAGISASDLDADDVAPAQVVPAMYYIQPLNEKVAVGLAIYSNYGTGTEYKDDYAGGSAAGTTHIMSVNFNPNVSYRINEQLSLGAGVSFVYATAELERNAGAGATPAMQIAKMEGDGYGFGWNVGALYEVNENNRFGISYKSKVKTELEGKYTGSTSGGVEVDGTLDLNLPSILEISGYHKLTDKFAVSYSWQYSTWSDFGDIVAESANCDSTAIGGSPGVCLEKKEDYSDSSRYSVGGEYYLSEAVTLRAGYAFDEQAGKATMSIPDTDRQWYTAGLTYKATPALSFDFAAALVAGKEITFEEELPAIGNQSVKVTSSGDAFIYSAQMNYSF

SEQ ID NO: 14132 - protein, 718 aa, Maricaulis maris
MTQRFAFSTSKTLLAVAIFTSMTTSHAEEPAEQQNSTNVLPTISIQAQKENPTSYVATKANSALKSDAPLFKTAQSVSVVTREQLDQKQARTLADALEGVAGVEAGKLGRRGWDDFIIRGQTSSDSVYVDGLRVGQNTYVATELSGMDQVQILKGPASINFGLVAPGGMVNLVTKRPEAESFARASMTYGSYSLKEGTFDLNYSPNNSEKGAFRLNGRISDQDDPTDYVYFKNFYISPSYNFDLGDNTDLSVIASYQHREYIRQQGLPVIGTLKDNPNGSIDRSLYIGDPNFGKYEADVYRTGYTFKHTFDNGWNFNQNFAVQKTEMDGKAVFARTGSNFWAKDKQGEIDYTTISRRNNSRHQVIDNLSFAIDNRLNKQFDLYGMQHDINIGVDAFQEKSDYTNDKYDIGDLNIYNPVYGQNVTLKQNVRDINRLKYLGLYLRDRIQLNDQLLLSLSGRQDWAQTQTTSLVTGNASKQSDNAFTGSASVMYTLNDIVAPYVSYATSFTPNSGTDVNSNPFKPEKGKQVEVGMKLQSPDQRIQGAIAWYDLKRQNVLVTDTANSGYKVQRGEQLTRGIETELSAEILEGLKLTAAYTYTIDAEISKDANASNVGKALDNIPEHAYSLSARYKFDPSSKLGWYVGGGFRGETYKTVDGLDVHVPGYTVFDTEAGYDAERWGAQLAIRNLFDKDYYTGALNENLVTLGNPRQINFTVKFNY

SEQ ID NO: 14133 - protein, 402 aa, Maricaulis maris
MKTTRAKRAVSIRPVYASVALLCAGASMQAAAQTSVTLYGVVDNAFAYSSNQGGHSNTYINSGALLASKFGLYGTEDLGGGNTALFRLESGLNAATGQQSQAGVIFNRQAYVGLSNTNYGQVTLGRAYTPYFQYVASLGPTNVLTGATGAHPGDVDALDTTLRFNNSVTYTTPVLGGLQAGVQYGFGEQAGSISNGSSVSTGLRYDFQAFSWGVGYTRLKNVSTGTTAGNFSNVGTFANNSPVNAGYATADSAQLIATAARYTFGKLMVGLNYSNVQYKPGALSLFTQSATFNTVGAIATYDLTPALRLAFGYSYTAEKARNGISSPAKYNQFSMEQLYSLSKRTAFYAIQAYQRANGQTLRASGTSTSIVDAVASVGDSQNGTPSNGRSQFVGMVGIRHSF

SEQ ID NO: 14134 - protein, 1444 aa, Maricaulis maris
MSFTHSARDPFFAGKLNVPRATPVFAISALAAALLIAFPTAHADSVSRKVVASNREDVNLRHGRSYEYLEAKRGGEISGRKNNVKGQAGELVNANSGGEIKLKDANIEASRASRLHDKEQGPAVSATGSHQHGHRGHDSVVKLEDGKVTTHNNNSPALRASQQGGKIYADGTELRTRGTGSDVVQALDGGQVFLRGTEIASEGRDSDGVKVYGRGASASVDRSRILTRGRDADGVSVKHGGIAVVSKSSIQTSGRSADGISVSGERSLVVGDSLKISTKGENSHGVDVEDGGTLLLSRGDVESKGKDGRGVAIDDGGRAVIVGSKVSASGDRGIALHVDDKDSQAIVIGSRLQSSGRSGQAVLIEDGADALIAGSTIVADGLGVQVQGKGSQLIGLDVDIDAESEARYRQSREPALGLRVEDQAKALLVGGSIQAKGDQATGVSVGGSGSLVFAAGTDIRATGDDSTGMRVSRDARAILVGSDIQGGGKGLDITKGGQAGTVGGTVTATDARGVALSVSGRDSVAATIGTNLTADGQDGVAVEVRDAGRAYLIDSSLNARAVGLRAEGKDASVVSVGSSITAGTEIVPVGRAYSEPAVGVASDTGATVILIGGDVTALGDNSVAAQATSGDMLIAGTKIGTSGTNATAVLAQQPEQDGKRGRDWHATSSRIAVIGSTVSTTGAEAAAVKADGKRSEILVAKSAVNTAGQGSHGVVVQDGGKVALVDSTVQVSGEQTAAARVQSEVSRYHRSVSELYINGTTLAATGENSAGIELDNSANVYLQESTVSATGASLVSTLSQRGQTQNITVGNGANLVENNGTLLQVNRSGDSGSSKVNLDLQDGSVTAGNIVDDLAVPLSGNGGTYVKLGALATYDGKMIGVREVTTEGGNQKINFEGGSTIGNLSIDNKAVTSGGTTAQRILAEGDVTIDDATLGGNWKIDGKLTSKNGGIVKPGNSVGTVSTAGIDWQAGTVYQAEINEAGQSDLVEVTGPDSADIANSSLVVSEENGAGRFRLNQDYTVLTAAGGVQGEFVSADWTGTAYPLIAMDTLYSDNAVAVRMGVNRQALSTMDFTSNQRATGFGAASVAGANATVDEAFFSSDPAQAFDQLSGEVHATARSLVFADMLSTNAALQSQMRANLGATLLPGQPMAASDGTPAGAQPKSASYPLWVRFNAASINNDGDGNTASAHYSTTRLLVGADAGIGGGWRLGAAGGASTGDFNVKDRSSDGTINNYTFALYGGNSWILGPGKLNLLLGGGYTRHNIDTDRNVSLGAGQELSADYHGSTWQLFGDLGYAIPWGETHHVEPYVNVSWFNQRMSGFSESGGDAALSSSASTAKLSSYTLGLRSALVFPGKTNAFTVRTNLGWRHAGGDRSPTRSMQFIEGAGSAFSIAGAPIAKNSLLVGLSGEVSLDSNFAMGLSYDGEFGSGNADNAGSLFMKVRF

SEQ ID NO: 14135 - protein, 3498 aa, Maricaulis maris
MKKFKNTLFNVNLTKKSLKISLLSASCLALFIPVAGFAQCTTSGNSVTCSGTVGDTTTSQTNYTAQIGTGKNSSINSVTINPNASVSYQRTVISLGSGSSSNHNSITIGGSVISGGLGSGPNGTGGNAVEFGNNTDLTIAKGGLIQVNSTGAYNAEAINPTGSGNIITNYGTIKTNSNASALWMEGTDTSVKTNGINTVDNYGLIQATPSGTGTIIGNSNSGIVYFTNRSGATVNGNISLGSTGNLANVVTFENGSKVNGTVSGGGNAATLNLTGASGSDSLSKSVSGFGTLNKSGNGTWSVGSAEAPLSSLSDSLHRNVGKDPSGNTTDGGTLILPGDVSSKNAVIGIDNGTLQLGTGSTSGWVDGITHNNGTLVFNRSDTNTLSSNIDGVGQVQQIGSGTTILTGTNTYTGVTTISNGALQLGDGTTSGTITNSSAITNNANLTINNPANTTLSQVISGTGSLTQVGSGTTTLSGTNTYTGVTTISNGTLQLGDGTTSGTITNSSAITNNANLTINNPTNTTLSQIISGTGSLTQAGSGTTTLSGTNTYTGQTTVALNATLNLPGRVAGDLVNAGTTNVNGGTVGGITSNTGTLNALNATLHDINNTAGTTSLNNSTAGTVTNASNATFSAVGGSLASATNSGTMTLGNGNNVAGDVTNNDGSLTLDGNAVAGTLGANGGSFEVTSAASDIGSLAGSANGNLDGALNLHNAKDTYSGAISGQGSLNILGGTETLSGTNTYTGQTTVAQNATLNLPGAVAGDLVNAGTANVNSGTVGGITSNTGTLNAQNAALQDINNTAGTTSLNNSTAGSITNASNATFSAIGGIIHSVDNSGTMTLGTGNTVVGNVTNNDGSLTLGKGNYVIGNVTNSKGSLTLDGNVIVGTLAANGGSFEVTSANSGLNSLAGTANGNLDGTLKIYDAQDTYSGTMTGQGGVQLLGGTETLSGTNTYTGQTTVALNATLNLPGAVAGDLVNAGTTNVNSGTVGGITSNTGTLNAQNAALHDINNTAGTTSLNNSTAGTVTNASNATFSAVGGSLASATNSGTMTLGNGNNVAGDVTNNDGSLTLDGNAVAGTLANGGSFEVTSAASDLGSLAGSANGNLDGALKIHGAQDTYSGSMTGQGGVQLLGGTETLSGTNTYTGQTTVALNATLNLPGRVAGDLINAGTTNVNGGTVGGITSNTGTLNAQNAALHDINNTAGTTSLNNSTAGTVTNASNATFSAVGGSLASATNSGTMTLGNGNNVAGDVTNNDGSLTLDGNAVAGTLAANGGSFEVTSANSGLNSLAGSANGNLDGTLKIYDAQDTYSGTMTGQGGVQLLGGTETLSGTNTYTGQTTVALNATLNLPGAVAGDLVNAGTTNVNGGTVGGITSNTGTLNAQNAALQDINNTAGTTSLNNSTAGSITNASNATFSAIGGIIHSVDNSGTMTLGTGNTVVGNVTNNDGSLTLGKGNYVIGNVTNSKGSLTLDGNVIVGTLAANGGSFEVTSANSGLNSLAGTANGNLDGTLKIYDAQDTYSGSMTGQGGVQLLGGTETLSGTNTYTGQTTVALNATLNLPGRVAGDLVNAGTTNVNGGTVGGITSNTGTLNALNAALHDINNTAGTTSLNNSTAGTVTNASNATFSAVGGSLASATNSGTMTLGNGNNVAGDVTNNDGSLTLDGNAVAGTLAANSGSFEVTSAASDIGSLAGSANGNLDGALNLHNAKDTYSGAMSGQGSLNILGGTETLAGANTYTGQTTVAQNATLNLPGAVAGDLVNAGTTNVNGGTVGGITSNTGTLNALNATLHDINNTAGTTSLNNSTAGTVTNASNATFSAVGGSLASATNSGTMTLGNGNNVAGDVTNNDGSLTLDGNAVAGTLANGGSFEVTSAASDLGSLAGSANGNLDGALKIHGAQDTYSGSMTGQGGVQLLGGTETLSGTNTYTGQTTVALNATLNLPGRVAGDLVNAGTTNVNGGTVGGITSNTGTLNAQNAALHDINNTAGTTSLNNSTAGTVTNASNATFSAVGGSLASATNSGTMTLGNGNNVAGDVTNNDGSLTLDGNAVAGTLAANGGSFEVTSANSGLNSLAGSANGNLDGALNLHNAKDTYSGAMSGQGSLNILGGTETLAGANTYTGQTTVAQNATLNLPGAVAGDLVNAGTTNVNGGTVGGITSNTGTLNALNATLHDINNTAGTTSLNNSTAGTVTNASNATFSAVGGSLASATNSGTMTLGNGNNVAGDVTNNDGSLTLDGNAVAGTLANGGSFEVTSANSDLGSLAGSANGNLDGALNLHNAKDTYSGSMTGQGGVQLLGGTETLSGTNTYTGQTTVALNATLNLPGRVAGDLVNAGTTNVNGGTVGGITSNTGTLNAQNAALHDINNTAGTTSLNNSTAGAVTNASNATFSAVGGSLASATNSGTMTLGNGNNVAGDVTNNDGSLTLDGNTVAGTLAANGSFEVTSAASDIGSLAGSANGNLDGALNLHNAKDTYSGAISGQGSLNILGGTETLAGANTYTGQTTVALNATLNLPGAVAGDLVNAGTTNVNGGTVGGITSNTGTLNALNATLHDINNTAGTTSLNNSTAGTVTNASNATFSAVGGSLASATNSGTMTLGNGNNVAGDVTNNDGSLTLDGNAVAGTLAANSGSFEVTSAASDIGSLAGSANGNLDGALNLHNAKDTYSGAMSGQGSLNILGGTETLAGANTYTGQTTVAQNATLNLPGAVAGDLVNAGTTNVNGGTVGGITSNTGTLNALNATLHDINNTAGTTSLNNSTAGTVTNASNATFSAVGGSLASATNSGTMTLGNGNNVAGDVTNNDGSLTLDGNTVAGTLANGGSFEVTSAASDIGSLAGSANGNLDGALNLHNAKDTYSGAISGQGSLNILGGTETLVGANSYTGQTTIAENATLQLGNGETSGTINNTQDIINHGTLSVNNSHAVTMPMLISSSGQFKQIGIGTTTLGDHNSYSGGTTITSGRLVGSAHSFGTGAINNYSALIIAQPSNATFDNSINGTGTLTKTGAGIHNQTRSNIIGTLNVSGNYQQDAGATYAVQVLPGTNTSDVLSINGKASLSDGAILSVSKASPGNYTLETKYRVLTTKGGVSGNYTLTGDTALSAFYGLGTTYDANNVYLEVKQDHLFVEEGKTSNQIAVAGGLDSLASNSVIKNVVGSLMTGDQARQAFNTLSGEIHASARTSLFQDSFYIRDITVERLRASDGGIGTDADTKKTCDIKKKREAEGACEGAAPALWMQSYGSWGRNSGNDNVATMNHSTGGFVLGADTPIGRSKWHIGGLFGYGYSSFNIPNRSSTGHSNNLTAGAYGGTSWGNLGFRMGASYTWNILSTNRTATIGQFSNQLNGHYNGDTAQVFGDLGYRFDVGNASLEPFANVAYVNLHTDSYHEHGGEAALHGKAIDTGLTYTTFGLRAAATLQKGDTAWIPNITVAYRHAFGDVDPTVTQRFIAGGNDFSVAGVPLSENSALVNAGFKVKAGKRITGGISYIGQYGDHYLSNGLRGTFSWIF

SEQ ID NO: 14136 - protein, 645 aa, Maricaulis maris
MSLALALFHHPLRATGAEDLAVLPFEQLVKREVVTGSTLVRQISDSPSAVAIVTAEDIRAYGYRTIADVINSMRGLYTTSDRRYQYMGGRGFGAPGDYTGRIMVLIDGYVTQDSLFNQAYIDESGLLDLALVERVEYVPGTGSVTYGNNAMLGIINIVTRKGGDFNGLQLSGEAGSHDTYRQRATFGRRFENGADLLLSASAMDSQGQNLYFPAYDTPGNNHGWANGLDDERNKRFFGKFSLDGLSIEAGYVDRRKSVPTQPTQFSVFNTPFTIDDENSYLNASYETDLGLQLYSASRFYYGYYAYENRRVINDPDPYAQRRHQAQWWGVDQKFVGKWFANHSILFGMEYRNDFRQNLRRTYYSSGWNVTSDLQESYSRNMTSVYMADEYRFHERWRLNVGARYDKASDLEGNWSPRIALIYQPDFRTTLKASYSEAFRMPNADDRSIYGAGAVPEYVAAKELVVQHDLDRNMRITGSLYEYRRSKQQVYVDALGDYAPVGNSLSKGGELEFEARWDNGIRARTSGAWQHSHDTSGQDAVNSPNLLGKFQLTSPLPGESIRAGLEAQYLGSRLTTERRRLGGVALANLTFSSERKWHGLSASFSIRNLFDRNYEVVSPFGWAPGTGIDALRMDGRTYWFQLNVDL

SEQ ID NO: 14137 - protein, 729 aa, Maricaulis maris
MFEKKRGIRTPLALAVASLLGGGTGFSQAAEMNDGDVMVVQATAEQALKQQPGVSIITAEDIEKDPPVNDLSDIIRKMPGVNLTGNSASGSRGNNRQIDIRGMGPENTLILVDGVPVSSRNAVRYSWRGERDTRGDTNWVPAEMVERIEVLRGPAAARYGSGAAGGVVNIITKRPTNDWHGSLSLFTNQPENDKEGATRRANVSLSGPLAGDALTMRLYGNINKTDADDYDINTAQNGSYAAGREGVRNKDINSVISWKITPEQMLDFEYSYSRQGNIYAGDTQNSNSNASPNGLVPSLYGHETNRMYRQSYGITHNGLWDWGQSKTGFYYEKTNNTRLQEGTTGRVEGMITDDKYTTSRLENYRASSEINVPLELMVDQTVTLGAEWDRAELNDPASMQATNVSGTTIGDISGEAASRSSKNSATTGAVWFEDNIDVLSGTAVIPGLRYDHHNQFGGNWSPSLNVSQELGDNVKLKAGIARAFKAPNLYQSSKGYLLSTRGNGCPIGVSGSCYLLGNENLKPEISINKEIGLEYTKEGFDAGLTWFRNDYRNKIVSGDRVVGFASNGNNILRWENGGKAVVEGLEGNLTIPVMKDVLSWRTNATYMIKSEMKKNGNPLSVIPKYTVNTMLDWQVNDKLSTNLNWTFYGRQKPRQAAEIRLEDGGNLSRKEGGAYSIVGVGVNYALTKDLRLNGGVSNLFDKTLYRENEGASTYNEPGRAYYAGVTMSF

SEQ ID NO: 14138 - protein, 311 aa, Maricaulis maris
MAAVNLRHIEIFHAVMTAGSLTEAAHLLHTSQPTVSRELARFEKVIGLKLFERVRGRLHPTVQGLRLFEEVQRSWYGLDRIVSAAESLREFRQGELSIACLPVFSQSFLPQLLQPFLARYPDVSLNIVPQESPLLEEWLSAQRHDLGLTETLHTPAGTERTELLSLDEVCVLPPGHPLAVKKVLTPDDFQGENYISLSRTDSYRQLLDQLFTEHQVKRRMIVETHSAASVCAMVRAGVGISVVNPLTALDYAASGLVVRRFSIAVPFTVSLIRPLHRPSSALVQAFSGHLQAGLPKLVTSLDAILSSATTA

SEQ ID NO: 14139 - protein, 682 aa, Maricaulis maris
MTKTILLATAATLLMATAAHAAAAPPAAPAPAPTQAPLDDAAQKGVLVFTPDFFAAQRPNTALDMVDRVPGFSADDGSGARGFEGAVGNILINNNRPASKNDAGTAVLERTPASQVERIELIRGGAPGIDMQGYSVVVNVILKTAASRQHVLTWNAALFDGGHDVQGGSYQFTAKNGERSWSLLLSDGTSTSDSNGVGRNIRRDGAGKVLRDEAFANDGWGGGDSARLNYSGPLAGGKLEATARYGIHDWQEWQTISAPGVLRTSDYAEDTKSGELGLTYIRPLKPKWTLETRVIHQFEHFDEVATGSDTTDGSDQRFTAKGDSSESIFRALVRHERTSALTLEAGGEIAYNMLDTHQAYVENGAAVDLPSASVKVEELRGEAFTKATWRVNPKLTLEGGLRLETSTIKQSGDAHNKESFFYAKPRFQATWTPKANHQVRVRFERELGQLDFGDFAASSDLDDGNVYGGNVDLRPEQRWISEVTFERRFWGEGIVSIGYRHDEIIDVIDRLPLDGGLSATGNIGNGTLDRLSLNLVVPTDKWGIKGGRFTFKNDWNETHVTDPTTHRDRPISDVRPTQANIGFQQDIAAWKTQWGVNWLPLLGRGTYDPDQTGGWRGAAYFESFVEYKPTPTLSLRAQLNVWDDFVVHRTVYSNRDTRAVKFSEERDINPRTFLSLKARKTF

SEQ ID NO: 14140 - protein, 569 aa, Maricaulis maris
MFNKRLSDVGPRVSSFNFSGFQIQLGLKGDLDFINGGFDVYYQYGNTNGSNSLLGDTSLVRIQQGLLLNAAGTGCADPSGGCVPVNIFGQGTMSAAAANFIKTRINSSQDYEQQYGGFSINGDTANQFSLPAGPIGFAVGFEYRAEEFAFNPSQDLATGNLTGFNASPPVAGRFDVYEGYAEVLVPLLKDLPLVKSLDLELAGRTSDYTGQPKAVQTYKVAGSWKVYDDLMLRASFNRAIRAPSIGELYAPQSNGFPTATDPCSARAAPNAAVRQACINSGVSASVVGLLNANQQTQTLSGGNPSLRPEEGETLTLGAVYTPSWISGLSFTLDFYNIKVTDAIDTFGGGTANLMNVCYGPLVNGNPNSPYCKAIVRLANGSIDYVVSTNQNVASRELEGLDFGVTYKTSLEDLGLPDWGTLSVRSLYTNTWLYTIKPDDISAPVKCADKFGNRCRGFGVNPVPRHKLRTAANWRFNNVGVNLVWSHLDDVVDDNPASRFTVERIGAKNYVDLSADWDVNDNLAFTGGVRNLTQEAYPILGGNASPSNSGYPAVYDVMGRTFFLNARLRY

SEQ ID NO: 14141 - protein, 1115 aa, Maricaulis maris
MRRSLLAAVSLSALIATPAWADEEINDERTEPVETADADGAGNADNIVIGSNGRVTLIGVPGPAVHVNSNNDLTTQNGSIIRINDRDGDGDPVSVDGAVGIQVDPGVEGDISHGGRIVLDDSDDPADLGTDDLVDADNDGEVDDPDGEADGAFAQDQNKTGLLIGAVDGDYNPVAGQDAVTGDVAITSTGAIVVQGQNSFGVRAVTAIDGDFFSDGSVTVTGENSRGISLEDDVSGNVEIISVNTVSPGGNAVVVEGDVGGGVRANGTVSAHGYRTTTRYRENLMVLFENEEEAAARGDVADNLDSGSAFLVAGSVADGVFISTSGTIQAYTGGGAALELRPDEDGTGDQVIGEVSLPDDYTTNRTDDDDEGDQLGYAVVNEGTIANNAVFDGKDATAFLVVGRDDNGVLRSVILGAGGVMNTRTVTATAYDGTARAMHFGAGAQADTILNSGVLRAAAVLGHEEDGFADDAYGAGRAIALDLDENSQIRRILNEAGNINATITGGGQSAIAIRSNDDSLDEIRNSGIISAVAGGLEDGFSRDDMEILAIDARNNDGGLAIIQEQAYDDEGEPISTPSITGDILLGDGDDRVEINAGSITGDISFGLGADVLVINNGSLNGAVSDADGHLVLDVTNGEIGLTGTDALALRDAIFRNGGVLEVVIDAQDRTNAFLNASGDVTFEEGSSLSVGLGDVIGAGGTFEIITAGTLSIADEAGTLTTTESPYLYNATLARSSEDENKILLTLELKTADELGMHVNQAAAYDEALAAFETIESLGAAFAGLRTAEEFYGAYDQLLPEYAASAIQFALASNDAAAGALQGRLRNARLAPDDLAGVWIQEFGYYADRSSTAFGPGYRGQGVGLAVGLDRPVGPFYAVGLQLVGAASEIEETNGFDQPMVSMTGQIGGYAALNLGGFDISGNVGLGYDYFETDREIRIGDFTALTSADWSGWHATASFQAGRDIAFGKWVLRPEADLTYVTLFESGYSETTSGTNADAISDLALIVDDRESSTLLGSGTLTLARRFGTDESWWAPSLRVGYRGEFSSSGGETTAQFGQDGNPFTLRSEQLANSGALLGFGLSAGSNYSTFTFAYDADVRDDFVRHVARLVIRLTF

SEQ ID NO: 14142 - protein, 347 aa, Maricaulis maris
MTRTKTLLTLLPTLCLASFAQAQNVYDDETNKLDIYGRLEGQIAKGDESFASEDDWSGRMSGRLGFNMSRELSAIENSRVIGKFEWQMRTETNDTRLDEGEDLEARYNYLGIENSNWGMVIFGRTKNPMYQVMKMTDKYKNYTPGIYNYGISSIDTSYKYNRQDATLQYNGNFGIHEFQAAYVMGNGENDRLDNGMLASYRMNYKGDGFKLSPALAISQFNRDESNTDTKREQHDQIMGGIELSLKGVTFGVTADYVKINEDGGSEDKYFGMDSIVAYKWNSFKVLAGYSFLDQKDEDIYEKEDWRVEGQWTLARRTYLSLTYDRELASKNKDSDDDAITLGLRYDF

SEQ ID NO: 14143 - protein, 701 aa, Maricaulis maris
MRQILLLPLAALLAMPVFSQTPADTTLTIRNIEIQGTRFAGLSERGGMKILRVDNNLSSVTNTAADAFRQLPSVITDMEGAVTYRGSGNVGMLVDGVPYGLLEEYSGDVLIQLPALFFNQISLGAFPPINAVPDGDAGILNLVPRMYGTGDSPLYVTLGAGWNERYNAGAVLNLHPGKFHINAKYNYRREYRERSFSKSTATAKNRTEMNNNATARPDVHVADMKVDYDLSAKDRITVHGLYHLMDYSRYGRINNRVFNPKGKQMKYVIRNRYNDQRQEAYAAEAYWNHEISENQGFYTVFNYNNFSYDEDNDFKNENPQNGNIVSEDNQSIDHTKHNYFWGFGYGQEIDGWDFKLGYIGRARNEDYLTAAFDKVDGSFELSPAKSYNYDFNRYLNLIYADVVKNWGAFNAEIGIQAEFSHFKMNEFSPSWINDPYWQGIKGKENKSSRFHLYPRSRFTYEVNKSNRLSLSYQQRAIRPNGSYLCSFLNNSDPTHIIQGNPDLKDEFIHNVELGYQFSAPRFRLTPAIYYRNRTNRIMEIAGQVNDETVWKKENIGHSQAVGADLSGSWNPVRILTVGFSGDIYRDEIDGRTVGYGEKKSLVCWDVKGNVNVSITPTTDFQVDGFYVSDQLTPQGKIKGRYSVNAGLSQYFLNRKLCANLSINNIFDSLEETTIIDAPNLEMTQKRNRDARVAWLTLTYSL

SEQ ID NO: 14144 - protein, 390 aa, Burkholderia ambifaria
MKTKKIEIIVGSLVGLASSVAHSQSSVTLYGEIDNGIHYQTNVGGGKAVYMDSLDGIDGSRWGLTGKEDLGGGLKAIFTLESGINVNNGQFAQGGTAFGRQAFVGLSSDTYGSLTAGRQYDMVWYFPEFLAGSAAVGDLPSAHPGDFDNTSNSVRFNNSVRYMSPDFRGFSFGVEYSLGGVPGDFTSTSGYSLGVGYTHGPLQIGAAFDYFKHPTSTPGNGWFTNYASGFNLLASSLNSAYQVAQAYQDAVIAAAYTIGNATISASYSNVQYANLGAGFMNGTAVFNNYDIGLNYRVTPVFFVGVAYDYMNARSVTTAQGNAVGNQHYNQVAFTLDYLLSKRTDVYLSGGWQRASGTSSTGAPAVANIGGSGDASNNHQMVYRLAIRHKF

SEQ ID NO: 14145 - protein, 10429 aa, Burkholderia ambifaria
MNRVYRIVWSKRLGALVVVSEITHGQGKSSSKSTQVGSVLVGSLLMAGGIGAALPQVVDPSAGPITADGVFNSSSHLISTSSSPAALYVPSLNIAGSVTNMGTIAGEGGSPANGIKVNSNATLSGNINNAGTIISGVTAIAVGPNGKITGSISNTGLIVGSSASGIAVQRGTVLGGITNSGLIAGTSGDGGISVNNYGYIGSINNQSLSGSQVGTIAGRLYGIVIQTGGTIGSINNAGSILGGTAIKVDASSTAGSTIAGSIINSGLIAGSNTGISVISGSSLLGGINNSGTIIGNGAYGINVSTNSLLAGGIYNSKSGFIYGGLTGINVGGASTVAGGFANDGSIIGYYVGVRLTGATVLGGITNTGMISGYYTALELGTDGTNNLVDSITNTGSLIGENSQGLQLQSIKVTGDIINAPSGFIYGGTTGVQIQKGSTLVGSLINDGTIVGGNTGIRLSSNSTILGTINNTGTIAGNTYSLNLQNTASGLVVNNSGTLIGAANIGINTLNLSGSNAVVAGNITGSSSSTVNVLGTFSSGGDIAVGAVNISNTGALTLNNNVNVNTGTGTLTNAGNLIVAASTYSPTITGNYAQSGNYTISIDDGLGSYGKLRITGRANFTPGYSFGITPGSAYIQPLYTSILYAVGGITGFTAPYIISPYYEVIQSPSDSNELDLFYYDPGPGPGPAPSSTLVFASDTSTGNGFALPGSTYTDAIINSGVTVVGGHYGLYLTSGLVSGSISNSGTLIGNADAGIYIGNSATLGGAIINDANSLISGGQYGIAVQSGGVVGSINNAGTILGATAIYVGTGSQINNGITNTGLIAGTVAISNAGTIAGVTAIQIAGGGVVQGSITNAGLISGGNAGIAISSGTLLGGINNQSTGTITGGQYGILANQNSVLLNQDIANSGLITGSVAGITFADGASFNYGMIVNSLSGTIAGGQYGIANASALYDGVNNAGLITGSVAGITATTGDTFGLITNLSTGAIAGGAYGITASGGMAGLTNSGLVSGSVAGIALGAGGQMYAISNATNGTITGGDYGVLASDSALIVNFTNAGLITGSIAGIAMQSSSIVDPSFMNLSTGTIAGGQYGLLATSNGGVNHGITNAGLFTGSVAGIGVNGGLINYGGIYNDTTGTIAGGLYGISNAHGAMEGGILNSGLLTGSVAGVMVDGGQILSTNGSDAIYNTSIGNSNTGTIAGSQYGIAIINSGRLTGDIGIGNAGTIYGATAIKVEAGSQVAGGVTNNGMIYGAIGINNQGLITGSVSGGTIFGATAIQFGGGTLVGGIVNSGSIIGASNGIALTHSTIVGGITDAGMIAGGLRAISVDGISRIDGGITNANLISSDDTGIKVGFKSRIDSIDNQSISGQVGTIAGGKFGINIQSAGVIGSISNSGVIIGRGSTGIAVSAGSLITNGISNSGLIYGHHRGIAALSSNESADSIFNQSISGSQVGTIAGGEYGVAIQNGGALGLINNAGSILGNSLGVLVLNGPLDTLTNTGFIRGDAVGVGIQSTGGSNGSVGFLINAGTISGATAIQVTSGSQITNGITNTGLISGSALGINNAGNIYGATAILVDGGSTVLGGINNTGTIAANPAGHAATFTAALKINGGTLLGGITNSGLIAGPTVGGGYQAGILLLSATVDTIVNSVGGTITSGRDGIRLSGGSTINSINNAGGSIMGSEAGIIVASGSQINSLTNTGLISGSSRIGVALMGNSSYIGPLQNYGTIIGKTVGISVNNSGLIIGGLTNTGTITGGNIGIDLVSGGTISGGITNTGLIGGTALGGVVLAGQYGNQTLSGGITNLSSGTIFGQTGIQVNGYANAFYMDTGFMHFGSANASNASLLGGITNSGSIIGSQNGITVAGLTAVAGPHNTYFATGIGSISGGITNTGLVAGISGAGISVGGYGYIDSINNQSLSGSQVGTIAGGQYGIAIQSGGVVTSGITNAGSILGGTAIYVGTGSQINNGITNTGLISGTVGISNAGTIAGVTAIQIAAGGTVQGNITNTGLISGSNAGIAISSGTLLGGISNQSTGTITGGQYGVLLNQAATLLTQDIANSGLIAGSVAGIAITSGVNLYRSISNSVSGTIAGGQYGVLNTGVNSLFANLINAGLIAGTTAGVATADGGRFFGVTNLDSGTITGGAYGISSAHYLDSIANAGLITGSVAGIVAQGSGVIGAITNSISGTIAGGSYGVLDADAGIVGSTSVAINNAGTIMGAIAGITAQSSNPMRSITNSSSGTIVGGNYGILVGTSAGGDINDGVFNSGLILGSSIAGIGLDNGSYNYADINNSATGTIAGGQFGISVANNSNAYQDINNQGLITGSVAGILVDHSNLNGIINQSTGTIAGGAYGISISNTGQINGSTGISNAGTIYGATAIKVATGSQITNGITNSGLISGTTDTGVLAINNGYIDTINNQSLSGSQVGTITGGQYGVAVQSGGAIGSINNAGTIISLGDAGPGRSAGIYLGAQLIGPPGPSASGGAIISGITNTGLILSTSAGILITSNSQLSGGITNAGLINGWAGIVVNDGATATGGILNTGTILASSYGLDIFDGGTVLGGITNIGTISSGGTGPSADRGAIFLAGGGLIANGITNTGLIQGADGIYVGQTSGYPTGGTVLGGITNFGQIVGASAGIAVVSQSTVVGGITNTGLIAGTYNGILVGNNSYIDSINNQSLSGSQVGTIAGGQYGIAVQSGGTIGSIGNAGSILGATAIKVEAGSQITNGITNSGLLSGTVGINNAGLISGITAIKLNSGTVIGGITNTGLIAGTYNGILVGGGSYVDSINNQSLSGSQVGTIAGYQSGINVGGVVGSINNAGTIIGAAALQINGSVLGGLTNSGVMIGQGGLGINLGDSDLISGGLTNTGTIVSTNHAINAYKTTITKSSDGIAAIYNSGTLIGVGTVDDASGIRLEHSYVDGGIYNDANALISDHSYGINLVNSSTVIGDITNRSGATISGGGDGIHIQSSVLAGAISNSGSILGGNNGILIGYGSNISNGITNAGLISGANTGIALSSNSTILGTINNTGTIAGNTYSLNLQNTASGLVVNNSGTLIGAANIGINTLNLSGSNAVVAGSITGSSSSAVNVLGNFSSGGDIAVGAVNISNTGALTLNNNVNVNTGTLTNAGNLIVTAGITPIITGNYAQSGKYSVGITGPTNYGQLHIIGDANFTSGYSFGITPGSVVTTGTYGSILDATGTIGGFSAYNGIYHYSGLTTAYSVTGDIAPNELDLIYGTTTGYGQLVFNTSTYTGDVGFASYHNGVLINSGVSVGGNSYGIYINSGGSIDGGITNSGTLVGTSYAGILIGNNSTLGGTLGGLYGAGIQNLAGSTIAGGQYGIAIQSGGVVTRGITNAGSILGVSAGLLISSSSRLTGGLTNTGLIASQGWAGVVVNSGATVAGGIFNTGTILAANYGVDVFDGGNVLGGITNTGTIVTSQGGPFPMGAIFVGAGIVSGGISNSGLINGASSSGVLAINNGYIDSINNQSLSGSQVGTIAGGQYGIAVQSGGTIGSILNAGSILGGTAIQVVRGSQLTNGITNSGLIYGSGMMNAAGIAVGSAASIVGGITNSGLIIGNSNGVLAYASSTVIGGISNSGLINGASSSGVLAINNGYIDSINNQSLSGSQVGTIAGGQYGIAVQSGGSIGSINNAGTIFGGSKAISLKSSTLLGGITNVGSIIGPYRGIDLGHGALLANGITNSGLIQATVWSAIDVWGEPGSTITSGISNLSGGTVLGNGVGISVWSASTIAGGISNAGQIIGSTFAGILATSSGPSTAAGTILGGITNTGSIIGGSIGIFANAGSLIADGITNTGLISGSSASGIFINNNSFIDSINNQSLSGSQVGTIAGGQYGIAVQGNATLGSILNAGSILGATAIYVGDGGTIVNGITNSGLISGANVGITLDNPIHLLGDIVNSVGGTISGGVTGIKFAARGTDISISNSGLIYGGYAALHLSNSYQLSLLANSSEGTLAGDSYGVYVDGASHMNGITNAGLISGSIAGLGLGGNSSIDQVIFNANGGTILGGQYGIFAASDSVMNAGIRNSGLITGSIAGIASLSRAYIHGGIINDLTGTISGGEYGILASNNGNIPDGITNAGLISGSNAGISARNYGTLMGGLTNSGLILSSNTIGSSAIAFNSNSTLVGDLINSAAGVISGFEGVKITNTSTILGNINNSGLITGMGDGSGSSYGHGIQLYSSGLLTGDIINNASGSIMGVGTGISIYSRSTLTGSINNSGLISGGLGDQQTGIIIGDNSTLAGNILNNAGATISGVGTGIRLSSNSTILGTINNTGTIAGNTYSLNLQNTASGLAVNNSGTLIGAANIGINTLNLSGSNAVVAGNITGSSSSAVNVLGNFSSGGDIAVGAVNISNTGALTLNNNVNVNTGTLTNAGNLIVAASTYTPIITGNYAQSGNYSVGINGLSYGQLHILGNASFTPDAIFSIARGSNLTGSSYSSIVDTTGTIGGFSVYNGIYHYSGLTTEYSVTEVGTSELDLLTTTTGYGQLVFNTSTYTGDVGFTSYHNGVLINSGVSVGGNSYGIYINSGGSIDGGITNSGTLVGSSIAGIFIGNNSTLGGTLGGLYGAGIQNLAGSTIVGGQYGIAIQSGGVVTSGITNAGSILGNTAIRNNSGTILGGLLNTGSLIGASNGISLTYSTVAGGITNTGLITGIGSTGIYLKGATLLGGLTNTGTIYGNTDAIAITHNSFIANGVVNTGSIIGASNGISLYANGQVAGGITNTGLIAGMNQIGVKLNDFSTIADGLTNAGTIYGGRTAIKVGFESQITGGLTNAGSIIGNSYAGILVSGNASAIDSIKNQSLSGSQVGTIAGGQYGIAVQSGGRIGSINNAGTIISLGAPGPFNPAGIYLGGSGPFGSGGTIANGITNTGSILSPSVGILITNSSQLIGGITNAGLINGAARAGVIINSAATVAGGITNTGTILAGNFGLDIYNGGTVLGGITNTGMIATSDGGPFPLGAIYAGAGGLISGGISNAGLISSVSSSGVIALYGGYIDSINNQRLSGSQVGTIAGGQYGIALQTGGRIGSINNEGSILGATAIHISAGGLISGGITNSGLIAGSGVGISLITGSFLNGGIKNTGTIAGQLAGITSLSSSISGGITNNGLISGYDFGVAVISGGSFGPGFIDSIDNQRAGSVIGTISGGLQAISIFNAGTVGSIINAGLISGVGNSFTGAGIYVGPAPFGPFGTQGGLITSGITNTGLIMGGVNDSGQGFGLDLVNSSLLNGVTNSGTFLGIGVYGGAGINLQSSTLMGGISNNGSLVGYAGTIGGAGIALNNALLTDGIKNLAMGTIAGLAMGAGAAGINLQSSTLLGGITNHGMIEAQGITGFGINLNYSTMTGAIANTGGTIFGISGGASTAAGINLYHSTLTGGITNSGLIYAEAVANPAFGILVSHSSLVGGITNNGTIAGESNVFAGGINVTNQSILSGGISNSGLIAEIGSANIAGIIVGIDSTVYGGITNSGLIIGNSNGVLAYASSTVIGGISNSGLINGASSSGVLAINNGYIDSINNQSLSGSQVGTIAGGQYGIAVQSGGSIGSINNAGSIIGRTAIQMDSAGLISNGIINTGLIAGAVGINNAGTILGNTAINNNGGTILGGIINTGSIMGTNQGIYIANGLVTNGINNAGGLISGNEALNIYSYGTVLGGITNAGAIIGATYSGLGLGRNSTIFGGITNTGLISGNSSSGIGVGNYSTLSGDLINAVGGTITSALQVGIGLSTHSTITGSIINDGLISGSTAGIAVANFGTLVGGLTNTGLISGNYFAGVGVGHGSYVDSINNQSISGLQIGTITGGQYGVAVINGGAVGSINNAGLINGSLAGIGVSTNSTILGTINNTGTIAGNTYSVNLLNSANAFTVDNSGTLIGAANIGINTLNLSGSNAVVAGNITGSSSSTVNVLGNFSSGGDIAVGAVNISNTGALTLNNNVNVNTGTGTLTNAGNLIVAASTYTPTITGNYAQSGNYSVGINDIAGTYGKLHITGDASFTPNATFKIAPGSNVTGTAYNAILDTTGTISAFTPYSNTFHYSGLTTEYSVTENIAWNELDLLIGTSTGYGQRIFDTSTYAGTIEPGFTSYHNGVLINSGVSVGGNSYGIYINSGGSIDGGITNSGTLVGTSYAGILIGNNSTLGGTLGGLYGGGIQNLAGSTIAGGQYGIAIQSGGVVTSGITNAGSIVGNTAIRNNSGTILGGLLNTGSLIGASNGISLTYSTVAGGITNTGLITGIGSTGIYLKGATLLGGLTNTGTIYGNTDAIAITHNSFIANSVVNTGSIIGASNGISLYENGQVAGGITNTGLIAGMNQIGLKLNDFSTIADGLTNTGTIYGGQAAIKVGFESQIAGGLTNSGLINGATYAGILVGGYASVIDSINNQSLSGSQVGTIAGGQYGIAIQSGGVVTSGITNAGSILGSNGIFLHSGSQLINGIVNTGLISGSGMSEAAGIYAGFGSTIVGGINNDGIISGNSVGIIAYNNSSIVGGITNTGNIQGSSNAGILSFDGAYIDTINNQSLSGSQVGTIAGGQYGIAVQSGGTIGSILNAGSILGATAIQIDASSQITNGITNTGLIAGTVGINNAGTIAGVTAIAINGGTVIGGIVNTGSILGTSAGIYLNQSTVTGGITNANLINAISAINIHNTSLLGGITNTGAVIAQQFAIGVSGADARIVNGITNSGSLVSNGSAPNSGIYIGSNALASGGIVNQSSGVIQGGNGIDVAYHGVLTQGINNLGNIIGTSRGIALYGAGTVAGGITNSGLISGTSYSGILISSNSSLDAINNQNTGSTVGTIAGGQYGIAVQGNATLGSILNAGSILGATAIYVGDGGTIVNGITNSGLISGANVGITLDNPIHLLGDIVNSVGGTISGGVTGIKFAARGTDISISNSGLIYGGYAALHLSNSYQLSLLANSSEGTLAGDSYGVYVDGASHMNGITNAGLISGSIAGLGLGGNSSIDRVIFNANGGTILGGQYGIFAATDSVMNAGIRNSGLITGSIAGIASLSRAYIHGGIINDLTGAISGGEYGILASYNGNIPDGITNAGLISGSNAGIAARSYGTLMGGLTNTGTIMAASAISISTNSTLYGGINNAGSIIGANTAITVTNNSTIAGDVINSIAGVIRGTNGVKVSTYSSLMGNITNSGLISGGTGGTGHGIQAYNHSLINGNIVNNAGSTIIGAGSGISIYEASTMIGNITNSGLIAGGTGDLQTGIIIGNGSTLAGNILNNAGATISGVGTGIRLSSNSTILGTINNTGTIAGNTYSLNLQNTASGLAVNNSGTLIGAANIGINTLNLSGSNAVVAGNITGSSSSAVNVLGNFSSGGDIAVGAVNISNTGALTLNNNVNVNTGTLTNAGNLIVTAGNTPTITGNYAQSGNYSVGINDIAGTYGKLHITGDASFTPNATFKIAPGSNVTGTAYNAILDTTGTISAFTPYSNTFHYSGLTTEYSVTENIAWNELDLLIGTSTGYGQRIFDTSTYAGMIEPGFTSYHNGVLINSGVSVGGNSYGIYINSGGSIDGGITNSGTLVGTSIAGILIGNNSTLGGTLGGLYGGGIQNLAGSTIVGGQYGIAIQSGGVVTSGITNAGSILGNTAIRNNSGTILGGLLNTGSLIGASNGISLTYSTVAGGITNTGLITGIGSTGIYLKGATLLGGLTNTGTIYGNTDAIAITHNSFIANSVVNTGSIIGASNGISLYENGQVAGGITNTGLIAGMNQIGLKLNDFSTIGDGLTNTGTIYGGQTAIKVGFESQIAGGLTNSGLINGATYAGILVGGYASVIDSINNQSLSGSQVGTIAGGQYGIAIQSGGVVTSGITNSGTISGGSAGIAVVNHSIIAGSITNSGSISGGRSKTGIIVSSTSIIAGGIINSGTISGGGVADAIVLQNGSSLGGGITNDGVISGGTSGAGIYLGNSSIADGIKNNGNILGYTGISLRDLSVLSGGVLNSGTISGGGTGIILKSNSTLSGGIQNSGAIKGRSQGVFLSSSSIAGGLTNSGLISGATKVGIFVGTNSYIDFINNQSLSGSQVGTIAGGQYGIAIQSGGVVGSINNVGTIVADAGGIRLSDGVLVSGGISNSGLIYGRGWAGILVSSASTINGGLLNTGAIVSDFSGIGIDIFNGGTIFGGLTNAGTINGSSLGIFAPGAALITDGISNSGLIHGGATAIYIGPSLSNPSGSTVLGGIANTGLISSNSNAAIFVGDSSYVDSINNQSLSGSQVGTISGGQYAISIQNGGIVGVLNNAGTIQSSLVGISTVINIASAGSISNGIINTGLIAGAVGINNAGTILGNTAIQNNGGTILGGILNTGSIIGANQGIFISNGLVTNGINNAGGLIRGNEALNIYSYGTVLGGLTNTGSIIGATYSGLGLGKNSTIVGGITNTGLISGVISSGIGIGNYSVLSGDLINAAGGTISSSQQVGIGLSTHSTITGSIINDGLISGSLAGIAVAYYGTLAGNILNNAGATISGVGTGIRLSSNSTILGTINNTGTIAGNTYSLNLQNTASGLVVNNSGTLIGAANIGINTLNLSGSNAVVAGNITGSSSSAVNVLGNFSSGGDIAVGAVNISNTGALTLNNNVNVNTGTLTNAGNLIVAAGNTPTITGNYAQSGNYSVGITSPTNYGQLHIIGDASFTSGYSFGIAPGSVVTTGTYGSILDTTGNITGFTGFSGNYSFSGYTNPFEIAKIGSNELDLIYGTTTGYGQRIFDTSTYAGMIEPGFTSYHNGVLINSGVSVGGNSYGIYINSGGSIDGGITNSGTLVGTSIAGILIGNNSTLGGTLGGLYGGGIQNLAGSTIAGGQYGIAIQSGGVVTSGITNAGSILGNTVAGILVGSNSHLDSINNQSISGSQVGAIAGGQIGISIQSGAVVGSISNSGSVIGNSYGIRLAGNSTISGNISNSGQISGVGFTGINAFQSTILGGISNSGVITGGATGISAYYGSQIAGVTNDGVISGSGLGINVASFSTLSGGIDNAGTITAGVTAIQVIGNSSITGGINNSGLISGSSSIGILAGSNSHIDFINNQSLSGSQVGTIAGGQYAISIQNGGAVGSINNAGSILGATAIQIDASSQITNGITNAGLIAGTVGITNAGTILGTAAIQIAGGSVIGGIINSGLISGASSSGILVTNNGYIDSIYNQNNGSQTGSIIGAQVGVLISSGARVNALTNTGLISGDLKGLTIANHANLGQLVNSGTITGGNNGIDLLSYGTLSNGLFNSGSIIGGNTGIYAGVHATLLGDITNTGVISGSAHSLSFVNHNIFAVSNSGTLLGSVYLGQNSLNLIGANPVVIGGITGGTNSTVNVTGTFSTAGIMNVGAINISNSGAMTLNNNVTAYNGIGGVGTLSNAGHLNVLTGAAPTITGNYSQSGNYSVGISNTSTYGRLFVTGDAIFTGLSYSFGINPGANLTANQTYGSILFTGGVISGFTNYSSTYYSGGMSTAYSVTEVGNNELDLIVGSTRGAGLQTFSANTNSGTLSGFSSYENGAVIDSGVLVVGRTNGIYVSSDSSINGSIVNNGTLIGVTGAAIYIGDPSTLGGAIVNNAGATLSGGNYGIYLNTAGTVTNGITNAGLIQGNSIAGIAVMGASAVIGGITNIGTISGNRTGLLVSTNSTVVGGVTNSGTIAGGLLGVALKNASVVDSIANTGSIFGATAIQVSAGSKIINGITSTGLIAGTIGISNAGSILGVTSVQIAGGTVAGGVINTGSLIGASNAISVTNGTVTGGIANTGLISGALGAVVVANHSTLLGGITNTGLIAGTNAILVGSSSYVDSINNQSLSGSQVGTITGSQYGVAIINGGAVGSINNAGLISGSIDGIGVSTNSTILGTINNTGTIAGNTYSVNLLNSANAFTVDNSGTLLGAANIGINTLNLSGSNAVVAGSITGSSSSAVNVLGTFSSGGDIAVGAVNISNTGALTLNNNVNVNTGTGTLTNAGNLIVAAGNTPTITGNYAQSGKYSVGITNTSAYGKLFATGNAVFTGGAYSFGINPGSTVAANQTYGLIFKAAGGISGFNSYSGTYVSGTSSYAYTVLQDATDPTALDLSVGAQTINTINYVPNVLANNNPSAVGAATALTVIANGTPGTMAPAINALNSLSGKAQSNAISQTVPLMAGAFSQATYSTQRALNQIVQSRMDSGLGLARGEEFIGTDQFWMKPYGSWSNQNDQAGVSGYKASSGGVVLGVDKEYSVNSRVGAMLAIDNTNITSNSAAAPNSGVVNNYQMGLYGTYRLDPTLHVNYQADMGINQNKGTRTINFVQSAAASSNYYSYSAHAGTGISKQMPIAEGTTFIPSVRVDYFGMQANGYTETGASSGLNLNVNQQTYQELMTTADLRLDQALTPKSKIVINGGAGYDSMNKQTQINSVFTGGGPTFATNGLQTSPVLYHAGVGFVGTDKNGIEYSVRYDNQFKTSGFVNQTGSVRVKINF

SEQ ID NO: 14146 - protein, 729 aa, Burkholderia ambifaria
MGTATGSVRRAIAIAAGGTLCAAAAGGAHAQASNAAVMPPADAAALLPKIDVTGEAGRASLGLVGLRTATATRTDTPVAEIPQTTNVVTAQQIEMTGATDLNQALRYVPGFATFGSDTRTDWYAALRGFTPTLYVDGVAAPNTAVIANWRVDPYTIDSIAVLRGPTSVLYGAGEPGAIVDAHTKLADGERVREAGVQIGNDARKQTMLDIGDKLDPDGRYAYRFVGIARDGNAETGPNADRRVAVAPSFRWRPTADTSLTVSASFLQDHGDISSNFLPASGTVLPNRNGRLSQDIYMGDPTFNDYRKKQWSLGYALEHRVNPIWTLQQDVRWSRLSLDDATVFGNGFMPGSTTNMMRFAGLFQLNYSRLDIDNRAQARFATGPLEHTLLLGLQFDRQTTTNSVWLALAPSLNLYHPVYRPVTAAIFSGRTSLGHVDQYTAMNSLGAYAQDQIRWNRWTLTLGGREDRVNARFDDRAAGIGTQQDVSAFSGRVGLTYQGDAGWSPYVSYSTSFDPVIGVRMYGGGLPKPTRGKQTEAGLRWQPAGRNLMLTAAVYRIDQTNVVTPSPTNLDPTGTSSVQTGKVRSRGIELSAVGNVTRELSIVASYVYQDVKNVQANDASLNNWPVSVPLPRQMASLWTDWTWHTGALSGLGVGAGVRYQSASAGAPDNSLTVPSATLYDLAMHYEVRHWRFALNVANVFDRRYVSGCQSYAVCVFGNERTVLASAKYNW

SEQ ID NO: 14147 - protein, 492 aa, Burkholderia ambifaria
MNWDVIKRKECGVKIRHKPLRTLVSTAVLGVLATGTLNAGGFSLYTEGAGYTTGNFAAGVAAEAADASTGWYNPAGLVLIRDQQAVFAGVGVFPTAKLSGVSTYSTINPPPFPSFVYSEVFNNINGAEDAFVPSFHYALPLGENATFGLSVVSPFGLATDWGPDSPVRYQATFTELITTNISPEIGGRLTEHVALGAGLDLQYARVKYNRILGVPNILNVLPPFNPMLADSLTYNKGHSFGVGFHVGVLGMFNDNHTRLGANYQSSMRHEFYGYSRLTGPLASPGNILAPFLFPAPGIFQSDDLFSNSIDFPDVVTISAYHDVNDKLALLGSLVYTAWSSYKTVQLSNAAAGRPADNGNVSQAKAISISPQNYNDTLRVAIGANYHVNDKLMLRVGGGYDPTPTNNIDRDVRLPDTDRWALSAGAHYQATNNIGLDIGYTHLFTSSDPVINRTDAFTATTRYNVTASGTAGANLVGVQATWTIDKEPPAPTK

SEQ ID NO: 14148 - protein, 1071 aa, Burkholderia ambifaria
MKHKLTLVLLSFFLGVQCMVAQQMKVTGVVINEDDGEPVIGASIVVKGTTIGTITDLDGKFELETQKDAKLIISYVGLRTQETTAQQNMRIVLSSDSQAIDEVVVVAYGTAKKSSFTGSASTVGAALMDKRPLSNALSALEGNTSGVQMTSSIGQPGEAAKVTIRGFGSVNADNAPLYVVDGAIFSGDISSISPSDIESMTILKDAASTSLYGSSAGNGVVLITTKKGSSSSGAGVTLSISQGWSSRAYNDYAKVGVYDYYPLQWQMLRNANMSLGQSATDAAANASKDIINKLKYNPFVGIANDAIVGTDGLLNPSASALKWGEDLDWEDAAYRTGHRQEYNVSYNTKTEKSDTYASIGYLNDKGYMIKTDFERYNARLNYNIYPVKWFKSGLNLGLSRTNSNYSTSTSSNSAGYGNLSRFIRSMAPIYPVHKHDIETGAYLDKEGNVVTDPALYTYDYEGARISSNGRDGIAEALWNDRLMSTTNSSARTYVTITPIEGLNLTVNYAFDNKDERRRVYENPEVGDGTAGPGRLNIRNRNFLTQTFNQLINYTKTFGKHNIEALLGHENYSYRLQYNYGMKTNEIVSGTYEYSNFVSISSMDSYTREYKKEGYFARLNYDFDDKYYVTASYRRDGSSRFSKDNRWGNFWSFGASWRISQEDFMENLTWVDNLKLRASYGETGNDAIYYTDDDTQQDYYPYQTLYNLGINNGLEAGLYFPTMANNNLKWETQVSTDVALEFGLFGRLNGTVEFFRKASRDLLFNVSQPLSSGVEKIVQNIGKVRNQGVEIDLNYQVLKSKDWKLSVGANATFINNKVTRLPDANRKDGIIKDSKKLMEGHSIYEFWLRQWWGVNPDNGDGLYIFDAENNTDANGNIKDAVKKTLVEKDGQVLTNSYSYAKYDFSGSAVPKVYGGFNINLSYKAFDLSTVFSYSLGGKVLDSSYRGLMDVGEFGYAMSPDLHNAWTTPGQITDVPRLDNNSGHATSIGQSYSTRWLTNANYLNLRTVTLAYNLPKSILNVINIKSARVNVSAENLFMLKARQGLNPQANYAGVSYNEYMPAKNFTIGLNVSF

SEQ ID NO: 14149 - protein, 208 aa, Burkholderia ambifaria
MKNRIVGIVLAAMMVVFVASVATAADDFKRYSVGVQMMFLNPDVDSVNPTASLISAEDTMTGGLTLEYFFTPNFSTELVAAIAHVDLEVGDNKVGSGEAWLLPPSLYIKYHPMPQWKVSPYVGVGVDWVYAWDETVVVGGQRYSLDIEDSFGWAAKVGADIKITENLYANVDVMYLDNETEVNSSAGLDGTDLDLKVWSYNIGMKYRF

SEQ ID NO: 14150 - protein, 390 aa, Burkholderia ambifaria
MKRIRTFALLALPASLHAAGAHAQSSVTLYGIADAGIAYVHNVRNANGSNASNLVRFSSGNLSGSRWGLRGIEDLGGGLSALFQLENGFNLGTGALGPGGREFGRKAVVGLANTTYGTVTLGRQYDPVVDLVQGLTEDNYFGGVFATPGDLDNYDNSLRVSNAVKYTSPLISGFQFAALYGFGGVAGATGSGRTYSFGLSYANGPLSLGAGYFFANGGSTVASGVRTWSSSSDTLFNTVINQGFSSAKSIQIVRVAGQYVAGPATFGLAYSNTQYGADTLSAFTQNAKFNNGSAFFNWQFSPALRAGVGYNYTSLTGPASAHYNQVNLGADYALSKRTDLYALFGYQKASGNTLNASGAIVKAAASVGSYGVNAGTDTQELAIVGIRHKF

SEQ ID NO: 14151 - protein, 667 aa, Burkholderia ambifaria
MKKIVLLVLLLAATETVFAAELPSDLPVSGIKVFTAGEVTVSGKKDHAKETVAATEMEMLDKKNIAQAVNMLPGINVSNVGGRNEGMVYVRGFDMRQVPLYLDGIPLYVPYDGYIDPNRFTTFDLSEINVSKGFTSVLYGPNTLGGAINMVSRKPAERFEGSLKGGLTFSDEGLASEFASLNLGSNQGTWYVQGSLSILDRDFMQLSDSFLATKSEDGSKRDNSDSRDFRGSLKVGYTPNSTDEYSLSIISQQSSKGVPVYTGINPTQTVRYWRYGDWDKSSIYFIGKKALGSKSYLKARAYYDNYYNTLQSYDDASYATQKTKKAFSSRYDDKTFGGSIEFGTEILSGNTLKIALHDKYDMHNEIGNTGEMPKEFEDNTVSVAAENTWKASDNISVIAGVRQDFRHTIKAEDLVGGVITSFPLEDNQATNLQLAVVGRLSESQELTAYLTRTTRFPTLKDRYSYRLGNAFPNPELKPEQSLNYGLDYAIRPADQLKFQASVYQSKLSDVIQQVNNIAYVKGIWVYQFQNTGEATFTGFECSVDWQPVSWLRAYSGYSYIDRKNDSNPSLRFTDIPRHKFTGYLQFLFNKDRWAIVESEYYSRRYSTSDGKYTAGAYGLINLRASTVLYDTLSLQASVENVFDRNYEVAEGYPEAGRQYVVSLAWAL

SEQ ID NO: 14152 - protein, 799 aa, Burkholderia ambifaria
MTLRSRRCTKPRFSSVWTLLLPIFTVPTAIAQSETEVPKPSSKGTIEVIEVTARRSVESLQATPISLTALDTEAIEQKGIRSVVDLTGYVPTLQIQANASGSNDVTLSMRGLRVSDSVSTAESPIGVYLDGAILPRISGAMMDLLELERVEVLRGPQGSLYGRNSTGGAINMISKKPYLDFGLTQDFTVGSESLFITQTRIDSGELGESGLTAAFSFRSANRDGHIDIIDTPNDRDGGAYDDKAYRLAINWLANDYFEVDYSYNRIESEGTKTPSHLAAVSYEAGEVAQVNGEPLELQASRADSLNLNNNGYGTSNTTLHTLAINWDMSDNYSLRAVTGIRDWQGEEFGNDLDGNGLLQANVINPVTFETSIQAFPGLFYSPLNKRKQQHFSQELQLLGTITDDLDFVFGLFYFDEDFDEYNPTNFYLPRAVIGPMFGNPNADFGMLAANIMDFNGSSKSKAAFSQFNWRLNQDLRLTAGIRYTQDEKYLYQTVVDFNDPSGFVSGGDSRDYSNFNWNISADYQFSETSFGYARVATGYKSGGLTARSAGTGNLFLDDFDEETLIGYEVGIKNDLFDKRLRLNTNVFYTQYDDFQIDSFLFGSGGATSLIENAGDADQLGVEVEFVIAATEDLRIDGNIAWLDMDFQKYEVLNRKTNQLVDVAEEAEFPYVSEITAALGVQYLLAELWGGELSLRADARYIGKRVFTQVEVVPGPTPDLDDYHSPFMHDIAADAYTLVDLRASLDGVDTGFGELRLSAWMRNTLDEEYITQGIDFGSLGIGNVIYGDPRTIGLDMRLQF

SEQ ID NO: 14153 - protein, 390 aa, Burkholderia ambifaria
MKKRFALGAACLALGAGNARATPYQDVLLAAVPEYNGRMTEGVALYGSLDMGINYQTVGGRSLWQTQSGGEWTSKFGFFGRENLGGGWRAEFNLESGFLANSGAQQDAQSTYNRQSWVGLSSDSYGRLRLGKQIGTALPLFIDVFGTVGTNSVYTWLGAAAVQTSRGVGYNSDLGPGATQLPARVDNAITYRTPIVAGTTSLMLMYAPSNVAGRAPAASAQGALLQWYNGTTYLAASYNQVWGINGASTVRNDLYGLGAVYDTGRIVLSASFNQYAPKLAGDGIARVYTLGAIVPFGVNAIRASVVYRDTSGVRDAAGQPARDSALGAMLGYDYLLSKRTGLYARAGFIRNYGISTVLLNGNPLPTEPGGTTPRTGTTPVTLSLGMYHNF

SEQ ID NO: 14154 - protein, 744 aa, Burkholderia ambifaria
MTVNRTIALAARRRRTKVGLGVGLGITLFAAQAAAAPGDARPASDADAAGGATLPAITVSGERGSALRAREASVAGLDDAPLRDTPASVSVVTRALIDDQQAKRLSDVLRNDASVVNDYAPVGYFEGFAIRGFPVDLASAIRIDGLTVSGEQNVPLENKERVEILKGLAGIDGGVVAPGGVINFVTKRAADVASVTAGVDSRGSTSAAVDLGRRFGADHQFGFRINAAKENMHSYVDDTNGRRTFGSIAADWDISPRASLQLNAEFQQWIQRSAPGYQLLGGTVVPSVKTTSKALGTQPWAKPVTTDALNLNARFDYQFSDDWKAYVAAGRSRTMIDDNSAFPYGCSYAASCAGGATSPFFFGANGDYDVYDFRSPGEYRRNDDLRAVTTGKFATGPLRHELTLGISVQRRVVHMADAVYDYVGSENVYGPDVAFPPSPNTPGPSYPRLDAWQYGVFGLDRISLGEHWQLLAGGKEVLLRQRSWDSIDGDATHTDRSVFLPQVALVYKPVTALSLYASYSKALSLGDQAPVRATNAYAFLPPVESHQFELGAKYDWLDRMSITAAVFSISKPFQFADPDASGASYTFVQRGTQRHQGIELGATGRLTERMALSASVAAIRARAYDSGSPAYEGHQIINVPALRASLYADYAVPRVAGLNLLGGVEYSAGRNANEEGTARVPSWFVFNLGARYTTKIGGHRTVLRVSVDNLFNKFYWRDAGEQQGDAYLFPGAPRTARVSLTYDF

SEQ ID NO: 14155 - protein, 1125 aa, Burkholderia ambifaria
MNHPLYGRSSHSRSPRSRLALAVASCLLLAAATPATASASLDTWQQQRQLQAAWAQPATSAIPSSTAQFPVAAPTAATSTTATLGNPGDPASWRTDEFNADWGLAATNADHAYARGLTGTGIRLGVFDSGTGLDHPEFAGKNHRSLRLADVLADGSLCDREVLDGPDACFTSDGNQVAIDYTLIDPAYRDLLNRNGYFEGPGYNVHGTHVSGTIAANRDGNGMHGVAFGADLTVARLFANSVNYLTVVERDGGLYLDSKSVAALGASDSIFPQLYAQLNEQHVRAVNHSWGLTNEPDTAEKLDFYLSHPDLADSLGAIAEGSRARGLIQVWAAGNTDSVNPSPEQAPIAGMYASMPRAFTDIEPYWLAVVNVNQALELSNRSMRCGLAANWCLAAPGSNINSTVYGEDSVIDAIPREDNGNVILEVSGQAPTYAYGNLSGTSMAAPHVTGALGLLFERFPYLDSAQVRDVLLTTARDLGAPGIDEIYGWGLMDLRKAIEGYGSLRVDTNVVMNQKAGGLKVWEGDAWDDWTNDIGGAGKLTKSGIGWLRLSGDNSFNGAVLQDGTLELNGTNTLTSAVEVQGGQFLLNGSLVSTALNTTGGVSTVSSSGLLKDSNLTVDGGVVSFNGTQTGGTTTVGSNGLLKGIGTLGNTRVDGIIAPGNSIGTLTINGNYVQGATGVYAAELAPGGRSDQLHVTGTATLGGTLVALPEPGTYYLGEQFNFIRADGGVSGQFAKTDFSAFSPFLQFSLAYGANGTRIDVARGASLASAAATPNQRAVATSADGLAINQGLPKPLTQLFPQQVGGVLDGLSGELHPATALALVEGSRYVRDAALSRRAGTTAPGADAGDATGAWVQALGGNSKLDGNSNTARTEANSNGLLIGIDREFSGWQVGVLAGTGRTDVKQQERRAKSKIDNTHFGAYASHNWGGFGLRGGVAWSKHEVKSTRDVAFAGFSDSLSARYDARTRQAFIEAGYRFGGPEAGLEPYLQVARVEVDLKRINERGGAAALQGKVDDTATTIATAGLRFDKGLKASFQQDSWLHLRGGVGYRRASGDRSQVANLAFANSSSTFAVEGAPIADNAVVAELGLSAWLTPRQQLELGYSGQFGSESRDHGANARWSVRF

SEQ ID NO: 14156 - protein, 362 aa, Burkholderia ambifaria
MKLRFGAAAMLVIAQGAYAQSSVTLFGLIDSGISYVSNEGGGKNVKFDDGIFTPNLFGLRGTEDLGGGYRATFALVNQFSMANGSIIGTGIFGRNAYVGIESDRFGNITLGNQYDFMVDSLFAKGNAISMDISGLYGFRNGPFQRLALPNNPTGAFDWDRTAGSKPVANSVKYSSPTIAGFSAGVMYAFGGVAGSIGADNAVSAGLNYEAGAFGIGAAYTNEKYGPAPGTPSTSVRNWGVGMHYDFGAVTAKALLTTVHNSFNDAGVWMAEAGGVWRIRPDVFLGAKYMYMKGNDAVNDNHAHQVSVALQYLLSKRTMAYVSADYQRANSGANAQINGVLDPNGASSSASQAVARIGLHTMF

SEQ ID NO: 14157 - protein, 171 aa, Burkholderia ambifaria
MRRVLFSCFCGLLWSSSGWAVDPLGTININLHGNVVDFSCTVNTADIDKTVDLGRWPTTQLLNAGDTTALVPFSLRLEGCPPGSVAILFTGTPASDTNLLALDDPAMAQTVAIELRNSDRSRLALGEASPTEEVDANGNVTLNFFANYRALASGVRPGVAKADAIFMINYN

SEQ ID NO: 14158 - protein, 363 aa, Burkholderia ambifaria
MTKKTLLALAACAIPAASFAQSSVTMFGLMDAGISYVSNQGGHGAAKFDDNIFFPNLLGFEGKEDLGAGTRAIFRLVNQYSLGNGSIIGGGLFARQAYVGVENDRYGKLTLGNQYELMVDSLAASGNEIAQDLVGLYGFRNGPFDKLALPNNPTGAFDWDRVAGSNRVANSVKYTSPSLSGLTFGALYGFGNFAGSVGANNTVSVGASYDNGPFGAGAAYTNQKYGATDGLPPTSVRNWGAGVHYTLGTVTGKALFTTVRNAQNGAGAWSAEAGAAWRPSPAWVIGASYTYMKGNDTLDNAHAHQFLAAVQYWLSKRTMVYVAGVHQRASHGSNAQINGVMDANGASSGALQSIARVGFSTRF

SEQ ID NO: 14159 - protein, 701 aa, Burkholderia ambifaria
MSRKNWAAAPMAIVVGTAGLSAAEAQELSLPAIEVSGQRTTAPFRAPESTSATRTETDVMEIPFAVSSVDKKLIQTVAATRGEDLYDWVAGVARQNNFGGLWDNYAVRGFAGDGNTSGTDYLVNGFSWNRGISVPRDTATLERMEVLKGPASALYGRGDPGGLISYTTKQPQFARANTIGVSAGSYGALRETLDSTGPVTKSLAYRFIAMNEDNGSFRDTVSSKRYLFAPSFTWDIGADTTLHYEFETARQRAPLDRGVVAVNGQLGAVPASRFMGEPRDGDYDVRNSGHQFTLEHRFNADWSVNAGFAQRDTDLSGRSSEAFALQPDGRTLWRRYRQVAFHSNDVQGRVEVAGKARTAGIGHTFVMGADAYRFNYDQFVSRSTPTAAAPYAIDIFDPVYGQPAPVPRTATNLLERDDGQGLYAQDTLAFGPHWKVLAGLRWDRFHQSVENRLKGATTTQLQTALSPRLGIVYEASSALSLYANTAYSFRPNNGADVNGRAFDPEKGRGYEAGVKWAGTRWLATVAAFYVNKRNVLTADPANAGFSRAAGEVRSRGVEFEWNGELGHGLRGIVNLAYVDAQVTHDSVLTPGARLVDIPRLSGSALLMYETALPLVDKAGAGAGVIYVGRRAGNTANTQDGFDLPAYATVQLNGYVQVNKHLRASVVLNNLFNRTYYVSSYNSLWVTPGAPRGLFASLAYSF

SEQ ID NO: 14160 - protein, 382 aa, Burkholderia ambifaria
MNTKTRNGLLAAGACCAIAAPGAHAQSSVTLYGIIDTGVEFVSHANAAGDHVVRMPGVTGELPSRWGLRGTEDLGGGYQAVFTLESGFNVRGGDLGQGGRLFGRQAFVGLKSGFGTLAFGRQYTMTYLALQGADIIGPDIYGLGSFDAYVPNGRADNAVTYVGTYRGVTLGAAYSFGRDGAGTGNSPGQGTCAGQVPGDAVQCRNWSVMLKYDSAYFGAAASYEEQRGGTGAAANFFDGVAPVAFTSSGGKDARTHVSAYAQAAGARIGAGWIGRRVSTGSPAAAGAHSDLFFLGASYAIKPDFVVDGEGYRIVNSAHDTRATMATLRATYLLTKRTAVYAQSSYLWNSAHARYAVSGGGAGTTPGQGMGQLGAMVGVRHMF

SEQ ID NO: 14161 - protein, 801 aa, Burkholderia ambifaria
MLLAVRFTDDSLRGPRRDMHARRDRESDKDTGGDTMKETAPSKRRVAACRARIALCCGGAFGGLLIAWPAHAAPDDSRDATTLAPIVVVGTTPLLGLGTPLSRVPSNVQTVRSAEQERQHRSTLTDYLDKNATSVDIAEAQGNPYQPDVNYRGFTASPVVGTPQGLSVFVDGVRINESFGDVVNWDILPPSAIDTLQLIPGSNPTYGLNTLGGALAITTKNGSTSPGGAVEVGAGSWGRKTVQFEQGGRVGDRVDYYLNANVANDNGWADHNASRVRQIFGKLRYTDADTTLSLSAGGADNTLQGTQTIPRSFLDNPRQAYTYPDLNRNRAGYLTLSGDHAFGDRVQLSGNVYYRRYRNTNVSSNVNEDVGRADDDDAADGAQATNDRSTIATERYGASLQLTLLGKPAGFDNQLVLGASADLANARFEQASQPAAFTDSRATIGIGEFQQTTRAKTRNANYGFYFDDTLQLAPQWSLTLAGRYDWARAAIEDVSGLQPLLTARHTFSRFNPAIGVTWNPAPGLTAYATYNEGMRSPTAIELACADPAAPCSLPNDFLADPPLKPVIAKTVEFGARGRVGAATTWSAALYRTTLDDDIQFVSSNGGAGTLGYFQNVGKTRRQGIELAAHTRVGPVGIGVSYSYVDASYRSTWTEHSASNSSADARGNIVVRSGDRIPGIPASTAKLRLDYAATPTWSLGTNLTYRSGVFARGDENNRDAGGKLPGYLLIDVDTTWQATKHLQLFASITNLLDKRYASFGMLGRNFFNGPNHMFDGAAAVDETFVGPGAPRGAWIGMRYAWD

SEQ ID NO: 14162 - protein, 728 aa, Burkholderia ambifaria
MHCYSLAPGACPHNETALNAVLRAGALLPTTLRSLGFALLSTCALPAFGAGIPTLQEVTVGNDSKDLIGVADSASEGTVTAEQLATRPLLRPAEVMEAVPGMVVTQHSGDGKANQYFLRGFNLDHGSDFATTVTGIPVNMVSHAHGQGYMDLNFLIPELISSVKYRKGVYGAEDGDFATSGGARIDYLRTLAAPFVEFGFGQNNYRRLLAAGSTALNDDLRLLAAVEFTGNDGPWEQPENLVKKNALLRLSSGTAANGFAITGMFYRADWTASEHVPERAISSGEIDHYGTLSANDGGKTHRYSLAGEWARSDASGITRASAYVVDYGLKLYSAPSGYISGLQGDQHEQADDRLQWGGELRRSWFLGPQWKDTELAVGAQLRQDRIDKVGLYNTVNRRRTEVVREDRITETAVGVFVDTRTQWTPWLRTGLGVRYDEIHARASALGGSFNMDNGGHTEARQTSPKLGVVLGPFELLGQTEFYANWGHGFHSNDVRGATARTNPQDGSPAERVPLIVKAGGSELGVRAAPLPGWNTSLSVWRMALDSELVFVGDEGITEPKGASRRHGVEWSNYFAPTPWLIVDADVAWSRARFKDANPDNGGRRVPNAIPLTASLGLSVDDGGKWFGGLRLRYLGAYDLEETGEEKSTAFWMANLKLGYRVSKQIEATLDVLNLFDKRANDIEYWGGACTRGEAMAGLGGCGSGSAIDGRLVHPLEPRTLRVGVRVNF

SEQ ID NO: 14163 - protein, 384 aa, Burkholderia ambifaria
MNKKLLTIAILAATAGTAHAQSSVTLYGVIDAGISYVNHSKTANGGSGKLFKYDDGVAQGSRWGLRGTEDLGGGLKAIFVLENGFNSGNGAIGQGGAIFGRQAYVGLSQSQFGTVTLGRQYSFSTDILGSNYSTGGNTVAGNYAYHVNDVDQLTSSRINNSVKFQSANYAGFTFGALYGFSNSTDFAGAAGTGTTNTGGSSRAYSFGVNYANGPFALGAAYTDIRFPSQSSPAFSTTIANISTGNIRDLRTYGVGGRYIFGPATAWALWTRTQFTPVAAGASGTFYNAYEAGVKYAFTPALSAAAGYTYTNATQNGGSAHWNQGNLGLDYALSKRTDVYGLVVYQKASGNNVQAQIGSSTSYFNTSGTGSSNQLAARVGIRHKF

SEQ ID NO: 14164 - protein, 370 aa, Burkholderia ambifaria
MKTLYKLAPLAMLGAFATHAGAQSSITLYGLISAGVGYATNQGGKNAWQALSGTNQNPRWGLKGKEDLGQGLSAIFQLENGFNVMTGTAAQNGREFGRMAYVGLADRTYGSLTFGRQYDAIHDYIGPVIIASNGVNIGDNDNGYNDIRVQNSVKYVSPVYYGLKFTALYGFSNATGFANNSAYSFGLGYERGPLRWSVVYAQYNHPYSSTNPDGAIANDYGSPLLIFAKSAMSPAVFASRQRIAGTGGFYTIGRAQFAALFTDVRYDYLDHSHLHLQNIGVNVVYTMTPQLFLGAAYAFTNGKYDVIDKRPKWHQVNLQADYFLSKRTDVALTVIAQQAAGDAQHAQIFAYARSTGTRQMMATLGVRHVF

SEQ ID NO: 14165 - protein, 397 aa, Burkholderia ambifaria
MNKQLIAAPLLLSLAGVAAAQSSVTLYGIVDAGVTYRSNERIGSAGAYTGHSSVGLTTGNLSGSRWGIKGSEDLGGGMRALFALENGFDITNGTSGQGGRQFGRQAFVGVGSDRYGTVTLGRQYTSLDDFVSPVGPSSFIGGFGAHPGDIDDLDQTARVDSSIKYTSANYSGFTFGALYGFGGQPGSMKQRNTWSVGAAYAAGPLRVGVGYERSDNSKKGATDPTAGKWQSTDDGLFNSSINEGYASAQSQQVIATGATYDFGPAVVGVNYSNVQYRGGAQSLFSGHATFNVAGVFTRWNVQPQTQLFAGYSYTRGSDVDGIDNRAQYHNVTLGAVYDLSKRTSVYLLGAYQHASGTTLDALGRPVDATASVSDKANGHSSDSRSQAIVSLGLRQKF

SEQ ID NO: 14166 - protein, 722 aa, Burkholderia ambifaria
MPSRRTPRRARTLRPWRASLPALITLCVASGAHAANAEPVAPASTSTTPAERELPTISVNASSAADPTVGYQPRTTSIAGGDERPLKEIPQSVAVVSSSVMQDQQARSLDDVLGNISGVTQTNTLGGTRDAFIKRGFGSNNDGSVLVDGVRTPVLHSYLATIDRVEVLKGPASLLYGMQDPGGVINLVTRKPEDTFGGSISASRTSHGGSSAQFDLTGPLGKPGQVAGGTLAFRLTGEYDTSRYWRSFGRERNALIAPALSWHDANTSIDVSYQYVDYTMPFDRGIVLVNGRPDDALRYRRYEEPWAQSSGIQETLRARVEHRFSDAWRVRATYGWGRDRYDQYIARGTTFNSATGAMMRTADANLGRNDADQIATLGLLGNLTLAGMNHALYVGGEYERQRSFRGDTIRGKAIKGFDLYDPVYGLLAPGGTPNAKQSDSRSLVHTYSMIVQDSVKITDRLTAVGGLRWEDWQQESGMGRPFAFADRSHGNVWLPQFGLAYALTPSLTAYANVSRSFKPNVASNVTSPLAPEFGRVLEAGLKFSLKPGITGTLAAYQIDKRNVAVTVGDITSTIGTARSRGIELDVAGQLTRHLSLIGSYAYTNANDRDSNTSLVNVARHTGSLFAVYDTALANLPGRWRFGGGARLVGARPGDTANSFTLPGYVTVDAFAAYETTIGKFPTRIQLNVKNLLDKTYYPSSNSDLIVAVGEPRLVTLTTTVSF

SEQ ID NO: 14167 - protein, 364 aa, Burkholderia ambifaria
MKTKLGVALATAMALAGPACAQSSVTLYGIIDTGVSYYNNAAHGGSFIGMPTLTGEVPSRWGLRGTEDLGGGYQAFFVLENGFQPGTGALNYGGRLFGRQANVGVNSPFGALTLGRQMNMTMIVLTNADVIGPSIHSMADFDSYLPNARSDNAIGYKGTFHGVTLGATYSFGRDAAGPAGPSATGCAGQVPGDIVACRQYTAMLAYDASNFGLAASHDVMRGGGGALAPLNNPAYTDTRDIVAGYVKIGPAKLGAGWIRRNLAAAAHLQADIVFAGGTYYATPYLALDLQGVRYLQRRENGEGGTNATLLVGRANYFLSKRTTAYTSVGYMFNSATAANAVAAGGTVATGSNQLGVMAGIQQKF

SEQ ID NO: 14168 - protein, 736 aa, Burkholderia ambifaria
MLNRTPFASALALAFALPIASPALAQNTSAEPSPAATAKPGDAPPTAAATAARDTLPTISVSGQAVQQDFQAERSSVGAKTPTALRDIPQSVTVINKALMESQGLTSFQDALRNAPGITIGGAEGGQIGNNINLRGFTAQNDIYLDGFRDRNQYYRDTFDLDSVEVLYGPSSMLFGRGSTGGVINQVSKKANLKPSAEVSTTIGTDDRYRTSVDLNRPLGATSAFRINAFGQSLGSTRDVMKNKDYGIAPELRFGIGTPTEVTLSALIQHNYDMPDYGVLAVNGHPAPVPKNTFYGLTDDRTIQDVQTVSARIDHRVNDALTISNRTSFSHSMTDARETAANAVLTGPLSSSAALTNGNYTSLPMSALYVRLASHDRVIENHSVDNDTMAHFKFDTGFVKHDLIAGVEVGHDSYANQAYTRSGLPILSLIDPAYLASTPTNATQTPANHAESGATTLAAYLNDTVSIGRDWKFVGGLRWDRFQAHLANTVSAPRYASQTNYFTSVRAGVIYQPTESQSYYFSYGTSFNPSLETLTVTNNTQNLSPEHTKSYEVGGKWDLLNDNLSVTSALFQQEKSNARTQTSTGEYLLEGDVRVRGFQASVTGHITPKWQVFGSYTYMNGVILSARDGTQGKALANTPRNTFTLWTTYAFTPHWEIGGGPTYMSGRYAANTDYVQVGGYTRWDATAAYHAKQWDLRLNLLNLTNKFYYDALIQSDGGRAVPGVGRTFLATLDYRF

SEQ ID NO: 14169 - protein, 737 aa, Burkholderia ambifaria
MPRFVPPPNPIPNPALTPLALALPLICTPILTTPALAQSTTPEAPRILQPVTVSADTTAAPDPATEGTGSYTTRVTRSATRLDLSIRDTPQSVSVVTRERIDDQGLQSITDVVAATTGVSTKVNDSSRSSFSARGFAIDNLQIDGIPTTWSTGWSAGETLTDTAIYDRVEIVRGATGLMTGAGNPSAAINLVRKHADSTVFTGAVTLGAGSWDNYFGTVDLTAPLNASGSVRARVVGSLQDQDSYVDLYHNRRETLYGVVDADLGERTRLSVGASRQENDPDASQWGGLPAWHADGTRTDWRRSATTAAKWASWASSHRTHFVRLEHQFDNGWKAELMLNHGENEGDLKLLYLYGTPDRSTGLGMGASPARYAVSRKQDDIGVHASGPFELLGRKHELAFGLMRSEQDFDATRRAAAGVSAVGNFNLWDGSYPEPAWGPETLSEAYETVQEAAYAVARLSLADPLKLIVGARVSNWTRDGQTPTARYEFDHKGVVTPYAGLIYDIDGQHSAYASYTDIFNPQNYRDRNGDYLDPLTGKSYEVGVKGEYFGGRLNASLAVFRIEQDNLAQTDAGYLVPGTSNQAYYAAQGTTSEGYEIEVAGEPAPGWKIAAGWTQFEAKDEDGDKVNTNHPRRMLKLFTTWQLPGAWEKLTVGGGINWEGENYTAVTNPVTGAAEKLKQRPYALVNLMARYQISKAVSAQLNVNNLFDKTYYSQIGFYNQLAYGAPRNAQLTLKYQF

SEQ ID NO: 14170 - protein, 8746 aa, Burkholderia ambifaria
MSIYITKYVINTFLSKWRAIVALFLCICIILNSVTVTISADKDSEKNINSSKENIAAPLGESGNTEDFQQAETSSNTQQPQVPTSPSGMPVTSGSQVVLDLFSPPPPPPPSSTIFSPSFLCAPLTLYGPPAMSYIPIPNMGVRRSYSSPDINCNFERKNEHEKSGSLSVPVLLEKCIYDKNSESKRCTNICLTIESIIRGHEETVKQKEKKKKSKKYDKRNIKEQQRRIEKRQQEEKVALLKQYEEKLQALQSQQASQRLEALNNGTDMYTLFSQQYNEEQDCHREKEKKLEELLMLHKQERDIFFIPVSDSTEKGTVEGRQEDYSDINKDRRHSTPSIPVTALNIFIEDSSKSTPGRLEHQDSYSNISNEPKSLSSDLDVYNNRDVVSSIPLSLINPDEEATVEVSASESLTETSIQVGPFPSKTSLLKYFNRVMNEEGFGSIQKYYRDDLYLPGCAVYQTAKKEHKRKHSGIRLPWLKRFNLSSKTKTDLQDESLQESSPPKSLREDGIYPPLLQHKRPSVYYTKEVGAGDDTPHSLKHVKYRKKRVGGILQSPEIPDFCKIEKIFRSLPSSEEEQESELCPSGPQGKIYLFTLGTQGSEPGYCIMRDPFESTSCYYPSGSDAKSESSEQGFYSSNLETENNTFLFNRVSPPEELQYGKKKSTLPLQKRTSCKKNKKWKSSYVVDDKQRAQSKMELQKHQYYITDCLLRLEKLHKHQYEVAKKTGDDLCSLEKKQAKDKERLQATLNEQYLDLLTKHQQLIARNTHPSEESLSEISEGNIEDAESSESDLERKHQAKKKRLNKKLKKLLVENYTIGRNHRQSVEETTTKIDKRHAQERCHWTTKKGPFSQCLMLQTEELWAFYNEKEKEREKIEAEKKENLKKYKQEKAAKQSYLGWLFGWKKAASESEKEKSSSEDFKTSSDSELEIKEVVSLSDKEHSEFDHSDNYEYDKSKPKCYISTKERNKRHKKSLQRDSRLTAGLSLGAPRQIMYQDKKDEKSDDDKKVSQGNESPQVTKESTVDGKKEVSAFEENLKSDEGLSVGDITFELSVLSGATGGDEDPLGKDKGSHEQEKEQKKDQKKWSDKKKKKWLTFKADQKKCPILTKEKYWSICCDNLLELHNRHEKEYKEAEKNASNIELLLEKQSQEQECLRSELEELWKQTREAQASSSSESSGSIVSSDIRSRGGYDIESDVDQETSNKRARDKQISKLQKKQQRERKTLLAMQRTKQEQLDEIQEERRRKAKRLGMSLVELNLMQQEQKEMLHNQQQQQVNRLVERQRQQMNELLASLHQPTMSESTMYTSCYSGIFGYLFGWGSQKVSSGKEENDVEQTPEKITEEKVKAVAGIGTLGSDAELEEGIFSDGADFSSTILQVMSDSELSNDIEQVTEQVEYKGVVSRGSECDEIGEPMDESHVPEKIMRLFERATFVDKDSSSGKEGDFSSEERKSSSYRNRYYGVEKRRKLRKIHLKEKAQLEKQLKEPEEKIRLQLEQRQQERRRKNLMFGYHISEDFLDKLEEDEYKTSFEPFNKLRAELEQKQAQERLSLQAALKKEFEESCQQDSEDISDPEVKQKKKEERDLLVALIEEAAGDIQDVEESEEEYIIEWKKNERARRAALLASARESGKPLCFQFTAQSSSANAASSMHGSHPETQEGQSSDKASATTVEPSNITCPGDTTSTALTKETSSVLLQSSSSSIVTSQDPEEIQHTDENKQDTSLFDGENRKKEQEKDSTPLGTGVSGGYHDASDHYGQGRAGEGGGGNNDPPVPSDSTQPSSSTSSTGVQTCQSSLIENAQDSSLQSSLLGYLLPSSITDKNISTKKSTLKTEGVDQSVSSSRCPEALTASVTSLFSSSYLKVLFSGWGVTNVEAAVTSDPNESKNKNSKDIDILGENSGNTSIEGNQDSLSDSDGSGQSPSGATGGGSGESLGEPDDDKDKKESSGHKKKKKKKHKRKKKEQGTSTETQTQEQQNKESQTSSSHQCEQITSEDSQEEKEPLVKKGGQDGKHDKDNNTVSDSEEGAWKHHTIIVKGDRKPEGNYAPPPWLTHPLSLLTGSPVLEGIPLSLEDELECGFAIDAMKLLDEGLEESASSSDIFLEGVIEGAIGSSKKAQHISNQYSILKQRQSEAVKALGRKHKQQLEELRESQLQKKNKTLRKNIKDYKKKKKELQQKFQEEMENADQETKEKLETICKEEVNKLYLTCKEDSEAQACSLYRKDGDQVEVLILQQKEEYEKLLQQQKEERKQYRGNKRALLQSISSTIGLQQAVVQQHEGTAAVPQDTFDSQSQGTTNSSWMFLRLDFSDNGEGTDNMFPFDPLPREVQGASFTDATSEDQDVDEIAQEADEDLDSNGNSSESGDLFDFSDGDYEDDKDDDLIPSWFPLHDVGISYGDAKGKGEEEVIGQPSSTTDIITGAIGGADVVSVIASSTASCGGGEEEVVVKSKEKEKKKKRKKRKKRTTEEYDAFVEKQRQYIEDCKRKYNAAYECLKAICKEEHNNATSLEEQQELAKQHERKFGALSHMGMAQHLFLQEKLGKKKKRWLKGEDVSSEEECSLWCNFVFEPRGDDSDTISSEDETNVAVEVIVDAGTNTETDTKGQPKEVRTGGENDPLEGESSGTVSSKSKELQEKHECEIQCFWEEYKEQLVTLHDNQEQRLQKWINDGKPEHDLKNTFGEEEAALHQTQGCFLKSLQEKHKREEEEERRQKGQEDSGTSLEQPTSKSKSKVLQEKHASEMQCFWVGYKEKLTILREKQKQHHQEWVESGKPEDELKDTFEKEEEALHQMQKCLLASIQEKHKREEEEERKQKEQKDKDSESSIIQGPLEEQNEETPASRDSITSSQGDTPHRENTSLVTFKELGVESGEEEINKEDKKDSSEEQTSESKSSNGLLQKVISFFQSVGSSFNKEEGAVGGIVTESCYVKSKELQEKHESEIECFWGEYGIQCRLLRDFQDAQRQSKGLRNTAEALENQLDKEREDFRKKKKKEWQNLQEKHKQEEEEERRRQEEGQPSKGGISGAKEKESDELGDETDGEKVFSLTFFGPPTQFDDNNAPPPFPYDPPQDSPQNGEDSSEINPNPEGSSQQESPSESSTEDTSSSSEDEDIVTLLSGNIKQARPIGQSTITTTTTLVTSVEGAEGLFPIEEETEQNLEDVQGSGATQGMVGLSTIEEEVEEAPGASEDLDSNQGATGEVSSPGSKEEVVYLSSSGERAIHKWLESSISMPVTMEEGSLSQGGGKTSTLYSLMVSSGILSFGGDGNGEKASSSNKQSKRSPEECKAFEEKQVQQRHNLLQSIEEKKKELLLTFEKQCPPGLPSYKKDKLVKEQKVTMEDFLCVSCYQYETLEQKQNEQRRRWEEGEDVAEEEDLILLWDTLDNEAEEGTKEEHAEVKVEGVEGEVFDGISEEDKPKKDDKEEQEQKATLGDSSGETIEESQQPQQEEEEKKENSPSGSNESPSPQQEEESVDETSSVVTSSPLLSINEVKQTEDKSAKKKRSEKELDDFNRKQAEQKDCFLGQVQQAKNELEEKYGEACCSASLDELLELEKKFIKQNQKLDSTSEAQFKKLERRQEDKRNRWEEGEDVSSDEEICFIWSSDESYEKSDRLHEKHTQELADFWRNYKKKLSTLKEIQQERRDQSSEDSKEKQAMEEMFLAEQEAMYKSQMNTFAELKQQQKKEEELEELGWTLENMQGAVGGVEPEDEDKIESPLDRKHQQERKSFWEKCRVDSKFIEQEQSERRDRWRKQGKPIASLEEIFIEEQQAVFETKMLFWESLQERQKKEREEKERREEQKRIAELEKQLSPFWKAFKDDQARMRENHDMRRKEWEESGKSLVVLEQLLAEEEEIFFQDKMQMLEELERKKYFEEKQSSRQKERQGRFSTKDDSDEDEDDIRYHTVFVQGEGEPPGNEAPPPLPFPPPVLGDSGEMQSGDTGGAGPPSEELSLGNILSSSDEDDNIIVSSTESSSSSSSSSDESDVSSFETSSDEGPDCVDGVYGAVGGEEPEKKKGNGYHKKKFKKVKKKLHNVALNQKLKKLKDKLQQLEKEYHKSIADCQNRYQDVKCNLLMAQAEELIGKSREEQDTLCKKNSEKIKKIEDGYRRQYEQLTESYYTKKQVVLNKLSAVMEKKALLKQKIQEYDSVDGKHRVSKGYKKKASKLKKESKKLEKELEALKEQQTKELQDFDQKSDACRQQILFFQKEEVNSIKDAGGDLCALQNKHTEEDCKVEELFTSQKELLIKEHESQRNEKEKRKKELEKQQQATREKDTPTCYEHGIDNIVKLLEEEIESLEKELEELEEKQEEEWKAFELQTEACRKQVLFLQKAKPKDSAREGGEEDRRAFESMVASQQELLLKEQERQRTEKLIRLTEAKEKRKQHKKKQQQKQEEKEREKQKKKQEQVKREKERELERQKQQLKKEHVQDRKCFVTTFNFCKEQLQRLHQENLKVVHEKGSDDTSLMQEYEKEKECFLTAQKSQYEKLLHQQRQEMKTLIQGSHGADVSSSQKEHEKSHAKTLEKLLQRQESCLKQLEDAQKQERQEAEKLGKDLSKLDEKHRKEKEDFFDHHKGILEQCLLQNLSETVCLLGRDESSSDEGSFDLEGFYSPDRCMGRVGEPIFTFVGSDFVRSQEASGIYPLEQQVEAFDEVDTGRKKEEDSYTDKEKKKKKKSKKERKLESELEKLKKEQAKAKSEFEVKVTSCREELFKSQRDEFVTAENKKQDLKALEKKHEDENVQFTSMCEEQFQILCKNQEEEKVRKEQELQKAKEDHKKKKEKKKEKKEKKKEKEISKLQQQHIKAREQFLQSYKNCKEKMEMLDQEELLIVEASGGDVEAKVKELQAQAEIFFKIQKDQYKLLFHRQEQEMKALEASFYGDEVDAPTGARSIEEFLVDRMLKPQLSEDSEEELKPLEDPSTFYNPSKYGEGSFIFFTQLSSEQTRDQYGSDDENGFRYHTVIVQGEGEPKGDEAPPPFPFYSFVSGDSGEMQSGDTGGAGPPSEELSLGNTSSSSDDDIITSSIESSSSSSSSGDEADVSSFETSLDEGSDCVDGVYGAVGGEEPEKKKGKAVDDVDGGRKKEEDSYTDKEKKKKKKSKKERKLESELEKLKKEQAKARSEFEVKVTFCKEELFKSQRDEFVTAENKKQDLKALEKKHEDENAQFTSMCEEQFQILCKNQEEEKVRKEQELQKAKEDHKKKKEKKKEKKEKKKEKEISKLQQQHIKAREQFLQSYKNCKEKMEMLDQEELLIVEASGGDVEAKVKELQAQAEIFFKIQKDQYKLLFHRQEQEMKALEASFYGDEVDAPSGARSIDEVLSSEDSEEEPKPLEDPSTFYNPFKYGEGSFIFFTQSSSEQTRDQYGSDDENGFRYHTVIVQGEGEPKGDEAPPPPVKLRVPPSLTADLEDVGDGNTEVDSRCFNQGVTSSGISSSRSSFTTEEGSQGSGSMSSLVRLQVSSSLITDLEDTENGNTKTGTQQWLGNTGNDNSCNESTQYTDNSSHHSSDDDGTDGHSNDNINGAEGGSGAAGGSGGAEGGSGGSDDDNNPPDDNSSNEEEEEESILLVSETDLTDTKAEDGDSEGEGGIKDQRKKRKHKKVSKRKQRQHERQLLEKKSLAHSQWNEKKKQQEKQRNRALLFSIQRKEDLSEQIRKEEREQQEFESNQHHERILLEAKHKRQNAEHSTDSDGEVHFPSKRPKKSHKKKSQQVGKQSSQVEQQVEKKDSKKQREEKDVPSCLLTDISYKRLLSSSQQEEKIHCVTSQQKEKEELQKKQEKEKEEYKKEAAKVQKCLAKLSSQQQPGASRQQKQEEEEILQQQTKEGNQYILKSKVKLNNKQLAEKDKLIRKHQEENLKLSKKHRKEKTEKEKKRKKKEEIKKKKHTITPEEKELQEYCSGRRRTLYSMQIDERDLLEEKHKRELGQILDMEEVEVLEEQHEEEVKELFEKQSKDRGLLEEQIKILLQQQSSHTTSGDEKKECVESSDEFDSIPSSSTYYDSTSSSYSTGDFYSSMPSGEPEVEIGIEIDENFGVGTSENSNNTQDETHRPIGGARKYQPKEYKDVSDTSKKQKKLTRSTPKLMLLSKKEKEALSHNVTQSYHNIYKKIRKKEIELEDVLRTEQEKDRRGEDADYQLILLLKDELQHLLSLFEQTLEEERQALAAVDAMDEQTELEQQSIEESENKKKEEPRRKSSLLERIFKRKQEGDEPSKKGKENHHENQKRLEEEPLVGLKKRPKRTSTTSRLSLTLTSIGESKIPQCEKSDESNLVGPVVSFFKKELRTRKSSMIHGVCFPQTGGVLQSLDVNSQKNLVSRDDSKKLESSGAPGGGDGSGDDSHFKKDKGSKRDGSSDSKKKKKKHSHKRFCRKRLAHERNKLRRKHQEEKELYKEQFTRGVQQVFALQDKERAEVAKKGGDLEALAERHMQDEEEHYVRNRREVADLHDKQNKERCRLYLISKGGGESANTTVTSDESSVSEILESGSEAAVYKEPVTQEVEELRRQQRKELAVLMFCCEDEKTALQTMHEKNKESLVGTILLETLEKVHKQEEDDLAAEHQKKKEELLKKHKQEQKDLENKHKRSSSKRGPKRKLHPKVKAVLLEHKQAKNRQKIIHQNRKTHLEKKQEEEKRMISQGQVPSVLLKKVSEYHGGQEGTSLVELVALYHEGEMSALLDEQKRQREEREKRQRQDLIRAKVGAFFTQRTPSVRKKEGLSLSQSSLHDSSPQKYTHPSHKTCGRLAAEQAIEKGFFENHKANCSFILGIEQKKELKQLEEECEKELKQLEEECDAAYAIFLQQLPFLCDEDRQTQEQHFVSQRQQIEKYREQQKEQLTCLQHKHQQEAKELEKLLEVQAKELEKRQKEERQKQRDVVSSYPERKAQQERLITQSKHLTALKEALSEEDSIFQKDLTSSTIVKQQLSKVEQQKELEALQEDFVLDLCFTESDYTSVSEESSEESSVPEGISRKPHGPSGGGFRHPRREISSSDSDTEGKSDDQSVRRIEQEIQTEQTGPQGTEESQTYAVQQKTSQFVEVKEEEIQVLEEKVQIVEERGDSDKEKVLTREEKKRKKEEVQRKHEKELNLWMSQYETTVQKIEQKYKEKKANRHILGCTLEELQEQEEKESKVAVGNFTVLLEKMREKQQKELQQFPSSDEDESDVDRRKKKKVIKTKAERNAQREQRKHHHTPHPYHPEESTSHLVLDTKQIVTLTPSSSDQETPVQSKETATNETPIPSLPSTVKGLTLEEVTVTVLPQPTQLSSLLSYFSSEPLQEQPCQVEEQQVSFESSQVQASTDEATIDPEVQLVLDEYSSKVACLQQEMDKKLQEIEEKGTDSSASSDTEWSWPKKDMPREIKTLKGSDSEGKDQQEVPKIPSAGAHSLSSMAESEDVGAVSHIEKKKRKRHKKHKRSQREKISRAKRALMAQYFAKVTLLGQECSEKVSEIQEQKKQKCEIEEKQRKEREEFFDQHQAARNALLAKQQQELIGVAPEEVGPLQDKHRQEQQAQSRQWGLNLHSLIKQQRKERGLSSSISSSSSDEDIIDEGSQSDDQEDSKSLSSPISPPPSPPVSGADSQCIGGASSSDTDATMKSDGHKSPEVPVSSDKKEETGGNQSSKVTTYLLSVFTGKGGTAAGAQSSSSEHTGSKRQQPSGSDQTSKSSRQGPSTPFEGQGTSGVEGASGGAGDPGDGEDKKSKKLDDSHGKDQKSSLKKHKDKKKHTTEEEEAKKRLQEKVEQKRKNRELLKQKCKEEEEAFLRNREKCKKQFLQEQEEEYEAARQSGKDLELLLVEQRERQVEFYNHHESQHAKMKKKHEALLKGKRKKKVKKYGTSLEEQQAKERAEARQKYQKGIEVMEKRQQEELDEASAQGKNLEDIKKKHRQEEEDFYREQMLGELGNLLQRQNQERQSVGLPPIEGSSSSGVTTYSDTEYSSLEMDLETKEEVYTSGNESTEQEVVTEQEVVVTEAEEVTEEKLLVKDESFSYQGSLTEYLSQAIPEEVNKPCIDDTSSSTSTTGRKSSFFEKFFSKVKGRKHSQEETESKSGTGSTASYGSKSSTTMQKDEVQQHSDRKLKHKQKKKRKKEKQLEEKHQQQQQDVYKDFKKRRLLMETRHQKELEEAISKGEDITKLQEKHHEEASVQHPLLFSQAMSVLREQQKVERENLIVSSGDSDTTSDTSDLEETGVSSKDHSPEKKGGKDGKPDPDGGSTSSSQYQGLVYYVTADSAPVFPYGSEASLPFSSDKGKNEGKQQTLQCGDSGYESDNQESGDGSGGSSTENQVCVSQESNSSLGGGPHSDDGYESSDENKNGKGSSGPQSVCCVNGVGATGAANGGGSSVASGVGSGNTGSSGSSSSSSGVSGNVGTPGNGGSSAGSPGGSSGSPGGSGGNVGGSGNSAPGGNGLVSVTSSMGNGSNPPDPNDPLTMSLLADDEDTLSDEAKEELLVPLDYNENAIMGSLDGLQQVLHTPAKSVQSAMSSLALQSRTGHMSPTKRFQAFASIEGEVSSQSGNQNAYTSQFGIVIHPVPNIRVGLAYNYSRDHTGDLYGIRSKKDIGFAKSKVSTHILSSMLVWNAEDSGFTAHIGISYGLGQVKNTRYISYLDDVIHTKGRSDTSILGGIAQLGYTLRLPKFLLTPYIELSTVNAWWKAYGEEYGLLASDISRGEERIWEKSMGLRTRWSITDDIQWRVWSKVISGQRKSKELTATLKAPFVPWETSTPDKKKTYSQLELGTAFDIQLSKQFGIGVNGSIRFSKKKEMRQQNAGMRFWYNF

SEQ ID NO: 14171 - protein, 494 aa, Burkholderia ambifaria
MKNRFEAARTRRLDALTALLLSLAAAPAFAQSASPAAAEPTAGASETAATPAQAADAAAPAPTGFWERSNLLGNMGGLRDVLGGHGVTLSLQETSEYLYNAAGGTNRGGAYQGVTQFGFNVDTEKAIGLPGGTFNVSGLQIHGTNLTQRYLQTLQTATGIEANSTTRLWELWYQQAFLDGKADVKVGQQSVDQEFMVSQYAATFMNATFGWPVLPATDLPAGGPAYPLSSLGVRLRVKPADAWTAMVGVFDGNPAGRSDGDAQSLNAHGTNFNLRSGAFVIGELQYALNAPPADPKAPQPAGLPGTYKLGFWYQSQHANDPRFGTDGLSLANPDSNGIAATHRGNYGFYAVADQMVWRPSADSPRSVGVFARVMGSPGDRNVVDFAANAGITLKAPFAGRDNDTAGIAVGYTKIGSHARALDGDTGAYTTPGYPVRRAETVIEATYQYQVTPWWQFQADLQHFFRPGGGIPNPNATGARIGDETVVGVRTTITF

SEQ ID NO: 14172 - protein, 747 aa, Burkholderia ambifaria
MKSRPDELKLGKFTTLCSVLAASPAFADGTPSPAPVSTEGHLAPIEIQGKTEHSYKADFSASAKFTAPLVDTPKSVTVIPQELIQNSGAATLTEALRTVPGITFGAGEGGNPLGDRPFIRGYDSQGSMFVDGMRDTGATTREIFNTERIEITKGSDGAYGGRGGAGGSINLITKVPHLGTTAAASAGLGTDRYRRFTADGNWQFADHAAFRLNLMSHNNDVAGRDVVNNERWGVAPSIAFGLGTPTRVTASYYHLSTDDMPDGGIPYFYTTSNKPANVDTIYPAPVDRHNFYGLIDRDFRKTTSDISTIRIEHDITPGLTVRNTTRYTESTQDYIWTQPDDSQGNVVNGKVWRRNNNRDSSINSLANLTELFGEFRTGPFKHSFTTGIELSREWGKRDSYKVATDTGKICQKGIGAASGYNCTSLWSPNPSDPWAGSVTRNNDNAHARTTTKSIYGFDTIEITPRWQVNAGVRVDDYSTRFTDTKANGGKTYTRDDTLFNWQAGLVFKPAQNGSVYASYATSSTPAGMLLGEGSETQSLTPGRGGVGPNVDQMAPEKNRSIELGTKWNVLNDQLALTAALFQIDTTNARVTLPNNQYAMVGNKRVQGLELGVAGQITKQWQVFGGYTYMKSELRDNGKDAANNGHRFPNTPKHSLTMWSNYDVTPKFTVGGGAFYMSEVFGDPANLRAVPSYWRFDAMAQYRINKKLDLQFNVNNLFNRTYFDQAYPAHYASIAPGRSAFITLNARY

SEQ ID NO: 14173 - protein, 500 aa, Burkholderia ambifaria
MTTDQHQEILRTEGLSKFFPGVKALDNVDFSLRRGEIMALLGENGAGKSTLIKALTGVYHADRGTIWLEGQAISPKNTAHAQQLGIGTVYQEVNLLPNMSVADNLFIGREPKRFGLLRRKEMEKRATELMASYGFSLDVREPLNRFSVAMQQIVAICRAIDLSAKVLILDEPTASLDTQEVELLFDLMRQLRDRGVSLIFVTHFLDQVYQVSDRITVLRNGSFVGCRETCELPQIELVKMMLGRELDTHALQRAGRTLLSDKPVAAFKNYGKKGTIAPFDLEVRPGEIVGLAGLLGSGRTETAEVIFGIKPADSGTALIKGKPQNLRSPHQASVLGIGFCPEDRKTDGIIAAASVRENIILALQAQRGWLRPISRKEQQEIAERFIRQLGIRTPSTEQPIEFLSGGNQQKVLLSRWLLTRPQFLILDEPTRGIDVGAHAEIIRLIETLCADGLALLVISSELEELVGYADRVIIMRDRKQVAEIPLAELSVPAIMNAIAA

SEQ ID NO: 14174 - protein, 372 aa, Burkholderia ambifaria
MNKTLIVAAAAASFATVAHAQSSVTLYGVLDAGITYTSNVQPALGQAGKSRWAMGSGIDQSRFGLRGSEDLGGGLKAIFTLESGFGIGNGKLGNNGGMFNRQAFVGLSSQYGTVTLGKQYDATQDYLAPLTATGSWGGTYFAHPLNLDRLSTTGDVAANNTIKFTSANYAGLQFGGTYSFSNNTNFGNNRAYSAGVAYQFQGLKLAGAYSQANLGDGTNANGATSSAIGGIASQGRVRTYGAAAGYAFGPAQVGAAWTQARLDNNAVGLGTLRTDNYEVNAKYNLTPALGLGAAYTYTNAKINNGSTHWNQFGLQADYSLSKRTDVYAQAVYQRAAKNGIGASIYNGDSFSNNLPSSSINQTAATVGLRHRF

SEQ ID NO: 14175 - protein, 359 aa, Burkholderia ambifaria
MVKQAVAAAVIGMSAVSGAWAQSSVVLYGSMDAGVAYVNNVGGHAKWAMIQGNTQPDRWGLKGKEDLGGGLSAIFQLENGFYTNNGQFATANTIWNRAAFVGLSSDRYGTLTLGRQTPLTFDYLDPLSTAYLAMSWYAFHPGNIDGLAATGNVPYNNAVKYRSPSFGGFSAAATMALGNTTNFSTGKSVGVALNYANGPFKASAVYSNEHDRAILISQTGITSFQGQNTANGYLANKVENIGAGASYQIGDFLVHGLYTRVKMQSNGFSDTFQSYDAGVNYRSSAFNTIAGGAATTTLAGRRWTQVELGDIYSLSKRTQLYANVLFEHGSGGAKAAFFTAGTSSTANQVIVLTGIHHSF

SEQ ID NO: 14176 - protein, 487 aa, Burkholderia ambifaria
MKNHSFKKTIALSLLASMSLCRAEEDGAFFVIDYQTSLARQELKNPGFTQAQELRQLIRDGAVRLQTSAIPLSYYLDILGNKTATLLRESLKNNAQPSQPNAQPPQQNGPSNQALANLEQSLGILGKLLDLSQQYASQGVIKPLVVDVGKEQIGITDSMLLVAQNIVLALGQVDLSKIQQNNNEQLYENIMKVMLLGAGGTNGAYNGVSVGDIATGMQNFSSQTGLIGANSTVSELNALIKSGISLDRETLGLGSFIEKNICSGASSCFSGNQLIYKKGLDRTINIINTVLGQFESSASSLYKISYIPNLFSLKDYQSASMNGFGAKMGYKQFFTHKKNVGLRYYGFLDYGYANFGDTNLKVGANLVTYGVGTDFLYNVYERSRRRERTTIGLFFGAQIAGQTWSTNVTNLLSGQRPDVKSSSFQFLFDLGVRTNFAKTNFNKHRLDQGIEFGVKIPVIAHKYFATQGSSASYMRNFSFYVGYSVGF

SEQ ID NO: 14177 - protein, 728 aa, Burkholderia ambifaria
MTLRLAMGLTFPLALTLALPAQAETGQQQYNIAAGPLNTVLTRFATASGTLIAGDIQLAAGKQSQGLQGSYTPAQGLSQILAGTGLVAKAQPDGSFSLAKANNSVSTLEPVNVSATNGDNLQNILDYDYSDISRQQPQDTKDLFKNEASVSVGGSIPVNEKVYVRGVEETAMLVTVDGARQNNKVFHHNATNLIDPSLLKSASAAAGVASADDGPGALGGALKYETVDVADMLAPGDNLGGFLNGRYASNGDAVTTAGSLFGRSNGFEALGYVKQVEGNHYEDANGDNVPYTEPGLLSGLAKLAYENADIGRIELSHEVVNDDSERPYRANFSGLTAGRPVPASRNYDLTRQNTVLGYSRLKGSGLWNPEVTLANNETELVTSENPLAAPNTTVEYTGITESVSATAKNTFHTGFVDITAGMDYYDDSALFQYAGDPDLEEKAENTGAFVQFRQTLFQRLDLSYGLRYDQQDFTGTDDSNHEDEGTSSNVFAEFHFNEHFAINAGYADVWGGTALAENFILNGAWVYNDMKPVQSHNHTVGFKANWNGFFVEANQFETGLRDARVPTYGGGPDLFSDFDINGFDTTVGYRADLGRLAVTYADIESKMDDEFATSYDGNYFTVPLGEQVAISGELYWPNTQWALGLTTEIALENDDLESRGLGEKQDSYTVVDVYVNYTPIDALSLRLSVDNLNNEEYTERASYGQEFATVEPLLEPGRSINMDVRYNF

SEQ ID NO: 14178 - protein, 642 aa, Burkholderia ambifaria
MNLRHLLATSAATALLSPIAHAAGDTAPAQPPQPADGIDLPAITVTDTRHLPESFDQRYATTQVLTRADLDRLSPSEPSITQALAMLPGVTVSQTGGPGSSASVSIRGSSASQVAVFIDGIRIGSPTTGIAPWADLPTEAFERVEVISGPAAASFGANAMGGVVQLFTRRAAGQPNQTSVSFGGGSNKTFDTQLRTSGTVPSTGPLAALGGLTYSLGLHSYNTAGIDATRPVLPYHEDGRNPYHAQDLDARLGYARDNWSISTFALYHRSDLSYDNAGFANRELDHQLTTGIAFHLDITPDTQFDQSFGYANDRQFLYASDPSIRTDRIDSQRISSSTSLTHQAHGFHLFGLPLSGETKVAYDFTREQAFLPIDVPDGVPTRNDSAFSLHQSATLGSVTMFVAGRHEIIAGKTVNTGNAALSWAITPVYTARVSYGNAFRLPSFNDLYYPGYGNPNLNPERSDSVEAALEANTAYGTFSAAIYDTRVNNLIAYNPATFSPMNIGRAHIRGIDLSYKGTIGRTTPVSIAVGILNPQDETNGSWLNRRPRQTVSVNIDHTWDELHLHALSTGASLNYGGTTFDDPANATYLPSYLTVNLRASYKINAHLTVSATLSNLFDRQYVTAYGYNTLGRTAFGKVSYTF

SEQ ID NO: 14179 - protein, 699 aa, Burkholderia ambifaria
MRDIRPSQIGQYIRRALRLHFIPVVLVAAPSAMANTNQETEQLETLVVTASALKVETPAQETPKALSIVTQEDIVARAPQKLDEALRYTSGVTAQPYGADNDTDWLKVRGFDAATYQDGSRLFRDGYYTWLVEPYALERIEVLKGPASILYGEAPPGGVVNAVQKKPTDIPQGEVGLQVGNDALRTLTLDISDYANQEGSVRYRLVAMMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNGEPNKETLAQGIVFRDGSTESLSLDNKAVAKWDSARLENTLLMGLELQRHQTQGVELDNYSFGTINPFNPNYGNYTPIDESSAADRTITKEQASLYAQYQIKLDQQWIGLIGGRMDWVDTENESQKNMQRKSRSDAEFSFNAGLMYLASNGVSPYLSYSQSFDVLSTIDGATGELYKPLKGEQTEVGVKYQPEFYDGYINLAWFDITQQNALVTNPDTFVATQTGEMTAQGIEVESVGYVTDSLKLTASYTFTDAKTDETGGKGTQQAGLIPKHQASAWLDYDATKLGLQGWTFGSGVRYVGESKDNPRSSDRTVPSVTLVDLMAGYEITENWQAQLNINNLFDREFVSGCDYWCYYGQSRSAVLSANYRW

SEQ ID NO: 14180 - protein, 418 aa, Burkholderia ambifaria
MYSYKIGRRARLRAATPHGVRRHHRTVALPATAIAACIAGLIPCVAHAQSSVTLYGLIDTSITYATNQRTQGAGSPGSGSVALTSGALNASRWGLRGREDLGGGTAAVFSLENGFSGTTGKLSQKGVDMFGRQAWIGVSSRTAGTLTFGRQYDPILDFVTPLGASGPGWGGNLAVHPYDNDDSNRNLRINHAVKYTSATYRGLTFGALYGFSNTAGAFSNNAVWSAGLGYANGPLKLGAGYLKISRDRNAPNPDGALSTVDGSATITGGNQQIWAMAGRYAFGLHSVGAAWSHSATDGVSGVLQGGGITPLKGESLVFDNFTVDGRLFVTPAVSLSAAYTYTMGRFDTRTCQTRPKWNHVVTQAGYAFSPRTDAYLEAVYQSVSGGHGNPAFNATVWTMTPSASSNQLVVALGLRHKF

SEQ ID NO: 14181 - protein, 380 aa, Burkholderia ambifaria
MNKTLIAAASATALFAPLAHAQSSVTLYGLIDAGIAYTNNVNGGSQWRMTTGTINGSRFGLRGTEDLGGGLKALFVLENGFNANNGALGQDGKLFGRHAYVGLSRIGFGTLTLGRQYDTMVDFVAPLSATAGDFGDTGFAHPFDNDNLNHSVRINNAVKYTSDTIAGFKVGALYGFSNSTNFAGNRAYSVAASYTNGPLKLAGAYLQMNGTKGSTSASPGATDVAEAKSVSQGGWSVGADRMRTYGGGVSYGFGPATVGFVYTRSQYDNSGSFGSTGQVAFNNYDVNVRYAVTPAVSLGAAYVYTDASVSNPDSKHGTDPKWHQVDLQAVYKLSRRTDLYAEAMYQHASGRGYQAFINTSGGASSTANQIVGTIGMRTRF

SEQ ID NO: 14182 - protein, 398 aa, Burkholderia ambifaria
MKKRVAFAMTAAGLAAATAAHAQSSVTLYGIVDNAIAWQNNSSGTGATSGGHSKVQMATGIWAGSRFGLKGSEDLGGGTKAIFQLEAGFNANNGSSQWANGIFTRQAWVGLTNQTYGTLTAGRQYTAYYTLLSPYSPTTWLTGYYGAHPGDIDSLDTSYRANNSLVYMSPKFYGFTVGGSYSLGGVAGSFNRGSTWSAAIQYLNGPAGIAVGFQKVNNSTLGGGVWGDNSTVTSGGQPAVSSINSGYQTAQTQQRLGVTAGYQFTPAWDVSVSYTNVQYVPGVGSAFRNTAIFNTAGAVLHWKAAPQWDFAAGYSYTAATQSNGISSSAKYHQVTLSQYYSLSKRTGLYAVEAYQHASGNTLNKTGGIQAATTSIGDGVGAGSKQNQIAAGVGMIHRF

SEQ ID NO: 14183 - protein, 363 aa, Burkholderia ambifaria
MKSRAERSIRTAIVTGSAAVAGLAAGAAHAQSSVTMYGIMDAGIEYTNHAAPDGGNSFKLKSGNKNTSRWGLRGTEDLGGGLKAVFRLESGIDLANGASDDGPDSIFARRATVGLKGKWGEVSLGRNFTVTYDYMLPFDPMGYAQNYSWATSSMATGGRKDGLFTRSSNAVRYDGEFGGFKFGALYGFGNVPGSVKTSSKYDFALGYETGPFAAVVTFDRQNGAADSVTPADTVNYIQGIHAGLSYDFGNLKTMAGYRNYRRTYHTSAANQLSDMYWVGGSYQFTPTFSLVAAVYHQNIKGGSDADPTLVSLRAQYALSKRTVLYAAGAFAIAQHGQKVGVSRDFAGYGTTQVGVTAGIQQRF

SEQ ID NO: 14184 - protein, 395 aa, Burkholderia ambifaria
MNAPHHRFAILILSAVGFGACAAHAQSSVTLYGVVDDSIAYVNNQQGHSNVYMRDGNLYASKFGLRGDEDLGGGTHAIFDLQSGFNLNTGAQAAAGTIFNRQAFVGLRNDHYGTVTAGRQYTPYFLLVGPYASSSWLTGATGAHPGDIDGLDTTIRVNNSVTYTLPTLSGLTASAMYAFGGIAGATGKGNTFSAALRYANGPVGIAAGYLRINSSGSSADFLNPATAASGSFAVSVLNQGYLSAKAVEQVAAAGNYTLGNLTMGVNYSNVKYLPGNGSAFTDTAVFNTYGALAAYRFTPTFSVAGAFAYTLASKANGVSGAARYQQYSLKESYSLSKRTTLYALQAYTHSSGQTLGAQGAGHIVDAAPIVGDSQQLTPSTTHGQFVGMAGIAVTF

SEQ ID NO: 14185 - protein, 385 aa, Burkholderia ambifaria
MKKLALSTLSLALLGAAGAAHAQSSVTLYGVIDTSIAWVHGNNGQANNSWQMLSGNLQGSRWGLKGAEDLGGGLKAIFQLENGFDPGTGHLNQGGRMFGRQAFVGLQSDQYGTLTLGRQYDPLVDLVQAVTADNYFGSVMATPGDVDNNDNSLRVSNAIKYTSPVWAGFQVEGMYALGGVAGKTGSGQTWSVAAAYNNGPVGVAAGYFYAANPSPTTTPGRPGWGSTTSDAIFDGPINLGYQTAKSIAIAQVAGQYALGPVTFGLGYSNAQYKPDAFSGFGSTEKYNTGRAFVTYQVTPPLLLGLGYSYTKASGDTSAKYHQVGVGADYSLSKRTDIYLVGAYQHASGTQLVDGVQQSAQASIASYGFAGKSSAELVALGIRHKF

SEQ ID NO: 14186 - protein, 661 aa, Burkholderia ambifaria
MTIPRVKLLAVAIGAATLSPLVHAADQDTVVVTATGFEQKIQNAPASISVISKQQLEDKAYRDVTDALKDVPGVVVTGGGSSSDISIRGMASQYTLFLVNGKRVSTRSTRPNSDNSGIEQGWLPPLESIERIEVIRGPMSSLYGSDAMGGVINVITKKVSNTKAWTGSLHGDATFQENNDSGDIFQTNAYASGPLIDGLLGAKVTGLLSRRAEDKIVNGYNEQKMRNGGITLNFTPDEKNDFDLDFARELQDRNSTPGMSKATENCRGNTCTPNTKSETRYEHTTYSLTHSGYYNDFNTTSYIQQEETNNPDREMRSWNTTFNNQNQIFLDDHTLTLGGQYRYEKLRDNGNQLDAADGLNKLTRWSWALFAEDEWSMTESFTLTGGLRMDKDQNYGTNWTPRGYGVWHLADQWTLKGGVSAGYRAPDLRQSSANWGQVTGGGRLDGIIVGNPDLKPEKSLSEEIALLWDNNDNLNAGVTLFNTDYKDKITEVRRCSSSADPACTIGDHSYDFVSDRVNVDKANIRGVESTFGWKISRDVNWTANYTYTESEQKSGQFSGKPLNKMPKHMFNTTLDWQATPDVGFWSRLNLRGKTSEYLSRASMSQGTPSYTQVDVGLRYNANKNLLVTAGVYNVLDKQIDYDTYDTVLDGRRYTVGMTYSF

SEQ ID NO: 14187 - protein, 382 aa, Burkholderia ambifaria [sequence omitted]

SEQ ID NO: 14188 - protein, 358 aa, Burkholderia ambifaria
MKAFARRASRTSVKLIAAAACVAATAPVHAQSSVSLYGQVDEWVGATKFPGGDRAWNVSGGGMSTSYWGLHGAEDLGNGYKAIFTLESFFRAQNGQFGRFQGDTFFARNAYVGIDSPYGTVTAGRLTTHLFLSTILFNPFYDSYTFSPMVYHVFLGLGTFPTYPSDQGAVGDSGWNNALSYTSPSFGGLNFGAMYALGNQAGDNGSKKWSAQFNYANGPFAATAVYQYVNFNNGPRDLSALVAGMKSQGIAQVGATYDLKYVKLFGQYMYTKNDQVAGSWHVNTAQGGVSVPLGVGNAMASYAYSRDSGGLDQTRQTWAVGYDYPLSKRTDVYAAYMNDHISGLSTGNTFGAGIRAKF

SEQ ID NO: 14189 - protein, 749 aa, Burkholderia ambifaria
MSRAVVLSPRPLALAVAALLAGSALTAHAEADATDIDTVHVTASQIARQALGTSTITAEDIARRPPANDIAELLRTMPGVNLTGNSASGQYGNNRQIDLRGMGPENTLILVDGKRIGARDAVRMGRSGERNTRGDTNWVPAEMIERIEVLRGPAAARYGSGASGGVVNIITKRPTGDLTGAVDLYGLVPEHSAEGGSERVGLQLSGPMTDTLSFRLYGNLNKTDADSLALNRDFATNPNAVPPAGREGVKNRDVNALLRWDVTANQVVEFEAGTSRQGNIYAGDRAVSTTGTSTPIDLGALAEQRAETNRMYRTTGAITHRGRWGDVTSRVTAAVEAVNNSRINEGLAGGPEGSFNGTDWSTSRLRNYQLDGEVSFPTTLGGAENIWTLGFEYLDSRLTDPYSMSQSSSSGGGFPGLSADRARGKADAQTTAVFVEDNIYLGERWIITPGLRFDHHSQFGNNTSPSLNAQFRINSDWVVKGGIARAFKAPNLYQSNPDYLYYTRGNGCPNALPSLGAGCYMRGNADLKAETSLNKELGVEWAPQSGWQASLTYFHNDYKDKIQAGYNQIGLTADTKGRIFRWENAPKAIVQGLEGNLVIPLLGEQGNRLKWSNNFTYMVENENKSTGQPLSVIPKYTVNTMLDWQATDKLSLLLTGTFYGKQKPATTNINNDPRCTGTCDPSIALQDRGAYNIWGVSARYKVTETVSFGFGVNNLADKRLFREANSSDAGAATYNEPGRAYWASLRFGF

SEQ ID NO: 14190 - protein, 145 aa, Burkholderia ambifaria
DRHGIDKADLAVVWDPGWNWWEIGGWHFAFVMEGHAGYWHTGGNVHANIGEFGATPMFRFIKSAGQVRPFIEAGAGIRFLTHPTISNDLSLSTSFQFADVVGVGAQFGERQQYQLGYRFQHVSNAGIKEPNPGINFHQFYVQYNF

SEQ ID NO: 14191 - protein, 400 aa, Burkholderia ambifaria
MKKKLLAGAGVALIAGAAHAQSSVTLYGIIDEGLTYASNIATPGPHGAVSGKPALRMLGGVQQASRWGLRGSEDLGGGLAAVFTLENGFDPSSGRLGQGGLMFGKKAFVGLSGPFGTVTLGRQYDSNVDILGPLEAAALFGGYMVAHPGDLDNVNNANSTNNAIKFTSKDYGGARVAAMYGVGGIAGAATRNQVWSATVGYTRGPLAVAAGYLNARNPNVSFFGTTGSPAPTVGGVPGSNMLSPVYSGYASARTLQVAVVGGTYAIGAMTLGAMYTNTSFRQLGDLSSGPNPGGVSGNAVFNNVEASVRYQFMTSLFGGVAYDYTHGGGVNGRDGATYHQVAAGLDYFLSKRTDVYVSAVYQRASGTDSTGHVAVAAINGPGASANDRQLQARVGMRHKF

SEQ ID NO: 14192 - protein, 359 aa, Burkholderia ambifaria
MMKKALVAAALMAAGVVTAHAQSSVTLYGRLDAGIEYMNGLQNGHQVRAESGDWGTSLWGLKGTEDIGGGNKVLFHLEGAFNTMTGGFSGSIWDRYATVGISNDRYGTLLLGRELAIANGVWDFDPFGQSAWSTASLVRGRNWNKTSNNVSYQSPQFYGLDFYGQFSFSNSTSFNGNTTAGQPGRAAGAQVTYTNSLFQLRGIYDETRDSNGRFSDVFNYSREYFAGVNVFLGQFKVQAAYQASRADGSGGPAVNAGVTGTQQVWGGVTWQATPAAALIAAVYHVNANHGGGNANIYTVGGSYNISKRTLFDLQVATVRNSKNANFGLNANGAGTAVSTGNPNPGGSQTGVYAGIQHLF

SEQ ID NO: 14193 - protein, 295 aa, Burkholderia ambifaria
MTLRCLLNPWRFSERILTDRENGEKGDNSQDTSYARVGVKGETQINPEMTGYGQFELDLEASNRHNPDQTRLAYAGLSYKDFGSFDYSRNVGVAYDAEAFTDMFVEWGGDSWAGTDLFMTNRTNGVATYRNTDFFGMVEGLNFALQYQGKNEGTGNYKANGDGHGLSATYTIDGFSFAGAYANSDRTDWQSGDGKGERAEVWALSTKYDANNVYAAVMYGESHNMNSDDGDVVNKTQNFEAVLQYQFDFGLRPSIGYSYSKALDVAGWICPYISRHLLSLNPLQARCRRYSRGER

SEQ ID NO: 14194 - protein, 656 aa, Burkholderia ambifaria
MSSPVSSALRRTLALSCAASALLVSIPARSQQVAAPFADAQGGAQAAVSLSEISVSATGVLTPIANTGSSVTVLTDRLLQEQQRRTVPDALQQVPGLNVVQTGGAGGQTSVFIRGTNSNHVKVQIDGIDVNDPSTPNRSFDFSQLQTYDLSRIEVLRGPQSGLYGADAIGGVISVVTKRGEGPARATATVEGGSFGTFNQFGNISGSEGIFDYSVSVGHIRQSAVQVTPFELLPRGVPLRTAFTDIKTVSTKLGAQLTDEFRLNYVLRFSDSAYLDQADGGFPYVPLPYRNLNDQQQLIMRGEAEWTPVPGFHNVFGANYSKFDRLFAGPLDPLAPPTPTTYLGERTRFDYRGDWQFSPGNLVLFGAQREDERFETTGIDRSNGNTAGFAELQTTPFAGAALVANIRHDANDQFGGATTFRVAPSYIVPGTGTRLKGSVGTGFKPPTLSQLYQDYPGFRFFGNPNLRPEESFGFDGGFEQPLFDGFMTVGATYYQTDFKNLIQTAYYPTFSTNVNVGQATAYGTESFVALRFNEFWSGRLDWTTTVTKDEIAHQELLRRPRNKVSATAIWNLMPGLTMTGSLIVLGSFVDGNRDFSVPRLKAPGFTLVNLSVNYAWSETLTVFGRIDNLFDQRYQNPTGFQGPGLAVYGGVRVTSF

SEQ ID NO: 14195 - protein, 221 aa, Burkholderia ambifaria
MHSSGVRTMHKTIRTCVTAAAIAASLAALPSLSHAALPGDGINQGDVLVRLRAISIQPNERASDTLGAINTGVNNAIVPELDFTYMIRDYLGVELILGTSRHQMTSSLGNLGGVGVLPPTLLLQYHFNHAGKVRPYVGAGLNYTYFYNNGLNVGGEGVSINKSSFGPALQFGVDVQITKKVFMNVDVKKIWMSTDATLGDKGIGTLHIDPLIVGVGVGMKF

SEQ ID NO: 14196 - protein, 374 aa, Burkholderia ambifaria
MKTKLAALAALAGCSALAHAQSSVTLYGVVDTGLLYQSTSAASFSPSAPNTGKVFRMKDGGIYSSFWGIKGSEDLGGGYKVNFKLQGSFDSGTGRLQLSDTPGAVAIFNQIASLGVSGPFGTVTAGRQIVPMIYAMADTDVRNAQFFGSVLTAWLGLNTAAGWPATSTNGAIGALYDSNALVYQSPTFAGVSLALEYAPGGVAGQFQGGTRESVVLRYSNYGLNASAVYYNGHDTNPAPGVAPTGVDNNRFVYVGAKYTVRDFSVSASYGNGRNPAHADRVNLDMLSAGVGYRFTPALQVASAVYYLKDRNRSANRSTAVVLTADYSLSKRTMVYAQAGHVNNRGTMDQMLVYGQPVAPGVGTTAAMVGLRHNF

SEQ ID NO: 14197 - protein, 753 aa, Burkholderia ambifaria
MEWATGTRLRAIAAAASVTFGMAAGHAFAQTAPAVNAGAAASADSARNGTAAGSTGSSTSTPNGPATGTLPAINVNAGSEGDGTVGLVAKRSRTGTKTDTSINEIPQTINVVTAQQIEMTGATDVNAALRYVPGFSSYGSDNRSDWYAALRGFTPTAYVNGLQVPNTLNLSSWRVDPYMIDSITVLRGPTSVLYGAGDPGAIIDVQTKTADGERVREAGVQFGNYARKQFMIDVGDKLDADGKYAYRFVGVARDGNALTGPNNDQRVALAPTFRWRPDADTSLTLSATYLQDWGDISSNFLPAQGTVLPNPNGQIDKDVYGGDPNFNYYRKKQWSLGYQFERNLNSMWTFRQNVRWMHLSLDNGSVFGAGLADGSLTDINRWAGVFQTNYSRFDIDNNLQGRFGTGPLEHTLLLGFQYNRQTATDSEWLAAAPTLNIYNPVYTPVTLSVFSPPNTTYRTNTYTTMNTFGLYVQDQVKWNRWTLTLGGREDWVNQRLDDREGGTQSKADITAFTGRVGLTYQGDYGLSPYISYATSFNPVIGVNLYGGGLPQSTRGKQIEAGLRWQPPGKNLMLNAAIYQINQTNVLTPTPLNLDPSGTTSIQTGEVRSRGIELSATGKLTRNLSLIASYVYQDVKNVKANDASLNNWPVDIPRPRQMASLWADWTWHTGPLTGFGLGGGVRYQSASAGAADNSLTVSSYTLFDAGVHYDTRNWRFAVNGTNLFNRHYISGCQSTSVCIFGTDRTVIATAKYNW

SEQ ID NO: 14198 - protein, 386 aa, Burkholderia ambifaria
MKRTTLSLISLASFAAIPAAHAQSSVALYGVIDTSITYVNHAQGKDNAWMLGNSSAGNLSGSRWGVKGTEDLGGGLKALFQLENGFDPSNGRQGQGGRLFGRQAFVGLTSERYGTLTFGRQYDPLVDLVQGITADNYLGSVFATPGDVDNYDNSFRVDNAVKYTSAVYSGLQFSAMYSFGGIAGSTGAAQSYSAAVSYNNGPFSVAGGYFHATNGPASNGLRNGWTSSSDGTFDGPINSGYASAHSIGIARIAGQYVAGPFTFGLGYSNAQYRRDASSAFDSNEHYNTGQGFVNYQATDALLVGVGYSYTRSGGDTSATYHQVSAGADYSLSKRTDVYLSAAYQHASGQTGDGKGGSMAAQASIASYGYAGTSSQTMVNLGLRHRF

SEQ ID NO: 14199 - protein, 362 aa, Burkholderia ambifaria
MKTFRTAATAVLFAAAAASPGAHAQGSVTLYGIVDTGVQYYNNAAGGGTVTGMPSLTGEVPSRFGLRGVEDLGGGYRAFFVLENGFAPNSGALNYGGRLFGRQANVGIESPYGALTLGRQMNMSMRVLLDADVIGPSIHSMASFDSYLPNARSDNALGYLGRFGGVTLGGTYSTGRDDAGPAGPSATHCAGNVAGDPVACRQYTMMVAYDAAQFGAAASYDVMHGGAGASAPLSSPGYTDTRTIVDAYVKFGIAKLGAGWIRRNTAAAAHSQSDIFFAGGTVQATPALSFDAQAVRYLLRGRFDSNLFVARANCSLSKRTMVYTSVGYMTNSALGTSAVAAGGTVGAGQNQVGVMAGIQQRF

SEQ ID NO: 14200 - protein, 784 aa, Burkholderia ambifaria
MSFTFAARPSRGRLALACAAAFAWPAAQAAAIDGASAEPVPGGSGNPAGRAASVAAVVPAPPGDTLTEVSVTARRQPVDPDTPAVVESITREQIDAHTNVTTEDALKYAPNLMVRKRYIGDRNSVFAGRDFNELQSARGLVYADGLLLSNLLGSSYAYPPRWSLIAPDDIERVDVLYGPFSALYPGNAIGSTVLLTTRRPDKLEASLSTQFFTQRYHDGYGLADSFGGNHQTARIANRIGKFWFSLSLDRLENDGQPMQYASPNSAYNPKLGAAVPVTGAATDVGPNGKPRTIVGAQNIERTEQLNETVRMGYAFTDRVDATLTLGHWENHYRQHGETFLRDAAGNPVNGGNVSIGGRNMTVAPSAFAPQRGDQENWLYALGLNGRLDSGWRLSGVVSAYDVSRDVLRAASTAQGGAGTLFQGDGTGWRTLDLKAEAPEVKGHTFTFGYHYDNYFLRNVTYNTADWLAGPTTSLASVYQGDTRTQALFAQDAWRFAPGWLATLGLRYERWDAYGGALGNAGGTVGYADRGANALSPKVALQWDATDVWRFRVSFATGTRFPTVGELFQGTISNNAIVNNNPSLRPEKAIDWDFTAERDVGVGVVRASVFQSDLRDSIYSQTTVSGASTVTNISNVDRVRVRGVELGFSGRNVGLRGLDIDANVSASNAQILADTANPAYVGSRFPRIPRMRANLLASYRFDEHWLASVGVRYSGRQFNTLDNSDVNPDVYGGTSSFTVVDLKARYRFDRHWTASVGIDNLTDRRDYVFHPYPGRTFFGELKWSL

SEQ ID NO: 14201 - protein, 380 aa, Burkholderia ambifaria
MKKTLIVAALAGVAASAAHAQSSVTLYGLIDAGITYTNNQHGHSAWQETSGSINGSRWGLRGTEDLGGGLKAIFTLENGFGINNGSLKQNGREFGRQAFVGLAHESYGSLTLGRQYDSVVDYLGPLSLTGTQYGGTQFAHPFDNDNLNNSFRINNSVKYQSANYGGLKFGGLYGFSNSTGFANNRAYSVGASYSYMGFNVAAAYMQLNNNINALALAASDPGAVAGDWTFAASRQRTWGAGLNYTFGPATAGFVFTQTRLTNSAGISAGQSGVSTGIPLAGGTRFNNYEVNGRYALTPAFSLAGSYTYTDSRLDGQTPSWHQFNLQADYALSKRTDLYLQSEYQRVNANGLAIGANINGLGAASSTNKQIAVTAGMRHRF

SEQ ID NO: 14202 - protein, 552 aa, Burkholderia ambifaria
MRFHAQMRRARLPDALPEFVVRHAKASALVRAMEITRRLLGAACRIVLHCLLLTITLSVDRAEAAVRAETLLLRPVADADPLLLRRFKAIDPRESLARAVRFAPAAAKPLPLPGAMLEGTGCLALMRVPPNDATRIWRALVRCHVKSRPIGPKRPVAPVMPKLEEVAEAPKPEEKAEEDDPFEPKGIKVGAFVIKPALELTVGVDSNPLRMPRGGRPAQTRSVVHELEIRSQFERHELNADLSVGYSQTQGVPVLNAPAVDAKIDGRYDITDDRSINGEVRYALDPVDRVLEAPRGTFVSKSGATVGVSQKLDNVSVSVKGLVDRSTFSGARPGDDAPIPNKDRNFTQPAVQTRVSYALSPQISPFVDVTLDRRVHDIPVDFGGVRRDSNGTVVSAGLSLAFAGRLAGEIAVGYLTRRFADPMLPGISGMIVNGALVYRPFDRTSFVLVGTSDTLESVIPGVSGIFRRDLILQARQEFDPRTSASLSFGFGQDRFAGIVRTDDRYSVALGAVYKLSREVQLKADVRQDWLRSTIPTVNNMATTATVGIRFQY

SEQ ID NO: 14203 - protein, 385 aa, Burkholderia ambifaria
MKKSLLALVALGAFAGAAHAQSSVTLYGIIDEGFIFNNNAKGGHLYGLSSGVMQGSRFGLRGTEDLGGGLKAIFVLENGFDVNSGRLGQGGLMFGRQAYVGLSSQFGTVTLGRQYDSVVDFVGPLEAGDQWGGYIAAHPGDLDNFNNAYRVNNAVKYTSPTYGGFSFGGMYSFGGQAGQFSRNQVWSLGAGYNNGPLVLGVGYLNARTPANFGGMFNTGASAATTAVSSPVYGAYANSANTYQVIGAGGAYTFGAATIGATYSNTKFKGFSVGPFVNQTATFNNGEINFKYQLTPALIVGAAYDYTQGSKIDGNSAAKYHQGSLGVDYFLSKRTDVYVIGVYQHASGNALDAAGNVVQAHASINGLDPSTTSNQVAARVGIRHKF

SEQ ID NO: 14204 - protein, 277 aa, Burkholderia ambifaria
MKKTLLCAAAGAAALAPLAAHAQSAGSNVVTLGWFHIMPQQSSTPMTTNVAPTPINTPLRLPPSFTSPGTGLHTSGADTVGLTVSHFLTDHIAVTSVAGVPPVFKVSGQGTIRPPGPAGALGTQNIGLGSVNPIVKSVRQWSPAVILQYYFAQANAKFRPFLGLGVSYNWFSDLQLNTNFIKQTQDNLGAILAAGAGKPGTTSVEAKASSSWQPVFNAGMQYNITEHFGLVASVTYIPLKTTSTVTIKAADGTVLSESKSDLKADPIISYVGMTYKF

SEQ ID NO: 14205 - protein, 1173 aa, Burkholderia ambifaria
MLCVGFFNTVSAQQKMSLKQALQEIQKAYGTKFSYQAELIDGLQATLTLPLSKSQPVERALKQVLYPNKLLFLYVQDNYYTLITDNREQEVNTDAARSNIPEPNYRTITGKVTDAIGMPLVSATVFPEGMGNRNGSVTSSDGSFTLRLQQEATALVVTYVGMQPKKIPLGKTNVINVTMDDNLNLLKEVSVVSMGYTKLPKERATGAFGSITSKEIREVPSINILERIENLTPGVQVDLKQNTIRVRGVNSFSTATASPLIVVDGFPVMETTDRAGNLSDVVSNVSGGAILNRYNPEDIESITILKDAAATSIWGARAGNGVIVIETKRGKNGPTAVNFSTNLSISSPADLNKLNTMTSAQYIDLEREVKELGFLTDPAIKQDWQTFNSNAPLGEALEWMFKVDRGTATVAEGDEALARLSQIDNKSQIRDLMMQKAVTQQYNLSLSGGANKSSYYISGNYTRDLPVFRENLGQSFFLTSNLTNKLFNDRLTLNIGINYTYSNSVNNPTAANTISTGVLGLRPYELLRDENGNNIERSIRFRDEVSQDFLDKGYLPWTYSALDDLYAVDNQTSANRFRFNMDATTKLGEGLTFSVLGSLQRNLEVTEDISSVDSYYVRDMVNYGTTINTAGKRVYGVPMGGTLRLANYDGWEYNLRGQLNVDKQLASFVKLNLIGGAEIRQTRYQSSNQVRYGFNPDTYSNLIVNPTANYTNVEGWSSQIGYNDNLAKNINRALSYYSNAGLSFLNDKYVVSGSLRFDDYTLTGAARNQRAKPLWSAGVKWNAKMENFMQNVNWLDALSFRMTYGVAGTMPKSAANVVVINTSTDNNTNEQIASIASPANNQISWEKVKTFNLGTDFAVLHGRLSFNVDIYQKRMSDILYRLPFNPTYGWTSLEFNSASMKGNGFELGMRMDVIKNKAYGWSSLFNFSYNTNEVTDNRIVKNTTTNLVNGSFAVGLPLDYMYAYRWAGLDDKGQSQVYNKNGEIISSAVGNNMLSADDLVYQGRTTAPYFGAFNNDFRYKQFNLGVRISYSMGNVLRRSSVQNYPDYVGYRGVIGSQKDLAERWRQPGDEDFTNVPGLKNVSYNSLQRYTYSDLLTISGSYIRLQQISLSYNAPAALLKGSPFKSASFSASARNLGLIWTKNKDGIDPAYLYTNNYNNLPPAKAFFISINTSF

SEQ ID NO: 14206 - protein, 393 aa, Francisella tularensis
MMRLKSIVIATTVLLGSATASIAAGSDNIDTLANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTINGDDVTVYLDTKFAYDKATLNAKGKKAIASFVNFIKDSNISSVTVKGYASQGQTGSEFDIYNQKLSEKRAQAVADYMKQLGLDSEKIITKGFGYNDTLGGIHKSDPRNQRVEASVSAPLKEAN

SEQ ID NO: 14207 - protein, 690 aa, Granulibacter bethesdensis
MMVFYRKYLTVTFLISLPCLAWSQSHNNSKDELDTITVVAQKINQQQQKTPISISVLTGFDLERENIENIYESIMRIPNVYMVKAGNPSDAGFFTMRGTTPGMEGIQSVGFFIDGVYANTFDTELLDVDRIEVLRGPQATLYGRNTESGVINVITKNPEFSPEYKIGLSYGNYNRTQVTTVLGGSINDSEQFSYRAALKYLYGNGYFKRDYDGKNNVDNLNDFSGRFKLRWQSMDDGWDVMTTFDIQNRRNGNTSFTALDKIKSGQKYVDSNYIGKSDVDAYKGQVNAVYTFDDIDFTSVSAYVDERKVDNQDLDFTRLSISELLMNRKTKQFSQEFRLNSKYSGPFNWLIGSYYFYQDDENEIDFRYLPYNLAQIRKSDIKTNNYAVFGNVNYYLLNDVELVAGARYDYEKKKLNFLMDNGFNPYQPYSHDNNSNSFGAFLPKVGLNYYITGDAMLYTSIARGYKSGGFNTLGPQSSRAYNAEYMTTYEAGVKTEWFDRTVRWNTSLFWNDMKDQQVEVAYYPISYSVNSGKSLSRGLESEFEWRITRGLTAFANVGYTDAYFKNFPTEIKVDNNYIPVNYKDNRPANSPRYTYSIGADYNFLNGYFVNATYNVKGSTYLDNANSKKQPAYGLLDLTAGYENKDYGVNLWIKNILDETYVTRAFKMDDGVWYGRAGEPINFGVNFNVKF

SEQ ID NO: 14208 - protein, 490 aa, Granulibacter bethesdensis
MKRLNSMKIMIVGALAASLAFGPAYAQEEQPKKLEKMVVSAAKMETSVDKTPTNITVFTREEIEQMPKTTTINELLRQVPGLYIPQYQSGVANDGVYSARGAEPSTTGLRFLVNGIEFNKGNGYTVPTRIPINDIERIEVIKTASAEYGDQAIGGLINVVTRVSNKPLEAKAGVSVGDFNYENYYTVINGTRNKWEYFVDMSFSNSEGYQDEAYYDPENFYTRLAYNIDETSVCEFHGSHMASKGAWPKSLTQAQLDEDPTQSPGGSNEFENDYNLAALAYKKKFGDDELQVKVIGKDEWVWMDYGLDFEFDEWEIFPSVTYNLRHSIGSMKNSILFGVEGRKHELTTQLWTRKNNAKFKKTKHTLREDTSFALYIVDQCSITEDLTVTFGGRYDSFEQEQTGRVNPANSVDQSDEAFSPKIGATYTINQYANLFAGFNSGFKSPARVPGAAYSADLDPERTLSYEAGVRGFFIACLSYTFLWFSEPVQG

SEQ ID NO: 14209 - protein, 867 aa, Granulibacter bethesdensis
MRKRILQLFLTTLLLALGSSLAIAQIVVTGKVIDSETSEPLIGVSVSTGQGASLRGVTTDMDGGFRFEVPAKSVLTFRCVGYATVTRSIGRGSQEDLGTILLDPQAIGLDEIQVIASVVPKDRMTPVPVSNIRVADIQAASLNVEFPELVKSTPSTYTTKGSGGFGDGRTNVRGFDTYNFGVLINGVPVNGMEDGKVYWSNWSGLMNQASTIQIQRGLGASKLGISSVGGTMNIITKTTDANTGGSAYVGMGNDGLHKESFSISTGMNDGWAITIAGSHMTGLGYVKGLKGRAFSYFFNVSKKFNERHTLSLTGFGAPQWHNQRSSKYSVADYDKYGIRHNQSFGYLRGELTPTAYAYNTYHKPQFSLNHFWKMDENTSLYTAAYASLATGGGRRAYGKNSKWVLINYNTGQPYEQTKVTPDGLIDYDAVLAANAAASNGSEAIFALGSNSHKWFGLLSSFKKKLNSSLTLTAGYDGRYYRGDHYDKITDLLGGSYYIEDPKTKLAYHTEGQQLKVGDIVNRDYTGEIMWQGLFAQMEHSSEWIDAFVSGSINYELYRNHNYGGSKSTGYLPGVSPWKSFLPWSGKAGLSYKFAQGHNVFANGGFFTRAPLFGNVYAAGAIIPNDKANMEKVLTGEVGYGFTNHKNFEFNINGYYTKWMDRVTSKRIGNEYVYLNGVDAVHCGVEAEISYRPIRQIDLRGMFSLGDWTWQNNVSYTSYDEAGNETGQDITYIKGLHVGDAAQMTAAVSADIELFKGFHVIGKYNFLGKNYAGFNPATRNAQQYEADGKEIVESWKLPDVGLFDLSASYNFKLGSLSTTFYFNMDNVADKRYVSDADDNIIGKKHDEASALVWYGFGRTWSTGIRVNF

SEQ ID NO: 14210 - protein, 392 aa, Granulibacter bethesdensis
MSSLARRNVGLALSATALAAATSAFATDGTYFTGNGASSSGMGGAAIAFPQDVASAVDNPAGLAELGSRVDFYMVALPVSANSTFGSPDNHLFSRKIVVSPGFGFNYQIAPQWTFGVAMTGAGAASNYGRPVLPVPGAGNAKASLVIVNTSPTITYKPRSDLSIGASLVVGVEQLRLNGLVAPGADGALQPVPSHGNANALGIGAGVGVLWTPVPMVSVGASYFTKTWFTPLSGYKDDVLASSGGHIDSPARYGAGVAIRPLPGLTLAMDYLRIQWSGAAGYNSTNSWGYRSQNVGRIGVSYEINPKWTVRAGYSFANNNVDSDHTIANMYGPGISSRAVTLGATYAIDKNNLVTAAFEYDIPTTIIGTGPSQGTNIRASYQGYTIGYTHKF

SEQ ID NO: 14211 - protein, 286 aa, Granulibacter bethesdensis
MCIKKHGIALSILLIPCIGNAQEIKSEEGWLHQSLNVIGRTDSRFGPRLTNDLYPEYTVAGRKDWFDFYGYVDLPKFFGVGSHYDVGIWDEGSPLFTEIEPRFSIDKLTGLNLAFGPFKEWFIANNYVYDMGDNQSSRQSTWYMGLGTDIDTGLPIKLSANIYAKYQWQNYGAANENEWDGYRFKIKYSIPLTHLFGGRLVYNSFTNFDFGSDLADKSHNNKRTSNAIASSHILSLLYEHWKFAFTLRYFHNGGQWNAGEKVNFGDGPFELKNTGWGTYTTIGYQF

SEQ ID NO: 14212 - protein, 427 aa, Granulibacter bethesdensis
MCLLRQMERNLVLTRSTKRQNKQWHLIPDRTGQQLRRNIIVKRNLLAVVIPALLVAGAANAAEIYNKDGNKLDLYGKVDGLHYFSSDSSKDGDQSYVRFGFKGETQINDQLTGYGQWEAQANVNQPESNSSNFFTRLGFAGLKYGNYGSIDYGRNYGVLYDIEGWTDVLPEFGGDTSAQTDNYMAQRANNLATYRNDGFFGLVDGLDFALQYQGKNDGHAYGKDADGSYSWDGAPLSNNAREIQGQNGDGFGMSTTYDLGWGISAGAAYTTSNRTTEQKWSGNQANSNVAGGNKAQSWGAGLKYDANNIYLATMYTETQNMTPFGSTGIANKAKNFEAVAQYQFDFGLRPSIAYLQSKASELNSYNGFNGGKADLVKYVDLGATYYFNKNMSTYVDYKINLLDENDFTRANSINTDDIVALGLVYQF

SEQ ID NO: 14213 - protein, 670 aa, Granulibacter bethesdensis
MARRTKVRIVCAIGFLCAVSLSAQEVVRDTITGKVHQIEKVTVTARRLPNKVTSSVPIQTLSQQDISQLGIQNMADAVRRFAGANVKDYGGIGGLKTVSVRNMGAAHTAVSYDGVVVSNCQAGQIDIGRFSLDNVSVLSLNIGQPEDLLQSARMYASAGVLSIETEKPHFENERNSAFRVQMRGGSFGYVSPSIRWWQKAGSRTSFSLNGNYMRADGNYPFTLVNGKYVTEEKRNNSAIYTYQIEPTLFHTFKDSSNLELKAYYFYSKRGLPGSVTLYNPISDETLWDENVFIQTRYKKDFSQKWSLQAQAKYNHGWNKYEDKGNEYADGLYRAVHRQDEYYLSVTALYRPWNVLSLSLAQDGIINKLRSNLPDCPFPIRYTSLTAFNARYRQGRITATGSLVYTNVTEHVKIGDAPADFQRLAPSFTVSLQPWQEQLLFLRLMYKSTFRMPTFNDLYYYRLGNRSLRPEKANEYNMGITWSRSFSSFLNYLSVTVDGYYNDVTDKIVAFPTTYAWKMANYGKVHVTGMDATLAAAASLGKNMVLVVSGGYTWQKAIDLTDATSKSYKDQLPYTPKHSGNVSAVLEMPWVNVGYSIVGVSERYSMSQNIPENRIDGYMEHTVSLSRNFSFRHCKLRLQAEIINLTDTQYDVIKYYPMPGRSWRLTGTIEF

SEQ ID NO: 14214 - protein, 420 aa, Granulibacter bethesdensis
MIRATHGPGRALLATLALWPALSHAEAPGWSLLSRNYFLHSDFRSPSGSGQNYRQEWAQGFIGEVRSGFTEGTVGVGIDAHGFLGLKLDGGRGHSGTGLLPRDSDGRAESEYSSAGAALKMQLGNTQLRYGEMMVETPVFDTGDKRLHPEYATGWWVENTDQPDWRLQAGRFTAFNNQDNSSTHDDFSGYGATTHNRAISLAGATFAPNGPFGAALYAGQLENTWRQAYLNLNVAEGNWRLDGNLYKTRDTGNASAGAIDTLAYSLLARYSFGAQALSLAYQKVEGDTPFDFVGGDAIYLANAIKYADFNGPGEHSWQLRYDLNFATLGAPGLSLMGRYVSGRGIDGSHAPAGGAYVNQYGDGGKHWERDIDLKYVVQSGAAKDLSLSFSHVSHRANQAQAGNDIDRIYLIIEYPLKGSF

SEQ ID NO: 14215 - protein, 492 aa, Granulibacter bethesdensis
MLNAKHFPCAIMLLPLAIVDVNAETAQQDQMVITAKAPVTEADFAGSVTTVTAEEIQLSGATNILEAIQMVPGISVNSVSSQASGRNGISIRGMENNHTLILIDGRRISDTDTNVPFSDFQYNWVPLVAVERIEVVRGPMSNLYGSSALGGVINIITTNADKEWSTTVEAQLSKVDLGNGGDAKDFSLATSGTLGDSVDLSFAIEQQDSDAFQNSFPSGSSANKEGKDSRNLILKAGFNISENTRLGFNIVDSDDDRTQYPDTLSYTIKRNQTGLELSNSINGFDINTNIYRSTSDNDIESQAYVHKLEENVATVDLGGQLNEQHFLTAGVEYSNEEYHKDYDSTSSFEFKDKFKSWSAFAQDRFDLSDELTLTWGARYDDHQRFGNALSPKAYLNWDISDAWQIKTGYGEGFKAPAVKDASDAYNFEYTYPTAFGGPGGSPSAFQRNVFLGNSDLKEETSRTIEFGADYSQGKLNGGFTLFHSKVKDLIST

SEQ ID NO: 14216 - protein, 686 aa, Granulibacter bethesdensis
MKISHQSLWPLLFLSPLVIADPFEDAELDLSALMEMDVQVTSAMKRAQSAFDTASSIYVLSKEQINKSGANSVPEALKMVPGLIVRQLDNNQWAISSRGVASRFSSKLLVMVDGQSLYTPKFAAVYWETLNVPLYDIERIEVIRGQGGLLWGTNANNGVINIITKNSIDTRGAYANATTGNQINIDANARYGGDLSNKGSYRIYGHVKDANESKKGISLTPSDTAKQHSLGLRADFTPSDEWSALIQGDVTHSNLGQNYRGVIDETNKNVSFSGDLSRTDSRVMARLENRISPDANQMLQVSWLKQSGNQTYIKENFESIDIDYQMNFLYDSLQLDWGLNYRYNKISFEESVFLDSDKDLDNLQQYGGLIQAQYNVIPNYLDLVVGTRLDHNDLTGWENQPSAKVIYKPQESHLIWGAISRSVRTPTLIEFNDDYKVNGTVVEDALGGSTGIKAIDEYAIATYLNGNDKVESENYVSYELGYRFEGDNTSLDLSAFHTDADNIAAIRFNTDPNQFLPAIRFFQLGQFEQAAFALTQTRVDLDVVSQGETTTNGFDIVATWQPLNNLSTELGYSYTKIDYDLPEGATPTIGFDSTNRQVFGKVNYTLFNKHNIFATLRVENSDAYNTDRYTTMDITWNYQINQTWSTALSGKNLFAGSHIEYNNTRETYTLPNYIDECITFSIKASF

SEQ ID NO: 14217 - protein, 1057 aa, Granulibacter bethesdensis
MVFSGGATTTTHAANLVIDGSSQTENGSVTVDQVIVGDTKKDSELTIEPGGQVHSTGDVTIGNKNVITCDDKGNNCSASQSSGVVNVSGEGAQLSADGDLIVGKTGKGVLNVTNGGAVQVNGDVVLGAATSAFCEGRQCFRFFGAGAAEISGEGSSLSSSGAIVVGDQGTGTLSVSDNGRVEADELVVGQQSVLASGGNAVSVSSGGVVSTETVSVKNGSLSVREDGRVETSDLVVRGAGSVDVSADGLVTSDTFRVIGGDLSVSEGGAVETGTLALRQGAAADVSSGGAITAETVSLANSSLTVGQDGSLAAGGLALERGASADVSSGGAVTAGTVSLANSSLTVGQEGTVETDALSLEQGSTADVSSGGAVTAGTVSLANSSLTVGQEGTVETDALSLEQGATADVSSGGAVTAGTVSLANSSLTVGQDGGLDTIEVLAEQGGTITISNGGEIRSETVTLQTSATLTIGASSGEEASGAGALQGLDDDPVSIVFGDGGGSIVLNHTEDDYRLEATVSGDGVLSQEAGYTSLTGNFSDFSGTGSVKGGTLSIDTAYGGSVDVEAGGTLTGTGTVGDVDFKDGSTYLVTVDGGDVLDSTGVVTIEEGASVELGVDADFQISLSDSTIILSGTEVIGEFSSLDGEAVTEVNENHLFVDLALVYDPTSVSLSGERNDTAFADLSTTFNQRATSGGLETLSPGNEVYETFATLQVAEAGDVPAILDQLSGEIHATVQSQELRNSFHVRDLIRERTHGLFDDDRTDGSAQVSTNGPGDSHLEVAPGGSIWAQGYGSFAQVDGDGNAARFDASTGGGFAGVEGYTVHGLLVGVVAGFGRTDVTVAERTSSANIESFTVGSYLSGGFGPVKLHVGSALTRNQIGSSRSVAFSGFTDTLEADYASHTAQAFGEIGYSVETAYANFVPFAGFSVTHMRTQGFSEKGGDAALESEASDQTLVSTTLGLRMERTFESLLGEGKDLSFNGFAAWRHRFGDTTQYVTSAFDGSQPFTIASAPIDDNTLLVEVGATLKLNGRADVSGTYRGEFGGSAHENNFGARLNLSF

SEQ ID NO: 14218 - protein, 767 aa, Granulibacter bethesdensis
MAANPRPDSSVSSPSTWVGGLLPLGALACGLGLPGWAAAQTEAAAEAVALPKITVTAPALPEQGKDSVQAVRTRIGRGEQALRDIPQSVTVVTERLIDDRNLDTFKDTLKNTAGITFLAAEGGEEDIRLRGFSLQATGDIFIDGMRDPAFYDRDSFNWDRLELLRGSASMLFGRGSTGGAANQVSKQPFLMDGHEVNLTLGSHRHRRLTGDFNIKTGDDAALRINAMATQADNNGAGSAIDKQGIAGTYRWGIGTSDEFSLGLFHLNNQNGINYGLPWIRPTASAPASSAGMITTLDPSAYYGMASDQSHGSASTATLAHTHRFDADASLKTTVRRGAFKRDQRASTVRLCTQTTNATTGVVTNPQCPTTQVALDTLSDATILTRGAQLKIQDLDTLHAQSDLSARFDALGLRHEVQAGADWAREEKIVYRATTPTGVNLAKPTTTIGTPDDGASIDEGQRVLSKASGFVNQAWGVYAQDLLTVAPGWKLLGGLRYDRMDGQFEQIATTGVVTPYRQQIGEFSQRLGALWQPSPTQSYHASWGSSFNTSGDSYSYNAQSANTDPEQSVNIELGAKLDSDDRLFSTRVALFHSVKKNERNTDPDTAATALLLSGKRHASGVDIDFTGMLTRQWEVYVSYMWIPDARVDVAAPTAATFGNRQGDRPGLTPRHSGTVWNTFQLSPKWRVGGGLNFRSESTPADQQAANAVTSPGYVTGDLMAEYAFDPQRFIVKANLSNVTNKLYGEGLYRGHYIPGAGRVLAVTGTLKF

SEQ ID NO: 14219 - protein, 422 aa, Granulibacter bethesdensis
MIRGSLKFTVAAMAASVAVVSAAQAGGFDRGGVNIDMLFDESRFATDAAVTIVLPQREINNVVRGANVANAALPTASTASLDVDSDYAVPRLGAKLQIVDNLDCLATYTQPVGADAGYGLNNAYSPTAVDFSLDTDDYGLTCSYKFAGGETSLGQGQFRIIGGVSYQELDGFLSRQTFLDFANVGVTTAGGVTNTSGLGQFNIGGESWGWRIGAAYEIPEIAFRASLVYSSKYDYDLTGTQNNTGFGAVIPGTQIVPISATTEIPQSLEFKIQSGVAENTLAFFGVKWQEWGKLGIIPIVGGRSPATGASSNLSFDPLYQDGWTVTGGMARRINDKVSVLGALTWDRGTSTTSGTQTDTWTFSSGVAFNPSERVELRLGGALGVLTSGTSTPAAGGDQANNITYSFGNDLVAAGSFSAKVKF

SEQ ID NO: 14220 - protein, 665 aa, Granulibacter bethesdensis
MKLRRIIPLAGVSSLALATALYAQDGQNAETVILNPITLVANGQENVEATGGVSVTAEDIEAMQPADISELFSRESSITVSGGGGPAKKVSVFGIEQSLLAVTVDGVPQAQTSWHHTGSNVIDPAFLKSVEVEAGAAAADSGFAAAAGALRYETVGALDLLEAGQNVGGRAALSYGSNGRGISGSLAGYGRSGGFDWFIMAHGSDGDNYDNGDGNEILGTEPAARNVLAKLGYEFEGHRIELGLERSRDEADRLIKANMGLAGDEVYPLKVSRDTVKLTYTSTDPTDMWDPEVSLYFSQYEYWRPNYATGARGNNGDAIFNEDQFGGKVQNTFTIGAGKITAGVDFNEHDYATDNYGDGANADRRYRNFSTSQIGIFTQGRFEFQNGFSLSTGVRYDAHRFTDWNGERFSDSGASVNGTIAYRVNDSIEVFAGASRTWLGYVIGDYGYVHARNDAFITDPDLDTGTAKNLKLGANFGGDAWQAGITFFDTKIDGLLSYESSTMLTNRTEEYRSKGVTLHGAYDFGPTRIGASFTKADVTGDGDDVLPNNGVYFMPVGETATLWVDHELPAWNTVLGASVEWAGSIDERVVNGTTYYKQPSYTVVNAYAEWTPQAYENLAVRLSVDNLFDKNYYERSGFAANDSRGGIEPVWAPGRTITLGTTMKF

SEQ ID NO: 14221 - protein, 897 aa, Granulibacter bethesdensis
MRTIHQGHLPIRTLVLIGMVILITAQAYAQNANARLTITLRNATLKEFVKLIENSTGYSFIYSEEISISHKINLKVKDMPLHEILDLVFKDEPISYKFSERYILLQKKRVQKPVSRKFTISGYVTDGTSSETLIGTNIIESHQYQGTTTNPYGFYSITLPEGETELRFSYLGYTTETHHFTLAQDTLLNIRMKGNAQLEEVVVVSDKAEAGTVATQMGAVEIPMVQIKNTPSILGESDVMKAIQLMPGVQAGVDGSAGLYIRGGSPDQNLILLDGTPVYNVDHMFGFFSVFTPEAIKKVTLFKSSFPARFGGRLSSVIDVRTNDGDMKKYHGTLSIGLLTSKINLEGPIVKDKTSFNISARRSYIDLIAKPFMPDDEKYNYYFYDINAKINHKFSDRSRLYLSAYNGKDHFATQYDDNSDFKDGSKMNWGNTIISARWNYIFNNRLFSNTTVSYNNYLFNVSAYSNNQYSLTNNTTFINRYSSDYRSGINDWNYQIDFDYNPSPMHHIKFGAGYIYHRFRPEVMTSKISDKVDSEAFRDTTYHSMNNSRIYAHEVSAYAEDNLKIGTRLRLNLGLHFSLFQVQKQSYFSLQPRVSTRYQLSKDVILKASYTKMSQYVHLLSSMPIAMPTDLWVPVTKKIKPMRSHQYSLGGYYTGIKGWEFSVEGYYKDMYNVLEYKDGVSFFGSSTGWESKVEMGKGRSMGIEFMAQKTLGKTTGWLSYTLSKSDRKFAKGAINNGERFPYKYDRRHIINLTLNHKFSERIDIGASWVFYTGGTSTIPEEKTTIIRPGNGANNGFILGFDNYYNPIYNNSPNVGEANYIEHRNNYRLPASHRLNIGINFNKKTKHGMRIWNISLYNAYNSMNPAWVFRSHNDDGKSVIKKYTLLPCIPSFTYTYKF

SEQ ID NO: 14222 - protein, 444 aa, Hyphomonas neptunium
MIRKHFAGFAASALALAVTAQAFAGTVTTDGADIVVKTKGGLEVATTDSAFSFKLGGRLQADYGRFDGFYTKNGDSGDGAYFRRAYLELGGTAYKDWKYQINYDFSHNSGTADDGYFDEASISYVGFKPVTLRAGRFDEDFGLEKATSSKWVTAMERNAAYELADWVNSHENGMGLQASSVVADMAYLSGSVAAKDINDKDGDSVKQFNARAVFAPMHETGNVLHFGLDFASRDVSDTAFDSRIRPRLGVRGIATNGGNDAGTNGNRATFGGGAGLNASSQTAVGAYDNDRVFGGEFAFATGPFSAQAEYLTRKLQADSNAYKDVKATGFYGQLAYTLTGEARVYKLDGAKFDTIKPENKQYGAWEVFYRYDNIKVDDKNVVAATATRDVGDAKATMNTIGVNWYANEAIKISANYIKVNTDKITNNVGDDSGDALVARVQYVF

SEQ ID NO: 14223 - protein, 901 aa, Hyphomonas neptunium
MKFKTRKTAVAAMVGTALLCSPYLVSAQETDADKEQEAKKDVELILVTGSFVRRSENFESPSPLAVVDSVAIDAIGAKNIADITQTLTINTGAENNPDAFTQNATAGTSNINLRGLGVASTLVLLNNKRQVVTAQPTNEGLNFVDTSSLVPMIAIDRMEVVKDGASALYGSDAVAGVVNFITKRNYDGAMVSVDYQDGAHGDNKEYILQGLWGATGDNGSVLAAISYTNRSPLFLSDRRLSRPQDDTSALGNPGSYFLNIPGAGPLPIIDPYGCEEFGGAPDLRAPSGTIPGLEVGFCGFDFGKFYSYVADESRTNAYVRADYEFDNDITWTAEFSTARNRAERGGAPSFPILTSPIVPDYHPQNPFGQSVAFFGRAEGNGFEGDPANTESDTLRFSTSLQGVTDTGFWEVSYTRAVNDFVFRVPDVLNTEFQLALYGLGGSNCDPIAGSPGVGNCEFFNPFATSYTSAPNSDYVVSSFTGTEVIDSKADLEVFEAFTSFDVFEMGGGFAALALGVQYRENQLSQDYDDLANQDSFTFVIGNPDIDGSQDVWAAFGELALPINDELDVQLAVRYEDYGGSIGSTVDPKLAVSWRATDEFSFRGSISTSFRAPTVFLAQGGATSLQQLIDPVQGAVAFVAVRTSGNEDLKPEESTAYNIGFSYEPFRDFSIEVDYWNFEFEDLIIQENAQAVLNEDPTNPDRVIRAGDPLTGPALQVNNTYVNASSLETSGLDFVTSYKIETDFGSFTPSLNATYITKYDLMDPQAGNIDGAGRRNFNNIGVSSPELRANLGLAWKNDIHAANVFLRYISSYDDDQNCDDGTANLGGCAGGFYEVDSHLTVDAQYNIDLGGLYDTEQSYVLTLGAINMFDEEPPQLFTNSGFDSKVHDPRGRQIYARLAIEF

SEQ ID NO: 14224 - protein, 743 aa, Hyphomonas neptunium
MKFYPSHPMPESLAAAIAVPLLGLLPAAQAASTAVQLPSVTVEGEYSSYQPESAQSPKFTAPLADTPRTVQVIPERLIQDQGASDLEAVLRNAPGISMTAGEGGRPASDLPFIRGQNSASSLFVDGLRDPSTQSRDTFNLEQVDVVKGPDSVFSGRGGAGGSINLVTKTPRNQDFTEVQAGIGTAETYRGTIDGNWVLGENTALRLNLLGTRGTVPGRDKAVEFSRVGIAPSLRLGLSGPTRVTLGLYLYRHRRVPDYSIPYDPRTGTPITETIGVSRRNFYGLVQRDSGDTEDYAATVKWEHDLANGFKVENLARYSRATVEQITTIPELKTADLAKGLVYRNLRASYQVNDSFANRTDLRGTFDTGQWRHTFDLGGEFATSRRSRDRYKQEIPDAASPCSPVTGGNNPALCASLRDPDPHVDFPGTVRRNHNPARYHTDILSLYGFDTIAFDEQWQLNLGLRWDHYKTSGRNLPVRGAKPPVYESAARTDNLFNYQLGLVYKPRPDGSVYASYGTASTPSAVSDYAPADNISGTSQQFKPERSEVIEVGTKWQVLDRRLLVTGAMFRETRKNTSIEVAEGLRAPAGKSRVTGMELGVAGSLTPRWDVYGGYALLDSKLVRASHNSGAQGQPLPSAPRHAFSIWSTYKLLPELTVGAGAFYRSKVYGNADAGHNKDGTPKARWVPAYWRFDAMAAYQLNKHLTAQLNVYNLLDKTYYAKTYRSHYAALGPGRSAMLTFKLSY

SEQ ID NO: 14225 - protein, 151 aa, Hyphomonas neptunium
DGIENVTGKEKDSPLKASFIAGGGAFGYKMDDIRVDVEGLYSQLTKDATVIDSTKSNVADNLTAFSGLVNVYYDIAIEDMPITPYVGVGVGAAYVSNPSKADAVKDQKGFGFAYQAKAGVSYDVTPEIKLFAGARYFGSYGANFDKTNTSD

SEQ ID NO: 14226 - protein, 656 aa, Hyphomonas neptunium
MAVHYGYDDKGRLAGERQTVHNPETGELLWQHETEHAYNEQGLANRVTPDSLPRVEWLTYGSGYLAGMKLGGTPLVEFTRDRLHRETVRSFGNNAYELTSTYTPAGHLQSQRLNSQVYDRDYDWNDNGDLVRISGPRQTWEYGYSATGRLESVRTLASDLDIRIPYATDPAGNRLPDPELHPDSTLTAWPDNRIAEDAHYVYRHDEYGRLTEKTDRIPAGVIRTDDERTHHYHYDSQHRLVFYTRIQHGEPLVESRYLYDPLGRRMAKRVWRRERDLTGWMSLSRKPEVTWYGWDGDRLTTVQTDTTRIQTVYEPGSFTPLIRVETENGEREKAQRRSLAETLQQEGSENGHGVVFPAELVRLLDRLEEEIRADRVSSESRAWLAQCGLTVEQLARQVEPEYTPARKVHFYHCDHRGLPLALISEDGNTAWRGEYDEWGNQLNEENPYYLHQPYRLPGQQHDEESGLYYNRNRYYDPLQGRYITQDPIGLAGGWNLYNYPLNPIIRMDPLGLYNLYQLLYDVWHDDSYGTSSIDITGSGDLISLGGHAGLGVAFAKKKGEMLSDICIYATACGHAGIGGGINAAITYSETKSLPTSGVSNSVGVTVGGGVGGHFAYTYVVDVDNPESSTESVGIGAGVDASVMTLACRTWQECWVN

SEQ ID NO: 14227 - protein, 1064 aa, Hyphomonas neptunium
MIKNELNQKLQLTCIVCALLSGTNYLHANGKWLDRHEKEIIPTVKKLTEEGIHINGTVRDSQGEPLSGVNIVIKGQTIGTTTDIDGNYFLEVPSRSSILVFTYIGFEEQEIVVGNQININLNMHEISTGLNEVVVVGYGSQKRASIVGSITTIEPQVLSQGTTRALSNNLAGNVAGVIAVQRSGEPGADGSNFWIRGISSFQGAGTSPLVLVDGIERTLDDLNPAEIESFSVLKDASASAVYGVRGANGVILVQTKRGKLGKPTVNVHFEQSFTQPTKLPQYIGSAEYLTLLNEIAKDNGQQQSPYSQETIDHYINRTDPDLYPDVNWMDLITKDFAMNQRADITVNGGSDILRYAVVGSYYGEQGIFERDKSQSWNSGTHLNKFNLRSNVDINITKTTQLTVSVGGYLQEMNKMAISSDDAFSGAFETPPFIHPAYYKEDDNIYFPVVNQRVNPYVQVTQKGYATTSQSKIESLFALEQDLKFITPGLKIKGIFSFDRYSWSGVTRSKTPDLYQPATQRDENGNLILNISSYGQQFLSTSENNDWGNKATYVELNLNYERTFGKHQVEGLFLYNQRDYQQFEESYDIVPYRRMGIAGRASYTYDNRYIAEFNFGYNGSENFAKGYRFGFFPSVAIGYLLSEEKFMEPYKDTFSKIKFRGSFGLTGNDQLDGRRFAYQTTLGEDGTGYDWGTNGQYYHRNSRFEGDFGIPNLTWETVSKTNAGFELGLWNMIDFQVDYFFEHRYNIFMKRNNIPTSAGFRNTPWANYGKVNNQGIDLALNVNKQINKDLYVGFRGSFTYAQNKIIEQDEALGVMGTNRQRTGEKVNQLFGLVDEGLFTFDDFQKDANGDYLIAENGGYVVNEDIPTHTFGPVRPGDIKYKDVNGDGVVSSLDETAIGGTYNPQIVYGFGANFRYKNLDFNIFFQGNGMTYGFKGGCSNKFTPGETMGAMGNILTNYQDRWTVENPSQDVYYPRLTWGKSENNVRNSTWWLENMSFLRVKDIEIGYTLPKSWVRQIGLSNIRLYAKGSNLFTFSKFDLWDPEVDTSVGTKYPIMKSFSAGFDINF

SEQ ID NO: 14228 - protein, 999 aa, Hyphomonas neptunium
MSSLVFKKKKLSIYVAALSMAAMGMPALAQGTGDENIEEIVVTGIRGSQKAAVDVKRNAANVVDSIVAEDIGKLPDVTIADSLQRVTGVQIQRTAGEGSVLNVRGMPQVLTTLNGEAFLSPWAITGVQANYSDIPASMVSGVDVLKSQSASTTAGGISGVVDLKTRRGLDLDEGWTATAAIEGSEGSITKDTNHDVNGFVGWNNGDIAFTLGAFHSNTNAANYQMYEDSRLGFVNTGGDPLDLNGNGKLDDRYLVPAGYGVKAFVMERERQGLATSFQANLSDSLKFTSELFYTKMDQYDRGVETQFNGSNDSNYDVLRPGTQARQEAVVPASGSTPERVIHSVQVAVVEAPDFQATTKSIQNHTDAINANFQLEFDNGGAFSGSVRYVHAEAEKEFEQATFQQGTPAWYWIDADGDNQNDPRDPFWVTVDYTKEYPTFSYNEDLSGIDRLNLFQAFAIGQTDKATMDVLRADGHYEFEWNTFNSVDFGVRLDRRDVDSKKYDYLTPTGRYSTWADPTVPEEDWYQMLPGDYVWQRYPDWYDFKGNAQLGQNPFTDLQSQLISYSDFGPFKGFESGVAALDPKSLDDVNGFMNFIYPGATKFADPAKAYSVVEDTASVYIQGNFENRDAALPFSGNVGVRVVETRREVVNAVYDAGAVPQEGTYYGGGYQATLGQPQGWQVMYKTLGTETTKTSFVDVLPSANINFFPHDDVIVRFGYSKTMSRNDLVNVGEGETLWYQEYKVYTPDGDREDADGKYKVVTSPGGGNDQGNPYVKPWRANNWNLSTEWYFADGAILGVGVFLIDVESATETLQEARAYPDSDGVVRRTANVWTTQNVSASDLKGIEFGYKQPFDFLPGIFGNTGIEFNYTYSDSDSGDEDLEGNSFPLQSNSKHQYNAILWYQGDKLSTRIAYNWRSEIYQGRVGLNTNEAPISLGNWTEAAGYLDASVNYDLLDNLTVYLQGTNLTETNYRNYAQFESQFHSLSVQERRIAVGLRVRL

SEQ ID NO: 14229 - protein, 838 aa, Hyphomonas neptunium
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 14230 - protein, 294 aa, Hyphomonas neptunium
MAKKYLITTSIFSLISISVAQAADVIIPEQPESVVAVPAFSWTGFYLGGQIGNFSSKVDLNYLRDLRDQEVGKWASVKKELLPKPSGFVGGIYGGFNFDFGKGFVIGVDTDVIWSNKKESKNFNEPMKRRPEILSEEQAGTSKSGIEIPGTEFPGGVEFPDPVPGPERPPFEYDRIIQATLKQKWSGATRVRVGFSGERLMPYIAGGVAYTQIQNTFVAPPNFVVIDFSRFLHDEKKTFVGYTLGGGVDFAMTDNVIMRAEYRYSDFGKKKFGQDRVEIGYKTNDFRVGVAYKF

SEQ ID NO: 14231 - protein, 84 aa, Hyphomonas neptunium
MEKNNEVIQTHPLVGWDISTVDSYDALMLRLHYQTPNKSEQEGTEVGQTLWLTTDVARQFISILEAGIAKIESGDFQVNEYRRH

SEQ ID NO: 14232 - protein, 277 aa, Hyphomonas neptunium
MKRALYLVLGLSYALHADSFKDVLTKGDYTFFNKKVVSPIKRYADQSAFYLGLGYQLGSIQHNYSNLNLSQQFNKSQIVFSDGLSPVFKNSYVSNGLGVQVGYKWVGKHEETKWFGFRWGLFYDLSASLYGAQESQSVIISTYGTYMDLLFNAYNGDKFFAGFNLGIAFAGVYDKLSDALLYQALLLDTFGGKVNPNGFQFLVNLGVRLGSKRNQFGFGIKIPTYYFNHYYSMNNISNNSGDVLKVLRFLEYGINSLLYQVDFRRNYSVYFNYTYSF

SEQ ID NO: 14233 - protein, 475 aa, Hyphomonas neptunium
MIYASNLLFKKHTNFDTFAYIKLTSMLHNRINTQLNKSSCITNNNYKDICPQSHTLGGSRMNKKNCSLLTISILFACHANAAGFQVAEHSASGLGRAFSGEGAVADNASVLARNPAAMTLFENAQFSGALSIVDPEVNVYDKTNGEQSDDVAPLQLVPAAYYISPINEKWAWGIGMFTNYGVATDYPDDISAGDMAGDTALVSVGINPNIAYRVNEALSVGAGVNFVYAHAELTRHKGSLAPLFGSTDKSENLIGMTGTTFGYGWNVGALYELSEKTRFGLGYRSKVDLDFDDGEFSSYDSGIATAPKVDGRLQISLPSIIEVSAYHEFNEQWAMHAGWQQTEWSTFTELKATSPQCNDGTAGQCFYKPEHYENNNRYSLGATYQMNESWTLRAGLAFDEQAGEATLSIPDSDRFWYSAGLTYLMSDNMTIDAGFALVKSRSGSFKETNAADEVLEFEAEGTAYISAIQMNYTFK

SEQ ID NO: 14234 - protein, 1369 aa, Hyphomonas neptunium
MADGDDTFTNSGTITMGDIGSAGISMADGDDTVTNTGTITMTDIGSNGITMADGKDVLTNSGRIEIEYASTGAVTMGDGDDTLTNSGTITLDESGSHGIAMGSENDTLTNSGTITLGDISSGGISLANGDDIFTNTGTVTIESTGDGGISLANGDDTFDNAGTVTMGDIGTTGVTMADGDDVFTNSGTVTIGEAGDGGIIMAEGNDTFTNSGKIRIGSAGTAGINLGTGNDTFDNTGWIRINDAGSPGISLGDGRDVFTNSGTIIIGEAGSPGINLGEDDSADEYGDDDAFTNTGTIDIGNVEYNGIGMGYYGDDTFDNAGTLTITEAGYNGINMGCYGDDTFTNSGTLTITEAGFNGIHMGGGDDEIAGDGGLDYFTNTGTITIGATGQFGIHAGDGPSFFDNSGTITIAGVAGAYASYGGIGMAGANDTLTNTGTIEIGYLGGSAADYAAPAPLEENGVIEPTYIGQAYKGIVMGPGSDKLINSGAIRIGYMGSAGVSSSKALTEESDGGDYSGIIGGLGNDLIDNSGTIEIVKTDHHGIVMGQHQDTITNTGTITIGDTGYGAIAMSDGEDTFDNAGTVTIGTSGYAGISMADGRDTFTNSGTIEIGETGLEEEGGSGISMGGENDAFTNTGIIRIGTSYNTGITMGCGNDTFDNSGAIRIRQTLTDPGLTLGDGDDVFTNTGTIRIGTAQADVEEGDYGAAIAMGGGDDTFTNAGELYLGDGFYNIIKGGCDDDLLINEGYIEGGIVMSDGDDTVILRSGSTVTGAINGQCTDPGDAEGTIDGDLIVLEGQGLHNNDILNFDVLEKTGDGTWTVSGLVTVDDLVDVQAGTLFLNDDISGYDGTPDIEIASGATLTANGINMDGDVENSGTFNLGGNIQSTMVTGDFTNAAGATLALGLSDTGECDNLTVGGTAGIEGGTILVTPVGVLQDGSTYTVLTADTLDGAFDQATANSMVLSFEMDDETEPNSIILETDRQSYAAALAGAGLTGNQAAMSHGLMQLINDAPDGDLADVINALDRQPDAASLANALGQLSPELYTLGTALTGVNTGGFTSGMTGRLSGLRVAATNRATEAGPVLAAVPTADRQAGQGWSPWAKAFYTTAEQDTTTGFMSYDYDAMGLSVGIDKGVADNMVVGVTLGIAKAEADVDANMGEQDVDTFSMGAYGSWTGDKVYVDGALLFGINSYDALRHIPMLGLTAAGDHDGVDYSAYIGGGYMAAMGDWNLIPTASMQYTFHEEEGFIETGAGAANLAVDKTDTSSLLGKLGVRVNRLFQMGDGMDLKPELSVQWGHEFADRDQQAMSWFAGTTTGAFTINGLEANRDSGILGLSLTAFMGDSLSLTAGYEGTMKEEFEAHTFTAGLRYMF

SEQ ID NO: 14235 - protein, 319 aa, Hyphomonas neptunium
MHAFSCHRLRGARTFAVSLLLAGVTGVLSHTALAQPVLPDESAQGEALSPEASPPKKGAYLSDWYNQDLMLIGSKDISFGPQPADDIYLEYEYFGRKGPFELYGYIDIPKIFNIGNSHDKGVWDHGSPVFMEHEPRISIDYLAGRSLAIGPFKEWYVAFDWIYDHGSRKENRANTLYSGLGTDIDTHSRVNLSANLYGRYQWENYGASNEYSWDGYRAQLKYIVPIDKFSNGASLTYIGFTNFDFGSDLHKDNPARTANATVATNVLLYSFTHLRFTLVGRYFHNGGNWEDGSELNFGDGNFRARSNGWGYYAGVGYQF

SEQ ID NO: 14236 - protein, 481 aa, Hyphomonas neptunium
MRSLLIAVLFSCASAHAAMGPFDVYEQALRNDPVFLGAIKERDAGLENRTIGRAGLLPKLSYNYNKGRNNSQATLPDGRGGNYHDDRNYNSYGSTFSLQQPLFDYEAYANYRKGVAQALFADESFRDKSQALLVRVLTYYTQALFAQDQIDIARAKKKAFEQQFQQNRHLFEQGEGTRTDILEAESRYELATAEEIEALDEQDAALRELGALIGVQSVNIDDLAPLSPGFAAFSLSPANYDTWHELAISNNPTLASQRQALEVARYEVERNRAGHLPKVTAYASSRQQESDSGNTYNQRYDTNTIGVEVSLPLYAGGGVSASTRQASRAMEQAEYELEGKTRETLIELRRQFSACLSGVSKLRAYQKALTSAEALVVSTRQSILGGERVNLDALNAEQQLYSTRRDLAQARYDYLMAWTKLHYYAGNLRDTDLAKVDEAFGTKRAEPPAADKPPVANKPPEASRPPVASGLAPPWAAQQPQ

SEQ ID NO: 14237 - protein, 229 aa, Hyphomonas neptunium
MKFRILLGASLLAVVASTGAYAADAIVSQEPAPMAAPAFSWGGAYIGGEIGWGWGRAKLDDKSTDQSNEFKPNGFIGGVYAGYNFDMGNNVILGVDGNFDYNDLKKSHDYISNSNAVQTSAETKLQWSGAVRARAGYAVDRFMPYIAGGVAFGGVKNSLNVGGSDYNNDKTLTGWTVGTGVDYAATDNVLLRLEYRYTDFGNKDFDLGNTATRGSFKTNDIRLGVAYKF

SEQ ID NO: 14238 - protein, 380 aa, Hyphomonas neptunium
MKKLNAAALTGVALALAGVSNASHAQSSVTLYGILDAGITWVNNTGGSHVVKFDDGISYGNRFGIKGTEDLGGGLEAVFVLESGFHLGNGQLGFGSTLFGRQAYVGLKNQWGTLSFGNQLDMTEEMVYLYNVSAWASGYAIHQGDFDRFNGDRLPNSVKFLSNEFAGFMFGGMYSFGNVAGDFHQDSAWSVGAHYANGPFTAGAAYTQLNNPHGIYAFDPYAMLGVHTFLGQQTVTVDPATGARTDLFSSNPFPVDKQGTFGIGSSYAIGDVTLMGNFTYTTIKGLGVTSHMKVGEGGASWQVTPAFSVIGGYQYTNFEGHHWNQGSLGAHYLLSKRTDVYISGDYLKASSGVDAVIGYSFTPSTTTTQADVRIGMRHSF

SEQ ID NO: 14239 - protein, 216 aa, Hyphomonas neptunium
MHQTNDTIRTRIIAAAVVAASVALPSLAQAASPGDGIHQGDVLVRLRAISIQPNERGSDTLGALNVGVNNAIVPELDFTYMIRDYLGVELILGTSRHQVTSSAGHLGGVNVLPPTLLLQYHFNHAGKVRPYVGAGLNYTYFYNNGLNVGGEGVSIGKSSFGPALQFGVDVQMTKRVFLNVDVKKIWMSTDATLGDRGIGTLHIDPLIVGVGVGMKF

SEQ ID NO: 14240 - protein, 395 aa, Hyphomonas neptunium
MVQQRDRGVRFHEKPSVSRALLCRAQPAPCRQYHRPDLGHEHRRLRQPAGHDAVVELSDFVRPGAAKFPNDYVPLVDFDRGYYGLLATKQQTARIDNEALSFEDRLKLTRTFALIGGLRVEHIGLDRNSTDENGLVNAGFPFTKDWAPVTGRIGYTWEAVPGLTFFSQYATGADISANNIFLLLPTQPLDLTTARTYETGVKHLFWDNRAEWSFSAYDILRKNVYAAAGGQALNIAGRQESKGVELAASVRPIEPLRLWGNIAYVDARYADYNFVGGSFSGNTPPNVPRIVANAGASYRFFTPWPVEVGITGRHVGDRYNTDANTVTMKAYTVADVYAFVDIPKTVFNAVDQARLTFRVRNIADKRYAIWGDPFYPDQILLGAPRTYELSAAFKW

SEQ ID NO: 14241 - protein, 674 aa, Hyphomonas neptunium
MSDGSIRGARPRAWLLSAGFRLFAVIAPRVRSAMVAGVVAIGLVGATSVSAQAQFTGIYGFGDSYADTGAAPGGAFRLAGVPAGCQSLPLPDNCRFTGGTNFVETLQSIYGLRGLTNYAIGGALTDNTNTLNSEIPGLVPPLPGFVYELARLAHDGVRFSSTDLVTVSIGGNDSSLLTSSVASATALGIAAAGRAVNGTGVAPLSGTYDGVTYNNVVTSGVHQLVDAGARNIAWLSAGNSKYFPVPEGGGAIGDAARDAFAHTYYQQIQLLLRPMAQAGVRIFLFDFEILQARIYANPAQYGFAADPLCQQSSAPHSPTCFYQNAVHPTAAAMTLIGNYMANQIDAPSTVAPQAGIANAVITGFTASALDRLDASRRFQPFGLGAAMAAMPTKAGMPTAPEDRWSVYGDVSYAGGNRDRQFYASGYDYTSTGGYLGVEYRLDPNWRVGGVFGYSQPEVKLGVQDARNRIDAFQFAGYGSYVDTHWFADAIVAYGRHELSLERRGIIDMIRGSTHADVFTAAAKTGYLFDAGKLRIGPIASLQYSYATIQGYTETGDVLLTMMVDRQTLDSLTGDAGVQFRYPLQLGSGIYTPFVNLTAAHDFLGGHSVTTTLVTAPLLPILTPVSADGGTYGRVAVGVSALVTDKVSATLTGTTSFARRSGNDAGVSGGLKVAF

SEQ ID NO: 14242 - protein, 1091 aa, Hyphomonas neptunium
MKFLEKRLEHGGRSRAPLGPWAALLLLAMTLLTAYPAFAQTGSGVLLGRVVDASNRAPAADVVVTATSPALQGEQLVVTDGTGQYRIPNLPPGDYTLRFEKDTFKPYARGGIAVRAATTIRVNVELLPEALKAAEIVVVGRAPTVDVGSSSVSQSITQDFTRRIAVSPPTGKGATTRSFESVAATTPGAQADNFGTSIAGTSSPENQYVIDGLSVNDPAYGIIGTPLTMEFIKEVNVVAGGYMPEFGRATGGVLDVVTKSGGNAFQGSVFFNIAPGIFEGAPKAVRRQGETIQTDETLSSIRDYGFEVGGPILKDKLWFYAGADLAFKSNSMERNLFATRYDPTFEPVTDPRTGLNVVDRLPGTQRFYRAEEQTLQYLGKLTYQIDPDHSVALSVYGSPSTSGGNGTFGFDPQRGVTELSNITGEYGATAHEYVASSTDVALKWSSAFKNKTLLLDATLGWHGQRSARLPPDGSELGTREGLAGVPLMVWQRYDPTPYSIYDFEKLSPEARAMCQPLTTQTGEIAAVPCAVRQYWQGGPDFIDDASLNRFQLKAMVTSIFEGLGHHVVKAGIDGEITTYKHIKAYAGGTTYVEEGGGDMSHDERQFGFLTGPDGLTTGPGARDYVIQDKLTVSSLGATIGAFAQDSWSILDRVTLNIGLRYDAQYLYASDGTLGLALANQWSPRVGVVYDITQEGRSKVFANYARYYESVPLDIMDRTFGDERYIRSSHRGGASGCNPGDPEDATGYGEGQCRNDDSRVPYDEAFGASGAFNHDPNRNWFTFGGGKAPVDPDLEPQSSDEIVIGGEYEVIPNGRVGALYTKRWMNNVIEDMSRDEANTYFIGNPGKGIAKDFAEARRDYDALTLYFNKTFSDLWLAQVSYTLSYLRGNYPGLFKPETDQLDPNMNTEFDLASLLVNRDGALPGDNTHEIKVYGAKAIELPKGMVLDLGLTYRSRSGAPIGAWGAHYLYGTDEAFILPRGEGGRLPWIHNIDGHIGYSVKLAKDSELTVTMDVFNIFNFQETVQVDERYTSEYVDPCVGGTKEDLNPSSGPTCVKNHNTGEPLDPKAVNPNYGEPTQFQTPRQFRFGARVTF

SEQ ID NO: 14243 - protein, 471 aa, Hyphomonas neptunium
MKPVFIALLFTCASAQAAMGPFDVYEQALRNDPVFLGAIKERDAGLENRTIGRAGLLPKLSYNYNKGRNNSQATLPDGRGGNYHDDRNYNSYGSTFSLQQPLFTRLTPTTAKVWPRRCSPMKACAARARNCWSGWKPIPARCWPRTRSNWRGRRNAPTASSSSSTSASSSAATAPAPTPWRPRPASTWPRPRKSRRGTARSRPARTGAAGRGAAGDRRPGAARRTLPGAPAEPRSYTAWRDLALAENPELASLRHAVDVARYEVEQNAPTSCRAWACTPAPASPSPVRRTPTTSATRPTASASSCVPLFSGGETLAARARPRIAWRRAITTWTTRSARPSTRVRKMYNQSSSSAAKIRAYEIPWIRRGRWCRHAQEHRAGVRVNLDLLTPSRRCTARYTVQGQVRLPHGLGTPAFLRRGAGRSRPGTGGGELRFRRDAGAPPRLRDDGLPGAAAHPWKTDTEENRSALNRP

SEQ ID NO: 14244 - protein, 468 aa, Hyphomonas neptunium
MKRPRLRLCSLIWPASLALVLTVPRLAATNGMNMEGYGPVATALGGASMAYDNGAAAVINNPATLSLQTATARLDLALGVLGPQITATAPNGASAESEATAFFMPAFGYTRRSGALVYGLGIFGQGGMGCEYDANTWRGLGFGLKNRTEVSVGRVIVPLAWQVNEALTIAATADFVWAGMDLQMAMTGAQFMDLVSTQQIGLASGGIVQGFGQALQQMPPGTSVDYAYFNFANGSDFTGEASGSGYAGKIGVVYKVSPTLTFGATYHSQTRLSDLKAPGNSISFQLNVPGMGHVPQTLAGDVTVRDFEWPAMLGAGFAWTPTPRWLIAGDVRHVYWASVMENFNLRFVASNATSNGNFAGQDLNATLYQRWSDQTIFQLGAAWQATDTFTVRFGANHGKDPIPAQYLNCLFPATVEKHLTLGCGWKLNEASSIDVSYSHGFAHAVTNGGGIRVEHSQNNAQVLYSHRF

SEQ ID NO: 14245 - protein, 707 aa, Hyphomonas neptunium
MSLKLHPVHRAVLTVFACQPMLAGIALAQEAGVAAPSQQSLPEVTVRADASQDLGTGYNPSKTVSATKIEAPLRDVPQTVNVVTADVMRDQHASSMQDALKNVPGVSFSTGDGQRDQVSIRGFTAIADQFVDGIRDDALYFRDLSNVDRVEVIKGPAAVLYGRGSSGGLINRVTKKPGVDVTDFALSYGMWADRRAEADVGRVFADGAAAFRVTGAVEKANSYRSRQFLDRKAIAPSLELRIAPETTVLLQADYLEDRRVTDFGIPAYKGRPVDVPASRYYGAANARDADYSQSRVYSGTATINHRFNDSWSIRNATRYYHYSLDRNNTLTSAVNEAAQTFTMNHGNVGREEHGWFNQTDLTQKASVFGMQHELLYGMEIGQQNKNQVNNTKPVPGSFDLFNPVLPTLARVAPGTPTTNNLGVFNTLAFYTQDMVTFSEQWKALVGLRYDHFEQQTLQNIAGLQNLSRTDNAWSPRAGLVWQPSKAQSYYVSWSKSFQPSGEAFALAANNTQLAPETTNNTEVGAKYDFLDGKASATVSVFRLERTNIKVANATNTALIPIGEQRTDGVEISGAAELGSGWRFLAGYAYLDAEVTKSTAALQGKRATITPKHSGNVWLTKSLGYGFGVGAGLNLVGARYADPLNTVTLPGYVTADMMAWYRHGAFEAQLNLYNLFDKSYIVSAHGNNPNLNMPGAPRSVMATIRYRM

SEQ ID NO: 14246 - protein, 687 aa, Hyphomonas neptunium
MAVLCPARVSVAENKKFKLHTLSAMMMGLFTGSFAYAETQNTSNQEQEMPVLVVIGEKTQRSIYETSASVEVFDQDTIERTPGATEIDDLLQLIPNLVDSGQSNNMPTIRGIDGSGPSVGGLASFAGTSPRLNMSIDGRSLTYSEIAFGPRSLWDMQQVEIYLGPQSYIQGRNTSAGAIVMKSNDPTHHFESAVKAGIGESDYSQTAGMISAPIIQDELAFRLSFDQQKRDSFVDLAAFEPAGDPKKIEMNSVRGKLLYEPSALDGFKTTLTLSHMDSRGPQTENINVAGNEAFRPVYETASFTTAWDIIWHLNDLFTFENNLVYADFSYDRYTNPNSRGDFNTDGKEFHIEPLLRYIALDGSVNTLIGARYYQSSQDDMYIDAASAYPMDGRTKAKSVFAEVTYALTPSINVNLAGRFEREQVKRNVSHPRYKLDYDETSSVFLPKLDVAYTPVQGQTYGIKAAKGYNASGAGLAFNSMQFTGFRPYEFEQESIWNYEFYTRHRFSHSVEVLTNLFYNDFDSMQMTQTTSSGDVFIANLDEASTYGAEIGSRWYATSSLELFANLGLLKTEFKETTGNTKELPRAPKMSANVGLLYDFGQGFEFSSNAAYTGSYFSESGNSEKFAIDSYWVANAQLAYVFEHGRATLYATNLLDSDKTTLYLSTNNTLDQLKQQPRMIGASVQLNF

SEQ ID NO: 14247 - protein, 257 aa, Hyphomonas neptunium
MKKTLLCAAALTSLAGTANAENFLGYQNGFADINVNYLDWSRHTVNKSKNTTHKEDFAYFELEGGANFNWGELYGFFDLENPFNKQHEDPGKNQRYTVKTTARVYIADTGFNLYGHVYGTWSLPGDKHGGNFHEVNTLYGLGYNTSIGDLWFKPFVALHYVDQTYYSGNNGYVVGWVAGYNFKMFQENFMITNWHEMEFARHERYGNGGRDGVNGALAFWWNATPNLAAGVQYRYADNKLGDDFYQDAIIYTLKYNF

SEQ ID NO: 14248 - protein, 699 aa, Hyphomonas neptunium
MKRTLLLLPAIACLSLSVFAQVPVDKTVSLQSVEIQGKRFGGLTGGEVKRLQVDSNLSGLTGTTADVFRLLPSVVTDIEGGITFRGSNNPGLLINGVPYGLLEEYSGDMLIQLPALFFDRVSMTSTPSIGLVPDGDAGILNLSSAVYTAADSPLVLTLGAGFQERYNAGAILNLHPGKFHIVGKYNYRREFRKRTFSKSTTNKGGTTVMNNNASARPDVHLADLSVGYDLTANDLITVYGLYNLMDYSRYGKIHNNKLVDGNLQPVMFRHRYNDQRQEAYAAEARWNHTFDNPKDRLDVVFNYNNFGYDEDNEYKNEKPETGKIIAEDNYYVNQDKNNYYLSVLYGKLFADDWHLRVGYIGRFKDESYHAYGNKLAAGEWQSDPQKENEYNFNRRTNLLLAALEKRWSSFYAEAGVQGELNLQKIDTRYQTDDVLEKIPMVKSTSRFHLFPRLKLGYRADKVGELALSYVQRVIRPYGSYLNVFTDRSDATHVWKGNPDLKDEMIHSVELSYSYATSAFWFSPSLYYRNKKNRIMDKVLDEGENGTIWTKENIGHSQTFGFELSATWQPIRMLSLGLSGDIYRDEIDGRTIGYDRKKSMVCGDIKGSVNISITPTTELQLDGFYISDQLTPQGKIKHRSSVNAGISQYFMHRKLRANLSINNIFNGLEETTIVDTKDLQMTQVRNRDAQVTWVTLTYNL

SEQ ID NO: 14249 - protein, 791 aa, Hyphomonas neptunium
MFRSCLLSSAGALALFAVCDGAAAQTAASTLPAITVDAPRQAQPSPRKKRAVVQRGAPRSLRPQPAVAVMPSPAPTESLLATLHRAPIGQPQTTIGRDQFDNRPSFSVADVLRDSPGISVKQGNGPRDFGISIRGSNARNGFGIRNLVIFDDGFPVTQPDGLSRSDLIDPHAYGAIDVIRGPSSALYGNYATGGALNFRTRRGAEINGFEYGSDAGSYGYFNNYLTVGQKTGNFEASLFASDTRSDGYTGNTWFNTQTVNFLGTLQATPDDRLTFKLINNTLDARLAIRSSLNQFDANPFQRGCATAATAAPGCGTVSLFNNGFNPAAGTTPTTAEQAGFGRTDRRTIVGGRWEHDFDNQTTWRNQFVFDDRNISQPTGATGAIGDYPSYNLMSDIVRRGQIFGMDATGYLGVFYNTLSWSGDTYRVMPGGNASRGWLVSNLTGMHTNYGARARGEIQINESWSAIAGIGWETTHLKGVNTAYSYAGPTGIPATTINSVDRQLQNTAPEFALQYRADKDWLFRARVATGYGTPQVGNLFVLPNGQNGNNTQLNPQRNLGYDLGFDWTPDPTLRISATGFYEFFRDELVTQAAPLGAPNASYTFNAPKSEHRGVELLAQWRFLPSWRVTAAYTYLDQIYTSYTENINNGATFSFDRAGNKIPGISPNELTARLSYDQLSGALQGVGAFVELQWKDTFYMDNANLLKAPGYELVNLNVHYDTPLQSEYLKSFHLYFEVRNVFDKTFVASANNIANTVTAAGLQNPASVLANTGGSIYAGQPRMFIAGMRLAFR

SEQ ID NO: 14250 - protein, 760 aa, Hyphomonas neptunium
MKFSRIHLALVAAGMSHGMVMADSSGSDVGTIGVQGRATVGGGYMVQEESIKARSTVTKEALDKQTATGNAIDKLKYTPGLNISSEDATGLSGFRFTMRGLNSDQVGMSVDGMPINDSGNYALYSNLLGDPENIDQIFVTQGSAESDGPHIGSSGGNIGIVTIRPTKETGAFVKQVAGSNGTYKTFARLNTGEINGLSNWLSMSHTEGQKWRGDGAVRADKVEWNSFFDMGSGNTANLILKYHEQDNNSYSQLTKSQFQQNGRKFDPYPSTPALGSNGKLSSYYELAQNPFQTFTGVLNTQFKLADNLSLSVIPYYFWGNGSGVNSSSYALNRGSNQNGVFDLSNLPTAAAYNADGSSTTGVYYRPSRTQTWRPGITTKLNWDVNDEHSVQVGYWYERARQSQTQPFIRLKSNGKPESIQPDSDYMVDANGNEIQGRDRYTVTPAQKVWAQDTWYFAPDWTLVGGLAFMNVEREGTNHGSLTERPEKRDQTYNKLLPNLGLKYQLDERDQLFYSLSRNMRVPQNYVLYDPGTGSIDSKPETSWNHELGWRYTEQDMTLAATLFYLQFKDRQVSSKDVNGDFADINAGAVDNSGLELEWSGLLPHHFNYYTSYTYTRAKQKDDLTVFNNGTAIELPTSGKQFTNVPKNMLAANIGYDDGSYYGTFGAKLTSKLYGDLTNDESIPGRTIFNLGAGIYLPVDKKIVKDATLRLNVDNLFDKEYLDGVYTTKTNAGTYSGFRDGDPAYIVGVERTVTVSLEANF

SEQ ID NO: 14251 - protein, 235 aa, Hyphomonas neptunium
MKSWLLGSVGLLALAAASPAFAADLPLKAAPPVPALYNWTGVYIGINGSAVLSDKRWDYFGPLLPTGDDGAHNFTGLFGGVQVGFDYQVGSWVFGVEAQGDWGRARGTSDSLLFANQTNRTLIDAFGLINGRFGYALNNALLYVKGGAGVVQEKYDVFATDTGVTFTNASETRWGSTVGAGLELAFSEHISVAAEYNHIFLGSRDVAFAPTGDIYRIRQDLDVLALKLNYRFNGR

SEQ ID NO: 14252 - protein, 724 aa, Hyphomonas neptunium
MKHSLIPLLASITLANQSIASETINQTANQTELDAVKVTADFRQTDVMEIPSSITIVGSADIDNRNANHLEDVLALAPNMNFAGSSSRARYFQIRGIGERSQFIDPFNPSVGLLIDGVDMTGLGGAATLFDVKQVEILRGPQGTAFGANALAGAINIESNKPTEETEGYVEAKVGNYHSKGIGAAISGSLSENIQGRISLNKYESNGYITNAFLDRDDTNNIDEALLRAQLAWQINPDNDLSLTFFKADINNGYDAFSLDNTRVTYSDEPGEDTQDTNAISVKLQNRSNSFFILESQISASKTDSTYAYDDDWAYGTYIFNSDNPTYTPDPCDTSLGPCLADDDGYSGYDEYNRKSDRVSLDIRLLSTDKGRLFYNTTDWVLGVFAGNKTNELNRKYTFLSSPYTSEIETNSSAIYSELTSHVNDTTTMTYGLRIERSEYDFVDSNNIIEDDSETLWGGKISYETLVSGNSLAYATLSRGFKAGSVNRETELASELRRYDTEINHTVEAGIKSSLLKDQATTSISIFYTKREDQQIKQSYSYLEDGKPEFVDYYANAANGRNLGLEAQIFWKLNSKINIDAAVGILETELTDYNFESSDADDNIITVDKSDRAQAYAPSYTALLAGTYNLSSNIAFRLETELKDSFYYSASHDNKSESYQLWNASIHYKLKNIEMSIVGKNITDEDYAVKGFFFGNDPRDDYTAKVYEQKGNPALVSLNVKYNF

SEQ ID NO: 14253 - protein, 519 aa, Hyphomonas neptunium
MQQGGSGRRAFTGRSLRPVYHGEVSAPPGHQPGILPVAPSPSPMPLPFLRQIARPLPRQAERADAHRLRHALAALVLGLGLQGTALADTAAPKVPDTPDAPATQDLPEPQRWNLHGQFTNVTQWHPDFSARYSGPNSLTPTSDSRETVDLTLFLGVRLWKGAELYANPEIDQGFGLDNTLGMAGFPSAEAYKVGKNEPYHKLPRFFLRQVIDLGGEQQAVESAPNQLAGTRSTDNLTITIGKFSVVDIFDTNAYAHDPRGDFLNWSVVDAGAFDYAADAWGYTRGMAVEWTQSWWTVRGGFFLLSDVPNSVTIDTSFKQYAWIGELEARHQWLGRPGKVKFLAFANRGRMGGYGDAVSLAQQTGSTPDMSLVRRLAWRPGVALNVEQELAPDLGFFARASMNDGSKEAYEFTDINQSVSAGFSLKGDRWGRHNDTVGVAVVVNGLSRAARQYFEAGGLGVLIGDGALNYGTERIAEVYYNWAARPHLTLGFNYQYVVHPAYNRDRGPVSILGLRVHADF

SEQ ID NO: 14254 - protein, 192 aa, Hyphomonas neptunium
MSYKSGFAYVTVLASAMLAAPVVSAQDNTDRDSSGVYLSGSYGGYKSHGGEFDDENDLFGVGLGYQFNQFFALEAEYIDFGNFGDDDVDGKLKGTSLGLMGRLPLTDTFGVYAKAGAFASSFDVDAFDESETYDEVNPFVGAGVDFRVTEQLTAFAEYNRYNVDIDEDDFNGQVTNDGPDFDTGRVGMRFQF

SEQ ID NO: 14255 - protein, 791 aa, Hyphomonas neptunium
MKPLQMPPIAALLGSIFGNPVFAADEAATETTPVKAEVKAVRVKGQRNAPAAVERVNLNRIKQEMIRDNKDLVRYSTDVGLSDRGRHQKGFAIRGVEGDRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTVEESYNLLASYWREADDVNRRRNTNLFYEWTPESDRLSMVKADVDYQKTKVSAVNYKGSFPTNYTTWETEYHKKEVGEIYNRSMDTTFKRITLRMDSHPLQLGGGRHRLSFKTFAGQRDFENLNRDDYYFSGRVVRTTNSIQHPVKTTNYGFSLSDQIQWNDVFSSRAGIRYDHTKMTPQELNADCHACDKTPPAANTYKGWSGFVGLAAQLSQTWRLGYDVTSGFRVPNASEVYFTYNHGSGTWKPNPNLKAERSTTHTLSLQGRGDKGTLDANLYQSNYRNFLSEEQNLTVSGTPGCTEEDAYYYRCSDPYKEKLDWQMKNIDKARIRGIELTGRLNVDKVASFVPEGWKLFGLLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNLFNRKYTTWDSLRGLYSYSTTNAVDRDGKGLDRYRAPGRNYAVSLEWKF

SEQ ID NO: 14256 - protein, 3544 aa, Hyphomonas neptunium
MSRCKTGYPDDRYQTSACRFVIINTGIKWIARLCFAAVALLSINGYAASIPSNVTIDFNSSGFIESADHGSNVFTQGDFKITYSAANWFQDTDDGQSNSAGVFAGMYSGVETITVETTSGNEFDFVSFYINAFGGGFASVEGFRDGSSVGTQSTGSGFGQANGSFTVTLNNNPFDNVDKVVITSNSGGYFDIFDSFVFNTVPDITPPTVSSVNSSTANGTYKLGDVITVQVNFSENVNVTGTPQLTLETGSTDRTINYTSGTGTSTLNFSYTVQAGDTSADLDYVTTNSLTLNGGTIRDAASNNATLTLASPGAANSLGVNKALVIDGVVPTVASANSSTANGTYKVGDNISIQVNFSEVVNVTGTPQLTLETGTTDRTINYASGSGSSTLTFSYTIQSGDNSSDLDYVATTSLSLNGGTIRDAATNNATLTLASPGTANSLGANKALVVDGVVPSVTSTAPSGGAVSTDTSVDFTVNFSESVSNISTDDFALGTTGSATGTIASVSAGSGSSVTVTVSGITGNGTIKLNLNGSTNISDPAGNAGPAAYTSGTPHTVAIPTAPDAPTIGVATAGDGQVSVAFTAPSNNGGSAITGYTVTSSPDGITAGGNGFTSSPITVTGLTNGTAYTFTVTATNAIGTSAASATSGSSTPMTDQTITFANPGAQNFGSSPTLSATSTSGLTVSFSSSTTGVCTVNSTTLTFVTAGSCTIDADQVGDGSTHAATTVSRTFTVNAVVPGAPTIGTATAGDTQASISFIAPASFGGAAITGYTATANPGGATGTGAGSPITVTGLTNGVSYTFTVTATNSAGTGSASAASNSITPASPQTITFANPGAQSFGTSPMLTATADSGLTVAFTSSTTSVCTVNSTTLTFVTAGSCTINADQPGNSAYLPAHQVSRTFTVNPALPGAPTSVAAIAGDTQASVSFTDPVNTGGTSITGYTVSVSPPDVLPVNGVGSPIVVNGLTNGQAYTFTVRADNAAGTGPASVVSNSITPKASQTITFNNPGAQNFGSTPTFSATSDSGLTPTFTSSTMGVCAITNDGAMTFLTVGTCTINADQSGNASYLPAAQVSRSFIVSAVAPGAPTIGTATAGDAQASVSFTAPGFSGGAPISGYTLVSIPGGITASGGSSPIVISGLTNGTSYSFTVAATNSAGLGSASSASNTVKPNGAPVINGTPTLTVNQGVSYSYTLVAMDSDVGDSLTLSAVTLPSWLNFNAATGVLSGTPSNANVGSHAVLLRATDVDGLTADQSFTIVVANVNDAPTISSTALTSATQDAAYSYTLVAMDSDVGDSLTLSAVTLPSWLSFNAATGVLSGTPTNANVGSHAVVLRATDGDGLTIDQSFTIVVTNVNDAPTISSTALTSATQDAAYSYTLVATDSDVGDSLTLSAVTLPSWLSFNAATGVLSGTPTNANVGSHAVLLRATDGDGLTIDQSFTIVVANVNDAPTISSTALTSATQDAAYSYTLVAMDSDVGDSLTLSAVTLPSWLSFNAATGVLSGTPTNANVGSHAVLLRATDGDGLTIDQSFTIVVANVNDAPTISSTALTSATQDAAYSYTLVAMDSDVGDSLTLSAVTLPSWLSFNAATGVLSGTPTNANVGSHAVLLRATDGDGLTIDQSFTIVVTNVNDAPTISSTALTSATQDAAYSYTLVATDSDVGDSLTLSAVTLPSWLNFNAATGVLSGTPTNANVGSHAVVLRATDGDGLTIDQSFTIVVANVNDAPTISSTALTSATQDAAYSYTLVATDSDVGDSLTLSAVTLPSWLSFNAATGVLSGTPTNANVGSHAVLLRATDVDGLTADQSFTIVVANVNDAPTISSTALTSATQDAAYSYTLVATDSDVGDSLTLSAVTLPSWLSFNAATGVLSGTPTNANVGSHAVVLRATDGDGLTIDQSFTIVVANVNDAPTISSTALTSATQDAAYSYTLVAMDSDVGDSLTLSAVTLPSWLSFNAATGVLSGTPTNANVGSHAVVLRATDGDGLTIDQSFTIVVTNVNDAPTISSTALTSATQDAAYSYTLVATDSDVGDSLTLSAVTLPSWLSFNAATGVLSGTPTNANVGSHAVLLRATDGDGLTIDQSFTIVVANVNDAPTISSTALTSATQDAAYSYTLVATDSDVGDSLTLSAVTLPSWLSFNAATGVLSGTPTNANVGSHAVLLRATDGDGLTIDQSFTIVVTNVNDAPTISSTALTSATQDAAYSYTLVATDSDVGDSLTLSAVTLPSWLSFNAATGVLSGTPTNANVGSHAVLLRATDGDGLTIDQSFTIVVTNVNDAPTISSTALTSATQDAAYSYTLVATDSDVGDSLTLSAVTLPSWLNFNAATGVLSGTPTNANVGSHAVVLRATDGDGLTIDQSFTIVVANVNDAPTISSTALTSATQDAAYSYTLVATDSDVGDSVTLSAVTLPSWLSFNVATGVLSGTPSNANVGSHAVLLRATDVDGLTADQSFTIVVANVNDAPIATNQTVTLEEDSSLMITLAAEDVDNDPLTYEITAQPASGTLEQHGSVWLYTPEKDFNGTDSIGFIAKDAELSSEPATVTITVTPVNDDPQAVDDSYTLTSTPNDTYTLTVLANDVDVDGDTLTIDGAAADIGSVQITSDGLSFTAPEAYVGPVALRYTISDGHKGRATAKVNVLIEGTDSASQPVITLPDDVEVNATGLFTRVKLGFAKAVDRNGHPLPVSLVNKSLFFAPGNYLAYWQAVDGEGNKAIKAQKVKVNPLISLSKDQVVAEGNQVTVSVHLNGEAPSYPLSIPFTVSGSADSSDHDLVDGVVEITSGQMAEIHFTTLNDGVTEGDEEVLISLDPSLNLGSKQQTQVVITEANIAPQVSLAVTQAGQQQVIVAQNSGDVHIRATASDANEQDTLTLTWASGALSLQADSTGMAFSPAAVTPGIYPVSLTATDDGSPVLSSTETVYIVVRPSLAALTSADTDGDLIPDVQEGYSDSDSDGIPDYLDANNDCNVMPEGELQPVYFLAEGQAGVCLRLGNIALRRGQSGMQLQPEVVTEDALAANVGGIFDFIATGLPQQGQSYSLVLPQRSPVPANAVYRKFNAQAGWRDFVIDANNTVASTEGERGFCPPPGDSRWTPGLTEGHWCVQLTIEDGGPNDDDGVANRTIVDPSGVAVMLNGNHLPVANPDSAAIAWNQSIDVNVLANDTDSDGDSLSITQVISEFGTATVLADQRISYTPAADFIGTDVLVYSITDGKGGTASSELTIVVNGNTAPVTVDDSAATDDRTSLLIDVLSNDTDVDGNTLTLLSATAQQGAVTIEANKLRYIPKTGFDGVDTVTYRISDGQGGEATGQVLITVKAYQEVIIDNKSGGGSMTLWGLAFILACAMLRRRELQRFALGSLLLLSVTQQAQATDWYVEGFIGQAQADKTLPELNVQVGEGQLINVDDSDTAFGVSLGYQWTPTVALELGYADFGEGSAKIKGATLTPEQYHELVKTVTPVLADGVMLGLRFTLLQHQGWRFEVPVGLFHWQADISSTMGNTRIKTDLDGTDWYAGVRFSYQFSDAWSVGLGYQYIDIEPNDLLSYQLNLRYQF

SEQ ID NO: 14257 - protein, 277 aa, Hyphomonas neptunium
MKKMMQGAAALIALVGAGESMALEWMSNSVGFRYGQQFTNPNNPDKFAKRIYSFTHADGYRYGSNFFNLDVFLSDNRDPRKGTDHGGSEVYAVYRHQLYASRVFDRPLGTGLVKDYAFTLGFDASRNNNLASAKKRALVFGPTLKFNGPGVLDLSLLYYREKNHFGVPGARHPDHTFDTTYMLNLTWMRPFKVGNHAAKFQGFVNYVGDKGEDYNDKHTAAETLVRTALMVAALPGDKRQPNLWLGVGYEYWHNKFGVDGGTGSRTSTPTLNMEFTF

SEQ ID NO: 14258 - protein, 769 aa, Hyphomonas neptunium
MKRQAPRRSLLAMAIATAFVPAFAAESIVQTATVEVIGSTPLSGIGVPRQQLPSNVQSISDDQLEALEALNLPEFMVRALPAVTVNEIQGNPYQVDVNYRGFTASPLLGTPQGLSVYVDGVRVNEAFGDTVNWDLLPRSAIAGIDLIPGSNPAFGLNTLGGALSIRTKNGFSDAGSKLEMSGGSFGRSNIEVEHGGNKNGLGWYAAGDWFREDGWRDYSKSDVKQFYGKLSARGAAGELDLALTQARTRLIGNGLLPLSMLSERRDQIFTHPDITRNDLTQLALNGKLWLSDTQSLSANLYHRYTRTRTLNGDMNDAYENDFLLDPNTPSGAHNRTSTHQNTTGAAVQWNLSTQRQQLAVGSSIDQARIRFLQTRQLGQIDGTRGIDQLGDVTDENKLHGSTRTASLYVTDTIALRSDLHLTASARYNASRVRTHDDLNSAPPNLDGDHSYTKLNPAFGLAWQVVPALNAYAGFSQGNRVPTPIELGCADPANPCTLPNSMASDPYLKQVVARTVEAGLRGQVAGDIQWNAGVYRTLSSDDILFVGTSTSAGYFTNFGKTQRQGVELGLNGKLHRVDWYANYSWLQASFRSEACLLGANNSTRGTAAECTGAGQDDEILVKKGNRLPGLPEHSAKLGLSWRATDWLRLGGDVQAFSSQYVRGNENNQHQSGTYTDINGNTRTFAGSGKVGGYAILNFNAEARLGGGWQIFAKINNVFDKRYATAGALAENPFASGSFQANPDDWHRETFVAPGAPRAGWLGLRYVFGGK

SEQ ID NO: 14259 - protein, 689 aa, Hyphomonas neptunium
MRALRLSPLSFGLLAALAHAQSGNVNPTQNSTQAPGGSLAPVFVTANPLGETDLIAPATALYGDALTRRQTNSLGETLNGLPGVSTTTYGPMVGRPIIRGMDGDRIRILQNGVAAWDASSLSYDHAVPQEPLTIERVEIVRGPAALLYGGNAIGGVVNTIDNRIPREPINGLTGGVDASYGGANDARAGAAQVEGGNGRFAFHVDAFDRETSKERIPGFAHSDRQRALDGPDANEAYGSLPNSDGRWHGGALGGAYTWADGYAGLSYNGFEANYGSVAEDDVRLRMHQDHVAFASEVRNLRGPFSQLKFDFGYTDYEHKEIDNGETSTTFRNHGYEARIEARHRKIGPFEGAIGVQLSQNTFSALGDEALVPTTQTTNVALFGLEEWNVTDAFKLSAGARYEHVKQQPTAAGNDKFASAHDRDFNAVSASLGALYKLTSLWSVAGNVAYTERAPALYELYANGPHDATGQYLIGNPDAQKEKAVSTDLSLRFASGPNKGSVGVFYSRFKNYLTEFNTGRLVDDSDQVVAPGTDDALNEAVYRGVRAEFYGIELDGKWRVFQKGAHQVDVELTGDYTHARNMDNDQPLPRISPLRATLAVDYGYGPFGARAELQHAWGQHRVPENDLPTASYTKLGLLVTYKFHVGATDWLAYLRGDNLTNQDIRYASSVVRDIAPEGGRSVMVGLRTRF

SEQ ID NO: 14260 - protein, 230 aa, Hyphomonas neptunium
MNPPILKKLAMSILATSFVLGGASAWSGEIYSTETAGYNQGDWVASFNMSKVYVDETLGSLNVGGATVPNAAVSIGNDTTVSFDISYFISNNVALDFFVGIPAKAKFQGEKSISALGRVSEVDYGPAILSLQYHFDNFERLYPYVGLGVGRVFFFDKTDGALTSFDIKDKWAPAVQVGLRYDFGNSWMLNSDVRYIPFKTDVSGTLGAAPVSTKIEIDPFILSLGASYKF

SEQ ID NO: 14261 - protein, 660 aa, Hyphomonas neptunium
MGLQLNNQDPIYGFQRRDFDSTNDNPDPTLRYGSRIALHNTPRTYIDPGADNCAALGALFNGSVQYDNRANRGNFCSSRAEPGYASILNKERSASGYANLSYAFNDNTELYSTLLLNRTKVEVNSGSQFWQASSDTGGLFYNQDSQQLESYQRIFAPEETGNLNFNNQRQTADSYNIAIGLKGGLGASNWTYDAYYARSEYRIDSRQQWPLADRIEDFFREQFLGAPQGEYYGYPIYSPNDANFYRALTPAQYRSFNDEIRTKSRTWTQNVNLQLTNTELFNLPAGAVGIAGVLQAGNQYWTNPTDPRVIAGDFYQLTGTQGSGKRDNWAAAFETRIPILSTLTANLSGRYDDYKNQGGGGDSKFTYKAALEFRPIDSLLFRGNYATAFKAPDMAFSFAGDSGFFQGVNDYYRCAVEEPGVPIADCTYAGTTISGRRAGNRDLKSITAKSWGAGVVWSPSARFSVNADYYNIKIDQKVSDLSTDNLLQTESACRLGSLDINSPTCVDALSRIDRTGPDAPVPNRLSSIRINPVNISNEEISGVLTKATYNLATESWGLFVFDAQYNVTLKHESQQFPQDPVRDLLSEPFFSSEFRTIANASVTWQKDAWTTTLFGQRYGRTPNLLSQQSTDGYAVEGARKVGAWTTFNATLTTRSATISR

SEQ ID NO: 14262 - protein, 1077 aa, Hyphomonas neptunium
MNKAHVSIPYTHHKNKVSVNKKLFQLSVITSALLFSGYTLAYSEAGQIGDKQSWESQEYKNDWGLAAMNASSAYALGYHGQGAKIGVMDSGALLTHEELSGSRFHAVKAKGEYGSTGMRYPQEMGGNYQKDQPFDVDGNWIKGVNDTHGTHVTGTVGANRDGNGMHGVAWGSDVYVGNTGATDSNNYGPYQDYQYFYTGWKAMVDDGAQVINNSWGTNTRIINTVKTTGPDGGNTTVHLPADTTQQTEYEYFYFKKVYGDKPSFVDAAYDAVKGTNVVQVFTTGNRDFANPYYRPLYPYFNPQAEKHWIAVAGMKQNAAKTGYELEGMFNEAGNAKWWTVVAPSRAIYSTVVDEEGNPGWDTFSGTSMAAPHVTGAMGVLMSRYQSMNALQVRDVMFTTANRYNPDGSLYKNWTSADGVPDERYGWGTPDLEKGMYGPGQFLGKFEYNLDSTPLDVWTNDISQAALDQREVEDLAWLTDYKNNGIDAGGNYELGDNFVVNDGNPDPASHIVDINDAKKWRQEYYQKRAEAIQAKIDAGLYDGALVKKGQGALVMTGDNTYRGGTTVEQGTLYGFTESFGTADVNVNGGTISVIDRYNDTFTQKGQLTSNQSHKANININDKGTYLVAVGHNANVGNLTLNQGAQLDVAASDVGQLKDVYLNGNTVQGTVNADNLVDSRAKAKALAATPNNTISDDYALFQKDVSVKNNTITGSISKKGDTTLATFANNENGRAIANTLDSNAKGQLFDAVLPMSANDLSSTYQSLGNDMLLNANTASVVNVLGLTRTVKDQAIGVGHGRYANLENSNARMWMTGVGQWGNLDYGYSNMDVDFYAGLVGAEIDVTENTKAGLFFGAGSTHYKAHEYGKIDSNDLHVGLYGVSNIKDVAAVNYGITHTNQDRDAKRTLWVGQTSGYNSTSYDAKITQFFLEGAYTQLNNDKYSIEPYAGFNWLHVSTDSINEQVGNMQFSTKTDNQDIQVGTIGLRGGYPFTAGSINMALKGDVSASHLFGDNRPEAQLYLSNSGEATLRGGKLDNLFGVGLGVDAQLNKSTTFGVSYQGQYNSDVSSSGINATLKVNF

SEQ ID NO: 14263 - protein, 884 aa, Hyphomonas neptunium
MPDVRLSSRSLTPVLCAVGLACALQGEVQAADGGPRDVATAPRVFDIAPGELAEVLLNIVRQGHVPIAFDQRLVAGLRGPDIRGRLSVEDALRRALAGSGLAYAQDESGAFVLRRGQAPVQETRGATVAPTLSTVVVTGTRKSDVKAQDSLSPIDVVSATQLRSSGAVDLRDALVKLLPSLTRQAQPFNASALTHTQSLRGLSPNHVLVLVNGKRRHETANLNISGGLEKGSTGVDLDTIPINAIERVEVLRDGASAQYGSDAIAGVINVILKSADSGGSAAADVGQTGDGDGFTHGGGGNIGLAFGDSGFVNLTAEYREQERTMRSGIDERTGRRDNISMGDPAFHRQSLALNSGFGLGDDIEVYGFGTYTRRKASSAANYRLASVAPTLYPDGFTPRPNSDEDDYAFLAGVRGERLLDAWHWDLSSGYGADRPDIGMTQSVNAAIYRETGNSPRSFDLARYRNSQWTSNLDLGREFELDFLAAPLALSLGAEYRRESYRIDAGDPASYYSGGAESLAGLSPLSEGQWSRHAWASYLDLGTSLTPAWEVDVAVRHEKFSDFGSTTNGKFATRYQFDPRVALRASVSSGFRAPSLVQEHYTGLSVGPTIALGLLAANSPAAKMLGADELQPEKSTSFNLGLVLSPWENVGLNIDAYQISIRDRIVDSATYSGQEAIDALAAAGISLPASASTVSTHYLANGADTRTRGVDITGHYLVALGEYGQVDWELSANFNRTTLRKNHRGANGEPLLNAQQVAWITSSTPRSQVSLGGTWSRQDWEVSLRLTRYGRTSSELDYTVGPDAWSTEKFNHFVNDPKYITDIAARYRLSADLTLTAGADNLFDVRPDKLPAQNTTYGDVLRYDTYASQIGFNGAFYYLRAAYRF

SEQ ID NO: 14264 - protein, 241 aa, Hyphomonas neptunium
MKKFLLTAVVATAFAAPALAADIAPRPYTKAPVPYTPPQAVYNWTGFYIGGHLGGAFGGDLGGSDGRFLGGVQGGADYQFANNWVLGIEAQHSWLANYRENVAFPGGSVVTGGNSGLGSVTGRLGYSWGPTLLYAKGGYAFRDGALGVTDAAGAPQAFTTTGNRNSGYTVGAGLEYMFAPNWSAKAEYQYFNFGRTTFGAGSPADVVGASFRNDEHTVKAGVNYRFGWGGPPAPQYPAPQY

SEQ ID NO: 14265 - protein, 740 aa, Hyphomonas neptunium
MKTRFAYSLIALALAQHQSAFAAETVLDKEAPQQTLSTSSPVASPASTEPAAYEQVKLAAPERIAVHGRAMQMYVDKETTVGTKTAINVMELPQSVQVLTEQLIVDQAARNITDLYRSIAGVSEFSYSGVTFRGFRDDANVFYDGVRGDPYSGFSVPQLFNVQRVEVLKGPASALYGGGEPGGMINYVTKKPTFVESKELTLSTGSEDMMGGSLDLTGGLTNNLAYRFGAYYQQEDSFRNNADSQNAEVAGGLLYEISDDTKLTTTFDVIKQDLGGNRLRGVPVDNDGNFLVAPSYNANEKSDFQKMDALVLQSILDHQFTDNFSVKTQIRYLNNDSTQQYHESRGWATLDANKKPIMGDGTIKREYRVQARANDEISLTNDFVYAFDALGFEHEFLFGGDYHYVETEYSYKLATDKTGVGNLNIFDLNYGETDPSTYTLQDKDTDGTRANRYGVYVQEHLHFNEQWSLIAGLRFSQFDDYDKKTGFSFSDNAITPRAGLNYRPIDSMSFYLNYSESFKPASLSNQESIKIHGFFDPETGKQVELGMKNDWLDGQFMTTLAVYQIEKQNVAQSNPLYTGDDESIPAMFNIGEVRSQGVEWTLVGDLTDNLTVTANYAYNETETIKGVTNGSLTNTFDSKHFANAPRHQAGIWTRYDINALDSAIAFGMDYVGEQFSLDGQIVKPHTIFDMSWTTQWDQTQVRLNLKNIFDKEYAVSGFSERNGHFPGEPRNITLELSHKF

SEQ ID NO: 14266 - protein, 1032 aa, Hyphomonas neptunium
MKIAGISLLLFCTTSQIAVADSYEKNAVTATQQSKTEKITGKIVDESGEAIIGASVKVQGSTIGTITNMEGEFMIPNVPNKAVLEISYIGYKPLEVAVGKSKDLRITMEEDTKTLDEVIVVGYGTTSKRKTTAAIASVNTEDIIKAPTANITQSLAGRAPGLLVTTSGGGLNNFSSVSIRGGGTPLYVIDDVISEERDFRNLNAEDIDQITILKDAASTAVYGARAANGIVMIVTKQGKAGKMSVNYNFNYNWSQPANMPNKLDAHDAAFYKNMSMTNDGLAPAYTDDELELFRNGSDPRRYPNTDWQKLCLKNFAPEMQHTLTVTGGSEKIKAYTSLGFYDQKSLYKFDVNSFKRYNFRTNIVADFKEIGLKVTSSIEAYKTDLRSPNAKSGDSYYHTWGHIQNKAPWEIAYNPNGQIFNTPDNPLMEISPDAGYTKNENLSAIANLALEWSVPYVPGLRLKALGNYRINNDKSKSWKKSPLAYDWDGNPNDPGKPSLSKSYSNWSSYTVQGFANYDRTFNQVHTISATAGIEAYKLFKDDASLSREEYLLDVDQIGAGPVSTAKNSSSEGEEARAGVVARLRYDYASKYVAEASLRYDGSDNFPRGKRWGTFYAGSLAWVISEESFWQTLKDRHIFDQFKVRASYGEIGSDAIRRYAYLQSYGLNDRGYLLNGSWYPGFSEGALVSKDITWYTTCDFNIGFDFGSLNNRLSGSVDYFRKSTKGYLTSPSAVAYTDPLGIALPQVKSNGEFIRQGAEFILQWKEKRGDFEYTLSGNFTYFDQYWNINPNEAETDTKNPYKRTTQAKGYWGIGYDCLGYYQNQEDIMNSPKRQSSVNLGAGDLKYNDFNGDGIIDGSDQHRIGKNSMPRGQYGFSADLNYKGWFMNMLWQGATPADLYMGGMIQGSQSGSGYPPVIYDFQTDVWTPNNTGARYPRLRSTASYNGSNNYGSSDFWLINTGYLRLKTLSIGYDFKHKLLKRVAWMNKCNVSLNGYNLLTFSKANKFDIDPEIGDGNLYTYPVSRVYSISVNVGF

SEQ ID NO: 14267 - protein, 661 aa, Hyphomonas neptunium
MSRNNLTLSPLTLAMALTTFTSSTFARETSYDVMVIESSKQSTLLNRIDSSVLVKTAEELERAGVDQVQDLEKVFPGLLIQTRGNRTYANTTIRGISSPDYYSPTVSVYVDGVLQDSAFLTQPLVNVERVELLRGPQGTLYGGNAQGGIINIITNKAIGQTSALASASYSNLNEQLNGSAALSLNDSLSADIALRAIKDNGNINHLPTQRKDANDSEQFSGLARLHYLPHHSPFTATLSIANSHLDSHEEWYLTQAEFDQKMTSQAIPQLKRIVNSYALQMGYDLGETQLTSVTAYQNRNIYRQFIGGTWQEDQNTLSQELRANTQVSDALSTLIGAYFEQRDFDAKSGVGSQATNQVEATQYALFGQAIYALNEQIDLTLGLRATHLSTRADYSGNPSWMIDAYAQNKSENTLSPKAALGWQITPDSRVFTSISSGYRPGGFSLQPRSSGDKNGYSAEKSLNGELGWRTRLANNMVDLSGALYWIKTDDIQLYTGNPGSQVLRNLGEAQSQGLELQLAFYPTDDLTLNLGGTFGESSFKSGNHDIEGNTLPYAPKTTLVAGIDYVLPQAWFNGAVSLSSNARYTSSVFFNETNTLSQAGYTLVDLAIQYQVNPHLSMRLFSNNVTEQEYKTYSFAMPNSSVALSNYGVGREVGLNIKLEW

SEQ ID NO: 14268 - protein, 425 aa, Hyphomonas neptunium
MTALPSRRAHPRLLCLSLALALAPLAHAQDAADAFKLKLGYTGEAASMIDGGRKGGDAYAGQLMVGTDVDLNSLFGWHGATVKAYVTNRHGTNLSNSSIGNSTSVQEIYGGQGTRLANLTLVQKLFDDRLELEAGRSVANIHFLGSDLCQYFQGNSACGNPTFVFRTSNFTYWPVSSWAAHATAWVTPKVYVHVGAYEVNPVQAQDGQHGLKWSTDDTTGVVVPYAIGYKNKGGDGTLAAMYELGGWQDNSDYTDPLRDRNGNPAVLSGLGYENKQGRSGLFGRFEQQVTNPNPSGTQGLTVFAAILKSTSGQAIEDHFVQLGLVQKGTFASRPQDNIAFVITQQKYSDEAIENLRLARASAGGTGTPADNQIMMELSYGIQVTKRLRIAPNLHYVINPDQFNEPTRSNDLKNALIAGMRIDWNL

SEQ ID NO: 14269 - protein, 586 aa, Hyphomonas neptunium
MFQSLSRIVAITPGVLGLLLLVSPGAIASPELPVETTDSDTINPTEALGVLRNRPQLANPLNRSGQQQFNPSAAQVTSVSELRDVAPTDWAYEALRSLVERYGCIVGYPDRTFRGNRATSRWEFAAGLNACLNTIERLLQENVAVLREDIEKLKRLAQEFEAELAALGARVSNLESRVAYLEDHQFSTTTKLRGESIITVSAAWGERALDFREQDLFNQGLLEQRRIDDNAVIGHRTRYNFDTSFTGNDLLKTRFETGTIVDWSDPTGTNMARLGHDSDRNSKTFIDDVYYRFPSGGLTTWIGANSLDIDDIFDVGNPLLFAEESGALSRFLRYNPLTFRGSEGKGVGFNYKFNDIFTVRGLYLTDTGNNPAQGSGLFNGNYSTGGQLGVYPSDSLAFTFTYLHTYFRSGSSDITGSTGSYVEANNQSDQTGTGVARDPFLGAPTIRDSYGITANWRINQTFNLSAWGGYALARAQGSDASGNSRKGFGADIWAWSASLSVVDLGKEGAVLSVAGGSASNARRIDALTGDLAVPDQDTPYMVETQYRYPLSDNILLTPGVYVIINPDGNNGNNSIWVGALRTTFTF

SEQ ID NO: 14270 - protein, 244 aa, Hyphomonas neptunium
MKNLLLALSCLLFANLAIASSHNGVYISSKIGVSVLNMYDSKFEYSNEKKSDFRALKFNDKSHPAFGNFIGIGYDFYDQFSVPIRTELEVGMRGKVSDTHSLNALSTVPNSSADMKNEATLTTLMLNGYYDMKNQTAFMPYISFGLGLASTRYENTQHSEFEIFGLKQNSNQSRSERINKLAWSLGMGGRYAFSDNLSFDLGYRFTEAGKYKISMPNSFDKDATDTSTINLASHDFMFGVVYRF

SEQ ID NO: 14271 - protein, 750 aa, Hyphomonas neptunium
MTFMVWAALLFAASQDVSAEGPMPAPQDRIVVTATKRPQPSTAVPASLDVLTGESLRAGAPLIHGEELANRLSGVQAVVANGSQIAFQIRGIGAIDHQALTPGAAAIYRDGVFLATNVQTGPLLYDLDRVEVLKGPQGTLYGRNASSGAINLVSAGPDRTAGGYLEGTIGTDDLFDVSAAVTGPLTPALAGRVAIRAVSQGPTLDNVAVDPDQPLGGDDAGGRTEDIGVRTSLAWQGGEGQRALWLAHYEHAGGVNPAPRNSSLGLEDHDISIGPDGIQDRDNHFYGTSLEWTAPVFGGQVVSLSAFEGYDQAYGFDFDGTQAPFGDPTLNANLFYDREFWQVSQEVRFDKETAWGHLLVGAQTSADDFRQDYLIWCGELNPTTLLGTCRYVGAPGRVGSTPASPGTATTLLTEIDQERLTAALFTDNEIALTPRLSLLLGARYSWERIEGEGSGRHIFDDGTVAFNNRDDVGPAVGANSIIESRVNGNIGLSYRLANDGLFYGRISTGYKSGGFNGEVQNNATHFQDEGLFAAETVTAYEVGGKGPLTDSLSVDLAAFFLDYDSPQARIFVTFPLPDETSITSNSLSNLDAAIAYGLEGKVDWSPNDTDYVQLGLTLLTTDIRQATNVSGNAEAFDGNDLPFASDTTATLLAHKEIPLRAGVTLSLDADAKYQSAFFLDAEGLNERRQDAYTLLGASMGLRFDGPGVEASLWGRNLLDEDYAVSGYGFIGYNVFVGDPRVIGASLRKDW

SEQ ID NO: 14272 - protein, 824 aa, Hyphomonas neptunium
MKYFFLFIIFLNSLCAFTQKVKVLNKQTGKIIKNVTIFNVKETISITTDEDGFADISEFDAMEVVIFSHLSYAVSRVRKAVLKSKNYIVYLTKESEQLDEVVVSLFKREEKTNRIAEQVAVLNSKEIQRVSAQTSADLLATIPGIKVQKSQFGGGSPVIRGMESNRVLLVVDGVRMNNAIYRKGHLQSAITVTPNMLEKTEVVFGPSSVIYGSDALGGVIHYYTKTPKLSEEEEVESQLFSRFSSINNEITTNISVEVRSQKWASLTSVSYSDFGDLKAGKKRTHGFEDWGKVFFYSENSNGNYKENPTVNLDPNLQRNTGYNQTDILQKFFIPITKNTDIKLNFQYSTSSNIPRFDRLMELKNEQLKFAEWFYGPQKRFLASAQVLLNPNTKGMESGVITAAYQNVQESRIQRKFGSLDRSYREERVAVYSLNGDFSVSLTADKTQAFSYGFEFAYNDVNSNAYGKELNIVAGEIEGFSKSFKVQSRYPDGGSSYLSSAVYIDYRQDINSKSTLNSGIRFTNTNLTATWVDQTFIQLSDANIQLNHSAVTATLGYVYKPNKNWQINSVVSSGFRAPNVDDVGRVREKAGNVTVPNITVTPEFAYSAEIGVQKYFNEKKFRLGANIYYTLLNNYIQRDFVYNADDSIVQVAFDGEFGNAVSNQNKNTAYITGITASYLGRISAVWKTSGFVTYTKGRTYDTQEPMSSIPPIFGQFEMSYTIAEIEIGSVIRFNAKKEITNFNITEGIDNHDLTPIVVKNAVDEFVKYYGTPSWITLGLNANYAVSDIISIQARLDNLLDQHFIEFASGVASPGRNLSLSLRANF

SEQ ID NO: 14273 - protein, 693 aa, Listonella anguillarum serovar O2
MKPMDMNNGNGKAVRNINKTQLATLIGILCVSTSANVVAEQLEKKEPQKKQDTVVVVGEKLGGTLAENTSSLTLFTDEVDDGESRDYYDLLDRVPNVLNAPSGIPHIRGVDGRGPGEGFLTFMTGATPRVNTTVDGVSESWSGEAFGKAGLWDTEQVEVYKGPQSTNQGRNSIAGAVVIKTKDPTFHREGKVRAGYENEDSKYHLAGVVSAPLVEDTLAFRLAAEGTKGNTPIDYSLPNGDQYPWDPSELESYNVRGKLLWKPQGNDKLTAKLTVGSRNEEGQYTNFVTKPGTLELHSKSGTRRQETKSWNINLDVNYVINDELTTDILVAHRNYTTKFKAYPDTNWYGDVDEDNYTAEAKLTYQSLDEKYNAILGLASFFKDQYTETDSLKRKDEVLTNSIYFDSRIRLDNRWQLLLGARYERDELKRDFDHATLPLDFKADEDDGILLPKIGLLLDVSDHSTLGLTARKGYNAGGLGYNEYKEEVFVFEQEKVWSYELSSRSSFLDDKLDLTANLFYNDYKNYQTSVSGDSGKRFDTYITNIPKGKTYGTEVEASYWFDSGLDLFAFVGLLKTDISEGPTGTSTNLSGNEFSYAPKLSAGAGFTQHLDSGLFFGARVNHVSDYYTDLANTESKTAGDYTVFNLNAGYTLNDLTIRAYVKNVTDEEYVIRQKSDLYEVGGPRTFGIVADYQF

SEQ ID NO: 14274 - protein, 409 aa, Pseudomonas syringae
MKKTSLWVGGCLCLLFTPVVHAEFIADSKAELTLRNFYFDRDYKQDPYPYTAARDWAQGVIFKGQSGYTDGPVGFGVDVLAMAGFNLMGNRADDYARSGLLPVNSDNSRDDYYGKVGITGKAKYRNNELFVGDLVPLLPTIFSSPARLFPQTYRGVRFLSTEIPKFQLEGFYVDEVRQRDSIRFTDVGTDNINRRFDRAATTDYFYTLGGAYQVNDAYRVRAYQAELHNIYQQQFLGFNGKQPLNQQLNFLSDVRFFNSEDAGTKKIGEVDNRHLSGLFGLNYQNHTISLGYMQSFGATGLPFLSGTESPVVLDFMSSDYSNKDEKVYSVRYEYEFKNVNVGDISLNGLRFMTRYAKGEDINLLNYGDQRFKEESMEVELGYRIPEGKFRRLKDYVGAFLTTVMICQRL

SEQ ID NO: 14275 - protein, 202 aa, Mariprofundus ferrooxydans PV-1
NTQGGLRFNKTLDKHFFGANVTVFQTNIDDYIADKYQDATQTYLIYNIGDVEIKGFEASASYGYDKFNSKLSYSQSDTKNKNTGGPVAGGNGRSIDMGDSIALTLDYQSDSLETIFGWTSMFVLEEDNVFDGQPAKDSYDVHNLYAQWVPSNVDGLSVTFGIDNIFDEVYTSHASRSGTVRGFTLDDYEPGRNFKLSAAYQF

SEQ ID NO: 14276 - protein, 966 aa, Mariprofundus ferrooxydans PV-1
MMAAVHLNYRVCDIQTPLSPGLARPRSPRLPKTDARAALQQSQMSPRRAEAYWGKRMVISQTLRRAALLAGASTLSLVLALPAAAQTAPAPQDGVTIDELVVTAQRREEKLQDVPIAVSAFSNDMLSRQKIDGGPNLQLAIPNVTFAKSFYSGYNFQIRGIGTKQTAVTGDSSTGVHFNGAPLTSNRLFEAEFFDVERVEVLRGPQGTLYGRNATGGVVNVLSAKPTGEFEGMVRAEVSNYDGRKLRGMVNIPLVADKLDLRLAGATLNRGGFVDNLGTGDKVDDRDLYSFRASLRWRPTSTIDANFVWQHFKERDSRLRTGKGLCTRDNGPSSVGGTAITNATVRGFLSAGCADASVYNAAAYGTPNSLATLYGIIGFARGLTSGDVYGGTQPKGLDVIDSAKNPYYRAEEDVFTLNVAWDINDKLQLNSLTSYYDGELDARQEMNRFQASTVFNSTTLAPGGLVNDPQLGASNRMSVSDRITTPSRQWSQELRLQSSFDGPFNFSLGGLALRYDVVQSFYIMSNAFTYAAMVANGGANCAPGGSCVYIDPNRVPTGQGHGNYLSFQPYHLDSNALFGEVYYEATPELKFTVGLRYTDDKKTLDNFPVKLLTPGSGLTPGTPPQLTAEFKKFTGRAGFDWKPDLGFTDDTLVYAFYSRGYKGGGPNNIGQVATLRPFYEPEYVNAFEVGTKNTLLGGALVLNGSAFFYDYKGYQISKFVNRISVTENIDAEIKGVELEAVWEPVKRFRMNGTVGLLDTKIKNGESIDPMNRTGGNPNLTLVKTSGAAGCVVPTAALANLLAVIQQAPGAATVTGVSGNPSALLGACSGSFATSFGVTPTDGVAAKLKGNELPGSPNWTASIGAQYSFDVLDGWEGTVRGDYYRQGDSYARVFNTSVDQLKGWANANLSFRLVNDERGLEIEGYVKNVFNKRAITDVFLMDEALGQVANAVFTEPRIIGVSLQKTF

SEQ ID NO: 14277 - protein, 145 aa, Mariprofundus ferrooxydans PV-1
MEYYVGAAIGYKLSDFRFELDSSFQSFLEKKTNHTYVVRGGKRFKEIISLITNVYYDFDVDFPLKPYIGRGLGYYQSRGHTQWQRLDMFLSSRLRFKNKGLVWQAIAGLKYSLCRNTELGIEYRLLQQERYPVLQRIGLTLTRYF

SEQ ID NO: 14278 - protein, 274 aa, Mariprofundus ferrooxydans PV-1
MKRICFALLAACLCASAHAQHAGDNVAVLGWFHVMPQDSSTPLTTHVAPTPINTPLRLPSSFTSAGTSLSTKSADTVGLVFSHYLTDHIAVTTVAGVPPVFKIYGHGVIKPPGPAGALGQQDLGDPQSNPIVKSVRQWSPALLFQYYFNAPTAKFRPFVGVGVSYNWFSDIQLSPNFIQSTQNNLGAVLAAGAGKPGQTQVSAKASSSWAPVFNAGLAYNITDHWGLVASVTYIPLKTTSSVIIKAADGTELGVSKAELKADPIISFLAVSYKF

SEQ ID NO: 14279 - protein, 1043 aa, Mariprofundus ferrooxydans PV-1
MKVMVLVKKTISLAVSSALSLMTLVTQSATAADYEKIDLSSPEGESLSLDEASVDYTGRGPAVRVSGAQNQLQGQGYDIRATADSPNSAVVGVQVDAGGKAELSGVTISTGGSDFATGAQATGAGSQLTLNDVQITTSGNQSCGVVASAGGQVQVAGGSITTSGNQADVLSASGKGSSILASDLTLTATSTGSVNAVSVADGAAIELQRVSIQSSGFIGAVAVEGVGSSLSADGVDITAENGRGIGVTSAALTFRNGSINAKGDGITLSSLYQKPGGTAVVSHSRITSQNGNGINVNADQAAADLDSVQVTALGDYGVAIWMPGSNTRVDVKDSILQTRGQSAVAIDNRGGVFTMDGGSISTLGDNSHALYASPDTTNSPGAVFNVSRVLIETSGRGSVGALARMAGASISLSNSSIVTHGDLGYGLFASGRGASVELQDSDVQTAGEQAHGLAISNNATTRFQGSTVVTNGSNAHGIVSFATGAGVVNDVEVTSSHIQTEDGAGILVNGGGLTTRFTDSSLVGRSGGEQGTALWITDRASGVLAGAVQLDAVRSNLFGDVLVDGGSLQLSLSDHSSLDGAIKGGSRDTQLSLDDSSVWTLRGDSQLTRLANNGVVEFADPGLAGAFKQLQVSGDLEGDGHYIMNTDLGLQQGDRLIVGGQVTGNNDILVRNSGSEPGAEGQSLTLVQSAGGPGSFSLANRGGVVDAGTYRYGLAADAQGNWNLVNVGRIQPAPGPDNLSTGASAAVNSSAIATLRATWDAERATLVQRLGDLRQGADRQGVWIRGFGQQQSLDNGVGRTFSQQVQGTQLGMDTRLDTAGGTLVLGALAGYSQTDRNFKGEGSGKLDSYHLGGYATYLDDSGWYTDTLLTLNRWSTRLDVWGTDGAKVSGHSRSKGAGLSVEAGKQIDLGNRWFVEPQAQVSMLYARSDNYRLDNGLQVQPGDGLSTQIRTGARAGRNLQLEDGTRLQPYLKAGWVEDLSAQNKVRTNGIASRPDGNGGGWYAGVGVTGELSRQHQVYAEVETSEGSNIDRPWAANLGYRFTF

SEQ ID NO: 14280 - protein, 712 aa, Mariprofundus ferrooxydans PV-1
MIFISITLRSLSPLMHHPGALNRQGSFVMKVSSCLFNSLLLSAGVGLLAPLAQAGDAVEEAKPASLELDTAFVTATGGATDLKDAPASVSVITREEIERQPVYDLNTLLRRVPGVTGGFGPVGEQSKIKLRGLDDKYTLILVDGKRVGSSADLSYRRDLARQDLNWISPNMIERIEIVRGPMSSLYGSDAMGGVINIITRKVSRTWTGSASTNITVPKDSDRGQTTQYSMNAAGPLTESLGLRLGANVTRRAADEVEARRDAQGDFMYDDGAGGSKDQSVNALLDWQINQEQSLSFEAVHGVEHSWASKKTFGDWNETVGGAFGPSRLTRDSYILSHTGDWSFGTSKLDAYLNKYRNDLDLGKANSEEKIVEGSLNIPFQLLLDQRLTLGGQWKREELTNTDTLGTVPVDYQGAPVSGSTLKGDYSAAFIEDELFLLDNLSLTLGNRFDHSDKYGNHNSPRAYVVYHPHPDWTVRGGVSKGFRAPSLKEGSAGAATESAGRGCGSLRPLGYVTGSCWMAGNPNLTPETSTNKEIGLSFDHDGWEAGLTYFHTDFTDKIEYGPLGQYQGRWWTMLENVDKARTRGWEGTARVPLGDSVNWRTNATYMLESKNLSTGEDLISSPKLSAFSALDWQVTDRLSTELSAQHVGKQRGLGNDFVQSYTTYDLTANLALTKWLTLNGGVQNLLDKDLRDGSTNFYVPGRAFFAGATTYF

SEQ ID NO: 14281 - protein, 398 aa, Mariprofundus ferrooxydans PV-1
MKLKGMAMAALLACTGSAYAQSAVTLYGVLDTSLEFANHVAPYSAAGFTANPGAGNNVFRVNSGGLSGSRWGLRGTEDLGGGLKSIFVLESGISVDNGTMQQSNRLFGRQAFVGISHNTYGQITLGRQYTSLFVAMANFMPTAYATQYEPAAFMAGNNFREDNTIAYTGVFGPVTALAHFSFGAGVPNLAIQGGASAFGGNGEVPGAFRRDSAFGGAFTYSAGPFGAAIAYDQWNPSVNNAAGVYQGTTATLKKASVAGSYAIGQVAKIMAGYRWGKVDNNGTGAQLQRDDYYWIGANYQVTPAVGLTLEYDYDNLKRDYFNNTHAPNPWQIAFVADYSFSKRTDVYLSAAYAKNAGLTLDAANTNQLATTGATGNSYILGTGQSSMVGVSLGLRHKF

SEQ ID NO: 14282 - protein, 739 aa, Mariprofundus ferrooxydans PV-1
MKKMIFAGCLMVGASVFAQAGETDSLKVVNLQEVQIVSTRATSKTPVAFTNVSKEELKKQNFGQDIPFLLSMTPSALTTSDAGAGIGYTTLRVRGTDGTRINITANGIPMNDAESHTLFWVNMPDFASSVKDIQVQRGAGTSTNGAGAFGASVNMQTEGISMQPYAEINASYGSFNAHKETVKFGTGLLKDHWAFDARLSNIGTDGYIDRASVDLYSFYAQGGYFADNTSVKFITFGGKEKTYHAWNYATKEEMKKYGRRFNSCGMYTDDDGHIRFYKDQTDNYLQMNYQLLLNHTFSAAWNLNAALHYTKGDGYYQEYKEDRSLKEYRLHPFMYDGKEVEKSDLIRQKKMDNHFGGGVFSVNYRNEKLDASLGGALNYYDGWHFGRVIWVKNYIGELLPDHEYYRNKAKKTDGNLYLKANYNLVAGLNAYADLQYRYINYKIHGDNDKYDYNTDGLQKLAVNDHFNFFNPKAGLNWDIDSNNRVYASFSVAQKEPTRNNYTDGNADEYPKAEKLYDYELGYTYRNTWLSAGVNFYYMDYKDQLVLTGELNEIGEAMARNVPDSYRTGVELMLGVKPCRWFQWDINGTLSKNRVKNFTEKLYEDEWKNPIEVEHGNTPIAFSPDFILNNRFSFSHKGFEAALQSQYVSKQYMSNAKQAEQTLDAYFVSNLNLAYTFQLRHVKSVTVGFTIYNLFNEKYENNGYAGSGYTLKDGKPERYNYAGYAAQAGTNVMGNISIRF

SEQ ID NO: 14283 - protein, 1108 aa, Mariprofundus ferrooxydans PV-1
MKHRHAIFRSRLGLALCFMLAGGAIIPQSSVLKAETSVTQQSRKITGTITDAKGEPLLGVNVVVKGTTNGTITDLDGKYVLEVEPNAILVISYIGYVTQQTPASGNVMNITLKEDTQNLDEVVVVGYGTQQKKDITGSVAVIDTEELLASSGSSATQQLQGKAAGVNIGTSGAPGSATMVRIRGINSINDNGPLYVIDGVSTRDQDLSSINPNDIESMQVLKDASSAAIYGAQAANGVILITTKKGTKTGQPRLTYDGYYGFSKTGKRYDVLNAYDRIDVEWQASKNNLDLTGASANGELPYHQQFGSTSDSWVNHLPNYMTVTGAGGSTSIDPSDYDQANNVVYAPVGDTNWWDEISQLGWMQNHQLSLSGGTDKGQYTMSMNYFDQQGTAIESYFTRYQARANSSYNVRPWLRFGENLTYSFSKNNGLSFSGTESNIYSWTYRASPYVPVYDYAGNYAGSLFAGTGNFQNPVAIHERNKDNYATTQRVFGNVYGEADLWTGLTFKTNFGIDYRNDYSYSMTKNNPEFSESGGQNNFYESNYFNYRWVWTNTLYFSRTFNEIHSLNILLGTEAIRDGLGRSLNARRYNYLFEDNTNTYTLDMGENNSQRTNSSTYNGEFALFGMFARADYGYKDKYLLTGIIRRDGVSRFSESNRYGVFPSISAGWRMSEEAFMEPSRDWLDDLKIRAGYGVTGNSEIPVATNFANLFTTSTSYTNYDMTGANNSETTGFRLSTYGNTDTKWEMTKMVNLGLDATFQNGKLSGSFEWYTKKTSNMLIQAAYTSMAGESGSPYINFGDIKNTGFDFMFNYRDRKGDWAWDLSLNLSHYKNEVLKLAEADDYSLWASGTRIEGYVTRTTKGHAVSEFWGLKQNGFYESVADVMATKPFGQSDITEADAAAYVGRFRFEDLNGDGKLDDSDRTFIGSPHPDLTGGLNATLTWKNWDFTMFWNFSIGNDLYNNTKYFTDFWTFNGNKSSRLRDQSWTLNGDNSNAILPMLNTEDNYSGAYSSSYYVEDASFLRLKNLVLGYSLPKELLKKAGIQNLRLYLQAENILTITGYTGLDPEFTNAYLRQSDSDNDGAGRVDLKRGVDMGGWPTTMRFLLGVNFTF

SEQ ID NO: 14284 - protein, 379 aa, Mariprofundus ferrooxydans PV-1
MQASARLLLCGALCAVSGAAAAQSSVTLYGIIDTGIEYVSHANAAGKSVFRMPSVTGELPSRWGLRGNEDLGGGYSAVFTLESGFNVRAGDLGQGGRLFGRQAFVGIKSPYGTVSFGRQYTMTYLALMGADLIGPDIYGLGSLDAYVPNARADNSVVYLGSYAGVTLGANYSFGRDSAGTGNSPGQGTCTGSVAGQATQCREWSVMLKYDAPLFGVAASYEEQRGGSTAAANFFDGIAPTPLTRAADKDIRTHVSAYANLGKAKLGLGWLNRRVEPGADTIASVRSNLFFVAASYNVTPAFIVDGEVYHITNSEHDTRATMGTLRTTYLLSKRTAVYAQGSYLANSAKAHYSVSGGGGGTTPTAGTGQTGAMVGIRHSF

SEQ ID NO: 14285 - protein, 189 aa, Mariprofundus ferrooxydans PV-1
MKKIVFILALWVSLSGAFEPKKSHIYFGAMVGLAPIKITPKPASDSSYTAFLWGAKGGYQFAFFKALALRGEFSYLMAIKPTALHTINTSLLSLNIDVLSDFYTYKKYSFGVYGGLGIGYFYQSNHLGMKNSSFMGYNGLFNVGLGSTIDRYHRIELGAKIPFSKTRNSFKNSYFLESVFIHAAYSYMF

SEQ ID NO: 14286 - protein, 926 aa, Mariprofundus ferrooxydans PV-1
MMKRVIFVFYLFFLGNLAMAQQDTTKISISFNEISIESVFAKIEESTHYQFYYLNDWLVDKSASGNFKEATLNQILDKLFKDTSLNFYVLNDKKVILSKNNIIYDELPGGFFKKGIQDTLITISEAPQENIFTPVFYGQNSTDEILEVETVRIGKESLRNGQKNYRLSGYIKNLETGRPIRDLTLLVRNGKIGTVTNVDGYYEIDLPPGLNILETKALGVKSQQKRVIIYSDGQLDFDLEEGIEQLDEVVVEADQRKNVEEEITGTTIIVAEESKDIPLVLGERNILSVATKLPGITNAGEGATGLNVRGGKTDQNLVLLDNSVIYNPTHFFGIFQALNPFVTKGVQIYKGNIPVEFGGRLSSVFDISTIDGNKEKFTGEASIGPVTSNIALQIPIVEEKSSLVIGGRGAYSDWILRSLENEDLKNSEASFYDVIANYTHEIDENNSIKATGHYSKDSFSITTDSLHQYSNRLFSLEWNHRFNEKNSGHLLFNNSEYAFEIDYDGLSNNDFNLGYSIDETELKLKLNYLPDSLHTIDYGLSAKLYSIKPGYIEPLGSESVINSSSIPKERGLEAAIFLGDNFQVTEKLGLSAGIRYSLFAALGESEQRNYIADQPKNEGTFLGTTSYGKNEVIETYGGPEIRASARYLFTPDFSVKASYNSMYQYIHTLSNTTTVSPIDTWKLSDSNIEPQKGSQYSLGFFKNFDDNNYELSLEGYYKKSTDILDFKTGAQLLLNDQIETEVLQGEGRAYGLEFLLRKNSGRINGWLGYTYSRSEIRFDGQFAEERINEGAYFPSNYDKPHDLSLVANYKFTRRYSASVNFSYQTGRPITYPIGQYNFRDSEYVFYSNRNEFRIPDYYRLDIGINIEGNHKIKKFAHSFWNVSVYNVLGRANPYSVFFVSEQGEVKAYKSSIFSIPIPSITYNFKF

SEQ ID NO: 14287 - protein, 1126 aa, Roseovarius sp. HTCC2601
MKSIKKKRSMASHRKLHFQKVLGSMIVALALLFAGSAGAQETKTIKGMVRDVTGEPLIGASVIEKGTNNGVITDVDGNFTLTVPADATLSIAYMGYATREIHLAKRKKQGDLRVTLREDSQQLKEVVVTAMGIKKDTKRLGYAVSTIESDEIVKAGATNFASAMYGKAPGIRITQTQGGSAGAVSINVRGLTSITGNNQPLIILDGVPIRNGGTGKSTDFAEFGNDGQIRSNGLVDINPEDIESVSVLKGASATALYGSEAANGAVVITSKRAKSGKLTVDFTAQVTANLPAYLPKVQTVYGPGRYNTEYSDYEKQTGGFYQRTMNGESYRSLYNTTMSFGPKYDGSDVLYWDGKMRPYLPATDNPWKELFRTGWNQTYNLAISQGTETSSNRFSYTFMGETPNSLTGSFTKHNFKLTGSYKPARTLNIEYSLNYIVQDVKDRPQTSLNLYGSFSNMFSSFMDIPYLKQSYVTSLGYRNTYAGGDATLTPDEAWAYDPGYLNGVSNMLWNMYHHHSKETENRLIGMIRPTWQITNWLSLRAQLSTDITDTKQTLEYETERPNSLYDPSGSFQNINRRYDIVYGDVMLNFNYNIRRFDIAATLGWTGRYENMNNMRVSTNGGLVTENWFDLNASRYTASSTLQRMELLKTGYMGTLSLGWDNYLFLELTGRQERSSTLKDQSFFYPSANLSFLFSNAFRMPAWWNHGKLRLSYGVVGNAPETYAANIIYEQGSDNGFTWNYVPSSWGNANIRPEKKYEYEIGFESKFLNNRLGFDVSYYNNRVKDQILSTPQPSTSGVKYVLMNVGEVANEGWDISVSATPVLTKNFRWDLTANYGIYRNKVVKLADGVPYLEISNIGGGGAKIQAVEGRPMGDIYVQVPQMNENGEYLVSDKGLYMNQTELQKVGNINPDGVGGLFSSFSYKNIFLDFSIDFRIGGDVINEMYQYSTASGLTPESLQFRDTEHGGLSYYYPGNNNASGVPVQVDPSLGAGPNGETVYHDGVILPGVVASTGEKNTRIIPAGYYYNQTYNWGTQPEQLTYRHSVFDNSYVKLRELTIGYQFPEKLISKLGMTRLSVSVFGRNLFYFYKALKNYDAESSVGTSWASQAVVGGSTTATRNFGVSLRASF

SEQ ID NO: 14288 - protein, 739 aa, Roseovarius sp. HTCC2601
MKFLIGAFAMLFIIPLYGQSITGVVLDTNSSPLEDVNIFNKTSGQHSHTNTTGYFAIPNTKKGDSLYFSRIGHETLLEVIKDQQTSLQVILTPSSVSLDQIVIVSEVDQLSRIVDIDVKNNPVKSSQEILRKVPGLIIGQHAGGGKAEQIFLRGFDIDHGTDLALSVDGLPVNMVSHAHGQGYSDLHFVIPETINNIEFGKGPFTASQGNFATAGYIDLKLKDVLEKIQVTLEVGQFNTQRFTGLFPVINSEYNSLYLASEVYLTDGPVNSPQNFNRINLMSKYVYDRPGEEKLDLTVSHFQSKWDASGQIPQRAVDAGLIDRFGAIDDTEGGNTSRSNVSLSYTKNLNENDSFTTNAFLSKYDFELFSNFTFFLEDPINGDQIKQYEDRLLMGVNSTFERKGKELASFDLDYQAGAGFRYDDVNDVELSRTKNRRETLERLSYGDVDELNAFAFFNAKFKKGNWNINPSLRLDYFKFDYNNKLSPVYDNRSENKVAVSPKLNVIYTPSSTFQYFLKTGVGFHSNDTRVVVANEGEDILPAAYGIDIGTIIKPASRLVVNAALWSLFLDQEFVYVGDAGIVEPSGRSRRVGVELGARYQFNDWLYAYSDVNYTYARSTDEPDGADLIPLAPDFTAVGGINVDNLGAFSGSLAYRYIDDRAANEDNSIIAEGYFITDMNLNYKVNNWTYGIIIENLFDTEWNETQFATESRLFNEPAPVEEIHFTPGTPFFIRGKIAVTF

SEQ ID NO: 14289 - protein, 933 aa, Roseovarius sp. HTCC2601
EQLEQINVLGSDNNNDNTPPKIAETVKTASQLKRQQVQDSRDLVRYETGVTVVEAGRFGSSGYAIRGVDENRVAITVDGLHQAETLSSQGFKELFEGYGNFNNTRNSVEIETLKVAKIAKGADSVKVGSGSLGGAVLFETKDARDFLTEKDWHIGYKAGYSTADNQGLNAVTLAGRYQMFDALIMHSKRHGHELENYDYKNGRDIQGKEREKADPYTITKESTLVKFSFSPTENHRFTVASDTYLQHSRGHDFSYNLVKTTYINKDEEELRHTNDLTKRKNVSFTYENYTVTPFWDTLKLSYSQQRITTRARTEDYCDGNEKCDSYKNPLGLQLKNGQIVDRNGDPVNLKSIDGQHQVVDKDGKPFSVASGTNNSAFAGKQLGSSEFWLDCSIFNCDVPVRVYRYRYSSEKPELEEVPLNRTMEINGKKFATYEPEQRSSSKYHMILPNSKGYLPLDYKERDLNTKTKQINLDLTKAFTLFEIENELSYGGVYAKTTKEMVNKAGYYGRNPTWWAERTLGKSLLNRLRTCKEDSSYNGLLCPRHEPKTSFLIPVETTTKSLYFADNIKLHNMLSVDLGYRYDDINYQPEYIPGVTPKIADDMVKGIFIPLPKKNYHTQEEIRKNAEENIAYIAQEKRFKKHSYSLGAMFDPLNFLRVQVKYSKGFRAPTSDELYFTFKHPDFTILPNPVLKPEEAKNQEIALTVHDNWGFVSTSVFQTKYRHFIDLAYLGSRNLSNSEGGQAQARDFQVYQNVNVDNAKVKGLEINARLNLGQFWHVLDGFNTSYKFTYQRGRLDGDRPMNAIQPKTSVFGLGYDHKENKFGADLYITRVSEKKAKDTYNMFYKEQGYKDSAVRWRSDDYTLVDFVTYIKPVKNVTLQFGVYNLTDRKYLTWESARSIKPFGTSNLINQGTGAGINRFYSPGRNYKLSAEITF

SEQ ID NO: 14290 - protein, 472 aa, Roseovarius sp. HTCC2601
MFSKLLIGLTALVALSGVSPAFATNGMNLEGYGAKSHALGGASMAFDTGNSAVMNNPATLGMMKEGKEEIGIGIRGLHPDVSLSYGPMTENSEGTGYYMPSLSYMRKDGNIAWGVAMLAQGGMGTEYGDDSPLFMFGRSYGNSLVPLSGKEIRSEVGVGRVMFPLAWNITDNTTIGLSLDFIWASMDLQMDMDGKHFKGMTQGVGGSVSGTMYNTLGSMMQSGGVTDINYMRYDFTNGSPFIGEAAGFGTGFKIGMVHRFSKMLTVGGSYHSRTWISDLETSGASLSFSGVDAMNNTFTQSVSGTIKVRDFEWPAVFAAGFALYPGDRWMIVGDIKQIDWSSSMSKFSTTFTADSSPSNGPFIGKRLDVDMQQEWKDQTVFSIGAQYKATERLSLRAGASFATNPVPDDYLNPLFPAITTNHYTAGFGYRLSDKSSFATAVAWAPEVSATNADGMVIRHGQMNWSLNFTHEL

SEQ ID NO: 14291 - protein, 960 aa, Roseovarius sp. HTCC2601
MASTCAFAQSTDAGAAATTAQTPPTTAGSGDAVTQLDTVTVSGYRRSIQFSTDAKRDSVGFADTVFAEDIGKFPDMNIAESLNRIPGVQLSRDVNGEGLNIAIRGLGTSFTKTTLNGASIATASIGLNAQNQNREVDLNLFPTEFFTQLTVSKTPTASMLEGGVSGVVDMRSARPFDRPGVHVTYQAQADWNSTSEKTTPRGAVMGSWTNEQGTFGALFGVASVRSKLGVEGFESVGWTNPGLTYTQCGLTPPAGTPATNQPTACNVNGGGNWRIPDRVPATAGSGLTTGETIDAAWLLARNPGLSIDQISDALIPRLGRSVYMTGDRDRDASVMSLEWRPSDSMHFYLDTLYSEAKRTTERISMNLIGRNGNMIPLGMQLDQNNVVTSATFANAQYFLEARPYREEVKFWSVNPGAELLFGENQDIKLNVQANATRSWLARESPSILVTSPFTTVDYRNEGGDRPSISSPLDLNDPNLGWGWAGGRVNIQNEKRVTQTRGARADLQFGEDKRNIKIGTSYDQAERTIRGFDNSTAWEQVICRGGGGNVCNGGPGSAIPNTALSSYLRPGPGGFITADFNRFLGDTNYYALRDSAPETNSANTGASAGGIREKNLGFYIETNAETEVWNRTLRLNAGVRYVTTDQTITGPVTINGIRQVQVLDSDYKETLPSFNVAWDVADNVVMRLSSSRTLTRPDPSAMLPNTNFSDPSAQTATQGNPNLAPYLSTNVDFGGEWYTGGEGYVGLTLFNKRISGFTVNGVRRIPFNDLGVPYESLLPIQQAGLDQRGGPNAATVDVQTQVNADGVLNIRGTEAIWVQPLDKLVDGLGFSVNYTHVTQSSEGEGVPAVAVGVAPNLWNGTVYWEKNAASVRLSYTWNDDMVISGANQNGIPYARLNADARGQLDLSASYALDWLPSKPQITLNVTNLTDEPLRTTYAWPNATYDLYQPGRTVMLGIRGTF

SEQ ID NO: 14292 - protein, 1037 aa, Roseovarius sp. HTCC2601
MKHVLIQERKSLFLFLRYLLLLFVMPTELIAQSITISGTVTDSNKEAVIGANVLLKGTSTGTITDVEGKYQLTVPENGTLVFSSVGYTSQEIAVNKRRIINVTLSDDIMLIDEVVVVGYGTVRKSDLTGSVGKVTTSELNQLSTTDIGQAIAGRVAGVDVTSNSGAPGAGTKIRVRGYGTINSSDPLYVVDGFPVSDIDYLSPQDIESLEILKDASATAIYGSRGANGVVLIKTKGGQYNSKTSINATAYISMAKTTKHMDLLNAWEFATLKKELAANSNTPLSARDEAMYNYVIDNKYEGTNWEDEVSRTGYSQNYNLDINGGTDRQTFSIGATYAKQEGVLKYNSMDILTGRINNTYKLPLDLTLGINAVYSHRSSKGGNGDGNYFGSIWPAVMRADPMIPAWDEYNDNWGEILFSDPSYHPARSIYLGSDKYGHSISNMFVGNFTLQMDNIAKVKGLSFRTQYGIRANFNESKRYTPVWYVASNQNNTNSSLTMSRNNFTSWLWNGYLMYNRVIGKHSINSTLGAEIQDFRYSTLSGTAADVPENPNLWYIDNSLTQSSKTSSNSMPTISRMASYFGRINYTFASKYLLTVTGRYDGTSKFADSQKWGFFPSFSLGWNAHEEEFLKDKTPFEQLKVRMGWGQVGNEASAAQFGYISLMNSSYRAVIGDQLQQGEIQRTFANSELAWETAEQVNFGIDFGTLNMRLTGTIDYFVRTTKDMILRTPIPLYVGMGRANTNAGSMRNKGLEVTLRWNDKIGKDFSYSISANASFVKNKVLSLGSPDPIYGGGVARKAENFTRTEVGREMAYFYGYKTDGIFQNWDEINNYKTPDGQLIQPNAAPGDVKFLKTANDGLPLNPEDRTYLGSGMPDATFGLNLTANYKGFDFSMFMQSCVGNEIANALVMDIYSSEFGQWNMSKKMMNRWHGEGTTNVYPRLIASDPNENARFSDRYVEDGSYLRMKNLQLGYTLPSTFTKKFNVSKLRIYGSIDNVFVLTKYSGFDPEMGDLLGNPLSIGVDLASYPRPRTFVLGFNISL

SEQ ID NO: 14293 - protein, 710 aa, Roseovarius sp. HTCC2601
MPPHHPRLPLSLLSLGLALQCPSVLAEDSVVLAPLQVSDTYANDGYQVRQAAVAGFQPAPLLDTPASISVFSQQLLEDRQVRKLSEVLQSDASVGESYAPIGYYENFNVRGFELNAASSYRINGQTIAGEQNVALENKQQVELLKGLSGLQTGVSEPGGLINYVTKRAQDIRSVTVSTNEQGERYLATDLGGWFGSEKQFGLRANLAHEDIRTYVDHADGKRDFASLAFDWQINPDATLQLDAEYQHREQSSVPGYQLLGGTEVPHGVDPEDRLAYQHWAKPVQNDSLNLGGRFEYRLNDTWTGTVSASRSKVVIDDYSAFAWGSSEGAFFGSNGDYDIYDFRSPDDTRRTDEAQAMLNGHFDALGVGHELTVGTSAQRRTLDQRPYYNEWLGTGNIHTGAPDLDPSDKPVGASERRLDSRQYGLFVSDRISFNEQWQTVLGAREVRLDEKTWDENGVAGRHTRQYELLPNAALIYKPQPNTTVYASYAKGLSAGGTAPWFASNAAEILAPTTSRQLELGLKHDWQGLSLSAALFQIRQAYQYARPDGTGNFTYVQQGQQKNTGLELGASGRVTPNLQVQASAAAIRARVQNSGTEAYEGHQAINVPKFRAALHAEYALPVPGLALLGGARYSASKYASQAGNVEVGGYTVFDLGSRYSTRVGGYDTVLRLTVDNVLDKRYWRDVGDYLGDNYLFQGAPRTARLSASISF

SEQ ID NO: 14294 - protein, 922 aa, Roseovarius sp. HTCC2601
MKPQMKLSALTLAITMAALAPSSLLAAEDSAATDGANSKIEKIEVTGSRIKRADFEGVAPVTVITADDIANSGLSSISEVLQSSVANNGGSLNGDSDGFTDSASSVNLRGMGANRTLVLINGRRQASFPSAAGGTSNFVDTSDIPTAAVERIEILTGGASAIYGSDAVGGVVNIILKKQYDGAKVEAKYSDTTQGGGEQFDLSYLQGINTENSQSLIMLEYKQVGAIQTYQRDDLYSPAYYEDEDGDIRWGSGPYGDSFPSSWASWIRDYSKVYTDDKYSPVDEAQCTNLFGDKGVYVEAGTYDCYYDKYADRGLQSEYDRINLVVNSTYDLNDDWQIYGMLNASYKESTKYKDEKGFGDYFYQDEATGAMSYDKYEFEDYNKFQMRRRMEEYPGPRTYDTQNTKASLAFGANGTIGDYELDISWSSGYALYEKQNHHMVRADALLGMVTFDPNDTDASKWYPNNQLTTEQAEALIGDSTKKSDSSMHQLQAVFTGDLMELEAGTVGFATTAEWARESYEDTLDETTMNGGFIGMGGTGGKGDRDRVAVAGELQVPLLADMTGVKSLDLSAALRYDQYLDDSDVGGATTPQVGLSYRPIDEVMVRANWGKSFRAPDMHRLYSGLTRSFGGTEYPHPTIPDEIYEDDYDGFNSGNLNLTEEKGEFWNLGFVANVTDNADLTLDWWNIELEGAVKTISTDEMLEDPSYIKNGQYTDCATMPEVGYLTEFDDDGIENIACMRKGPINSAYEASEGIDASFNYLFPETAAGEFKFKLAASYLLKKEYQEREGDEIEEQTETDYFPKWKGNASLSWSYEDFTATIAYYYTGEAVGTDLFEYVDENGDDVESMETDTLDPYQIINITLSYYAPWEGKFTAGVKNLTDEMPPLYDIRNDEHNDWPYYQDDNSSYSAKGRSLFLGYSQKF

SEQ ID NO: 14295 - protein, 881 aa, Roseovarius sp. HTCC2601
MALASQSLRITGPTKRWSGLVSKPMSRTLITGLLATSALCAPMVALAQDATTVDAVVITGQREAQRAAIVVKREAFVVSDVVSADDIGKLPDHNTAAALRRIPGISVMEDQGEPRFPVIRGLRSTYNRTTIDGALVASVDESGRTVPMDIVPSVMAGRLEVIKTVTPENDGNAIGGVINVTTRSAFDAKRPFFNGMASYGQYERSGDVRNDKPSYRLAFAAGRTFGAEDQWGVVIGASHEQLDYDIPQVEAADPSVREYTAAGAPVLSGSPTGNGLQVPTQVRLFWYNNTKQRSGVNAKLEYRPSDAFRWDASVLASRMEDDEERIEYRIEPLGNVANQTPTSGAFTRGRGIIHLNQPITTREIGLARTGFAWSFAPNWKLDGDLVYSLAGLKVPNHSVEFRTVDAQGANYAFTYDTTNRLFPTFNPVNEAALRNPANYVLQQHRDALTKTNESTTQARLDLAFDDDAHWKLKFGGVLRSSERDFRNSQVNYRAATGFVYTLAEVDKAGPSQLIAGRYRLDPRIDAEAATAFFRANRGRFTTTVSAPTGNYDVSEDVQAGYAQASYQFGDLTLLGGLRYERTKVTSDAVRNTGGVLTPVSNDGSYANWLPSLHLQWKPRPDLIVRAAWTNTIGRPDYGSLAATENLNFDGSQPTLSRGNPDLKARESESFDLSVEFYPTDGMVSLAVFSKDIKNEIFTLSSSERLDVGRGVETVLISTPRNAETAKIKGVEFAVQQAFTFLPAPLDGFGFNGNVTWLDTEFTFRTSTGPRVTGLFQQPEITTNAAVYYQRGPFEARVSHNYIGGQLETINDANVNSDQYWKGRHVFDASLSWRWNKHLSLFVEGQNLSNTGRQEVTGPGRRYLQEWANYGRTYWVGAAVNF

SEQ ID NO: 14296 - protein, 354 aa, Fulvimarina pelagi HTCC2506
MKKTLLTTAIISSLTLYSFTALADGPEFYGHADLAITNSDTGYATQNQKDGTVLENNFSWLGVKGSEAVSPYFDIIYQMEFGVENFDNSNKTFNARNTFLGIRSAAGTALVGRNDTVFKSAEGSFDLFGNTNADIDLLVAGQTRSADGISYYSPKIADLVTLNATYLMSDNYDQVDNNGDEVYSKDHMYALSATLGDKAFKAQNYYVAAAYSDGIDNVEAYRGVAQAKFGDVILGALYQHSEHVDDKFANLSGDTYFVNAAYLIGDLKLKMMYGKDDSGLGKYVSRYVGDQNNSGLEQVRDVDLQQFSVGADYRLSTKTMVYGHYTRFDGDLMLADVKQDLNDNVFTVGLRVDF

SEQ ID NO: 14297 - protein, 750 aa, Fulvimarina pelagi HTCC2506
MKAFILKKRIAGMPTKLAVLIGVLCSGMAMPLLAEEPPTAVQPTTASSASEKETRGDTMTVVAKPGNTFRAGGDDLVPAYLDGQIANGGRLGFLGQQNARDVPFNVISYTDKMILSQQAETLADVVKNDASIQTLKGFGNFMETYRIRGFTLDGDDITFGGLYGVMPRQMVSTNMVERVEVFKGASAFVNGVSGSGIGSGVGGSINVEPKHATDDPLTRLTVDYESKNKIGGGVDVGRRFGDNDEFGVRVNVLHREGEGAIHHQKDRMSMASVGLDYRGDRFRTSLDAGYQHQTVHGGRIAVGTGSATVIPSAPDATLNYGQKWVSTDLKTTFGMWRSEYDVADNWTLYSGIGSSRADEYGVYGSPKLTDNNGNATISRMDVPFKRDTFSGLLGIRGQFDTGAVTHKVNIGYSGVYAKSRTAYTMSDNVGPIDIYHPGDISNPPSIYFGGDMGDPKVRNRVRSAGLSLSDTLSIMDDKVALTAGLRRQEIMVRNYSYEGIEESDSTFNRTKVTPAYGLVVKPWENISLYANHIESLSPGGIAPFNAANKGKVTGIYVAKQNEVGVKFDYERVGGSLALFEIKRPNEYINSQTGNFGIYGERRHRGMELNVFGEPVFGLRLNGSATWIAAQQIKTDGGANNGKDVVGVPRYQLVLGSEYDIKSVEGLTLSGTAIRSGSQYANNSNTMKLKPWTRLDLGARYSMPMNDHTLVWRANVENVTNEKYWSSVNDSGAYLYQGDPRSLKLSMSVDF

SEQ ID NO: 14298 - protein, 1118 aa, Fulvimarina pelagi HTCC2506
MREKRWLLCFLVAMCCTFSAWALPSQDKTVTLKLHNVSIETVLDAVKKQTGVNMLYNSQMFKGVPSVSLDVKNERWDTTLKLVLNPQGFDYVMKDGIVVIRKQKRENRVRGMVTDSHGEPIPGASIIVKGTRTGTSTNIEGEFTLDVKSDKVVLEVSFIGMKKQTVQVDATRRKTVEITLVDDVKTLEDVVVTGYSNVRKSSFTGSSTQISGDDLRKVSQTNIIGAIQSFDPSFRLVDNVQFGSDPNALPEMYIRGRSGFGVKELDKDQLSKSNLENNPNLPTFIMDGFEVSIEKVYDLDPTRIESLTVLKDAAATAMYGSRAANGVVVITTVAPKAGEVRVSYNFTGTLEMPDLRDYNLANASEKLEIERLAGLFDKGQANIPSTAVGMNNYYKKYALIQKGVDTDWMSIPLQNSFNHKHSIYLEGGTPNLRYGVDGSFNIADGVMKGTERNRYSAGFSLDYRIKNLQVRNYVSFGHTKSKESPYGSFSDFSGLQPYDSPYKDDGTLREKLTYSKISGRDNNNPLYEATLGNYNWNSYDEVIDNLSFNWYLNDYWTVKGQFSVTKKYSKSEKFIDPLSSKTSVTGSKDNNLAGDLYTTNGESLDWNSNAFLYYTRSFNKQHNLNVSAGWEAASGTTESTNAHYRGFPSGEFHSLNYAAEVYKKPTRTENTTRRVSVLASANYTWNDIYLVDASVRFDGSSEFGANQKWAPFFSGGLGVNIHNYDFFKSNGYINKLKLRASYGRTGKVNFPAYAATTMYETLFDEWYITGYGAVLKALGNKDLTWEKTDKLSVGIETKTFHDRLTVDFEYYYNKTIDLVNDVTLSQTSGFSTYKDNMGQVANKGVELKLRADIYRDRNWNVALWGNMAHNKNEILKISDSQKAYNERVAAYYKNEALYQETLGLSHGAEYSVPLPQYEEGASLTSIWAVRSLGIDPTTGKEIFLNRDGSIADKWNAAQEVVVGNTEPKCSGAFGLNLSYKNWTLFASFLYEWGGQEYNQTLVNNVENADLVNKNVDLRVLTDRWKKPGDIAQFKDIKDRGMTTLPTSRFVQDKALVRLNSLNVSYDFNRDWIKKHLRMNLLRLEASTSDLINWSSIKQERGLSYPRSWKVEFSLKAQF

SEQ ID NO: 14299 - protein, 705 aa, Fulvimarina pelagi HTCC2506
MGSRVFGMAAQTRRGLFIGTLMGGVSMAALCALPAIAQEEAAQEEAAQAAAEEEAVELAPVFVTASPLATPLDELATPVTVVSRDEVLSSPAATIGALLKDKPGITESSFAAGASRPIIRGLDNTRVRVQENGLGAGDVSAVSEDHGVPIDPLSAERVEVVRGPATLRYGSEAIGGVVNIINNRIPTELPKDGFEGEASVSYDTVNDGRRIYGEMNAGEGNVVFHLDSFARKTDDYRIPGAFDRQTNTWTETSGIAGGASVLLDADAFSGYAGAAVSYYDSNYGIPAGDPLDPIHIDMWQAKLQVASELDFNGGPFSKLALTGGYSDYTHGEIDSAGATGSRFDNEEWEARGELSHRAVGPFTGAIGIHARGRQLEAAGEGGELIAPSDTDAIAGFIFEEMPLAGEWFKLQASGRAEHVNVTGTALDTVTALEFDSERSFTPLSFAAGLVANAGNGWVFGLNAQRVERAPDALELYSKGPHEATETFEIGDPTLDKETAQTFELTAKRVGDDYSFEAAVFHTKFSDFIYKRLTGITCDDDFASCGVGTELDQVLFTQEDATFRGLEAAGRVTLARWGTARAGLSGQFDMVRAELDAGGDVPRIPPMRAGAGVFYADETVAGEFGFLHAFEQDRISANETETGSYTNLKGEIRYLVPSVMGGNAALEFALVGENLLDEDIRNHVSFKKNDVLQPGRNVRLVVTARF

SEQ ID NO: 14300 - protein, 431 aa, Fulvimarina pelagi HTCC2506
MKGFMQPRFALALLYCAMADSAFASGFLDDAKAEVLSRNFYLSNDYRSPSPAGKNYKQEWAQGFIGTFASGFTEGIVGVGLDAHAFYGLKLDGGKGHSGTGLLPVDSDGRSESEYSSAGGALKLKTSKTTLAFGEMTVETPVFDTSDKRLQPEYATGLLLDSHEIENARVVAGRFTAFKNQDRSSGKGDFQGYGASTQGESISFVGTDLFSDSPVGGALYASDLSDTWRQYYANLHFKQSGLLLDANVYHTRDTGQALAGDIDNTAFSLSGKYTFGAHAVMLGWQRINGDTPFDFVGGDSIYLANSIKYADFNGAHERSWQARYDLDLGAFGIPGLNFMTRYVSGSQIDGTHAPKGGAYNPFDADSGEYQPQQGDGGKHWERDIDLRYIVQSGAAKDLSVQLSHVSHRANSAQAGDDIDRIYVVIQYPLGF

SEQ ID NO: 14301 - protein, 446 aa, Fulvimarina pelagi HTCC2506
MNGFVTTARMCGVGVALSLVGCGAYAADMPTKAPIPYAGVDDFWTRPYLFGDLGRTKLKEQGISLALTLGDEAVTNLSGGSRNTSANAGQLWFQAKFDMAKLAGIPGGTIGITLVDRFGKNLNSEAGIPALQLTNEVFGRGNILRLTEFYYSQKLLGDRLELKGGRLPVGSDFFFGQCEFINLTFCGGQPGNIQGGYIYNWPVSQWAGVVHYNFTKEWKLSVGVYDANPNYLTTSDAGVYLAPGIPRSNPAAGVLVPVEVVWEPSGPLNGTWRFGGWYDSASSIDGGLPGIIGVVRGGPGVGDQNLSSQRGRYGFYESILQRLTVDGPKAQGWYTFLNTSVADHRTSYQDYQIAWGIKHTGTFSFRPEDEVGFAVGTTHVNSAALTPNAGGNEIPLEAWYGWQATGWMNIKFDAQYVINPGGRGFNGAGVKTNNAVVLGLRTVVHF

SEQ ID NO: 14302 - protein, 745 aa, Fulvimarina pelagi HTCC2506
MIDNALRIHGLFIMKLKFQKRKVLTVFIVFSMCGGGVVYANGSVPSVSNKYDLGTLTNDGSQYSYVNALSKDGRVVGGFVTPDGNDYIATIWSWNNLKDTINIGASFARSKVKALSADGSIAGGYQYIRIHESSSSANLEKKASNGKFLANDGVSATFIPVIWSGDSWENEVKLELGILESGVVNALSGDGKTIGGYGFSTHLVPIIWSGSHWKDIKHLDVPKEYYDAEVRALSTDGKVAGGYISSKNITRGILEGKSRNDTKNFTHAFIWSGDGFGIKTDLGTLNNNESEGAEVRALSADGKVAGGYFSMENGSVFYGAIWSGDQWTTKTQLGTLKSDNSGNSLVYALSADGKIATGFAESDSSIGRATVWLGDHWQTKIDLGTLKSDNSGYSISTALSADGTVAAGYSEVDSGKDHATVWKIIYPTQSQSESQPQSQPTVVKVDTVNTIGALSVLAAETFSVMDLQRQGLILLQQGCEIDDSQVCWSVRTGVVSTGSNRDSVVGFRFGYAMFETLSAGFSLDRSLSRSLQDSYLKNNYNLGAGFYAQWNAPFRGGEWYVRPAVAFNRYSVVVQRPLLTNTEAGTGYSRMKGRDVSLEAGQRFNADHSVLLGWHLGVRHSSVLRTAYSEQNAAFPFSYSAINNRRTSAYVGADVAVPLTARLKWMAGLEIDRRLYGDDPVYGGHADYIGGFAHQMVMKRVIGTISSGVEYRLSPTMFWGATFDVSRRALGDRTWSGTLSLGGRF

SEQ ID NO: 14303 - protein, 847 aa, Fulvimarina pelagi HTCC2506
MSPRSVRWRLMLSNSREESRRQECLMLRCHARRGVSVVAVQAALLASSSGAFAQSSSAVLPPVTVDAPAAVKPKPRKPAANTAAARNRSAKPAGERAAPAVASEQGAASARASLDPPAAVARYQLPQRSFSVTAKEVDETINLKDPEDAVKYMPSLFVRKRNDGDNQAVLATRSWGLNSSARTLVYYDDLLISALIGNNNTNSSPRWNLISPEAIGRVDYLNGPFAAAYPGNSIGGVLLITSKMPDKPFAVAKETVSVMPWNQYGTKDTYVTSQTSAAAGNRDGALSWLVSANYLDSFQQPLSYTTFGTTLGVGPAGTTGTIAAQNKAGGVANVVGTGALAHSQQTSGNLRLAYDITPLVQATYSFGIWNNHQTSDPQTYLRSTVTGLPTFGGVSSFANSKYTWDQIHVSNAVSLKSDTKGVFDFDLAASSYNYLQDIQVSPYTVSPSPGLGYSLNGKVTRMDGTNWQNADAKGIWRPLGYDGAHEVSFGIHGDRYRLENPVYASSVWYNTPSTGNGQLYSTGVGETRTGALWVQDAWKIIPTVKLTLGGRLESWQAVEGFNLNTMATSAGVITSVVPTWQPGLSSTNFSPKASLSFDPNKDWNITANFGEAYRYPTVTELYQNITVNGVTYLANPLLSPEQDFTGELNLERRWVDGRVRLTVFGERTNNALISQSTTVTDASGAQSVQTAISNVAAIRMQGVELSADKDNVLIAGLQVFGSVTYVDSRIISDPSWKGATTVVGKRVPYVPDWRAKFGVTYRPNENWAYTVAARYSGKQYSTLDNTDRISHVYGAFDNFFVVDLKMHYNATKNFAFDFGIDNLFNEQYFLFHPFPGRTFVLAGKYTF

SEQ ID NO: 14304 - protein, 818 aa, Fulvimarina pelagi HTCC2506
MEALEGKRISIKLNRRILMKSFFLILAFAFSSCHVFAQGVIRGKITNPVNNEPVAFANVLILNSELGAISDENGLYEITEVPTGLYNVRASFVGFKSKTVFEVQVTLARPVQLDFELVEDASELSEVVVSDEFSRSEETPLSVRKLNANEIERYPGGNRDISRVIQALPGVASTPSFRNDILIRGGAPNENKFFIDEIEVPVINHFATQGSSGGPVGILNVNLIKNVDLIAGGFPANRMDALSSFFEFQLKEGRRDKMATQLTVGASELTLSNEGPIGEKTTYLLSARRSYLQGLFKLIGLPFLPTFNDFQLKTTTKINEKTELTFIGVGAIDKFVLNEDVPDDESEEDRENRLYLLDVLPVQNQWNYATGVKLKRFRENGFWTFVLSRNMLNNHSVKYAGNDESSQDNLLYDYLSQESENKFRAENSIFKNGFTIKYGVNYEYSRYYIQNFDRSTLAATDEVINVESTSHFNLYGGFVSASKYFDDERLLITGGIRMDGADFGETAKNPLKQISPRVSFSYQLRPNLFATANAGIYYQKPAYTVLGYKDNEGELVNQQNDVRFIRNSQLIAGIEWLVPDKNRRFTAEAFYKKYSNYPSSIRNGISLANLGADFGVIGNEPVESNSEGRAYGLEILAQQRLFNDFYGIAALTLVRSEFTNPNTDGYIASSWDNRFIVSLTAGKRFGNNWEIGARWRFLGGTPYTPYDYEESSLISNWDLRNQPILDYTQINAVRLKGFHQLDLRLDKKYFFKKWNLNWYVDIQNAYNFKAEQPPLLVPVRDSEGNILVDPSDPTRYQLKYLNNPAGSILPTVGIIVEF

SEQ ID NO: 14305 - protein, 702 aa, Fulvimarina pelagi HTCC2506
MRFSRWFLQTCVMAFSSAAAAQTIDLPEVVVTSPNPIQTAPNSDEAGYPGATSQSIAAASSFTSVSVMTSQQGLTRGAASLGDALSTTPGVSSTTFSPVASRPVIRGLGGFRVRTQENGIGSHDMGNLGEDHAVTIDPLVAGRVEVIRGPGTLRYGSQAIGGVVSANNGRIPTVIPPNGVAFEARGGLNSVSGGKDGALLLDAGGGDFALHVDTFKRAAGDYRIPGGIQENSSYSSQGYSIGGSHLFKDGFVGVSYQSMATTYFIPGIDSAREKNHIDLRQSKWSSRGEWRLRESGIDTLRYWLGFTDYKHDEIDGLGAATNIGSTFRNRELESRVEVSHLPFSTAFGELTGAAGVQWGRRQLSVKGAQEELLSPARAENLAAFIFEELQLMPALRMQGAIRMERTAIAGTGASFPSSYLPPPDQPSLFAVNRSFLPVSASAGLLYDLPYGMVARVTAQHVERAPDPVELFYKGPHDTPRTFEIGDPTMTLEKADTLEIGLKRGRGDTRFEISAYYTKYQNFIYKNFTGLMCNDSFATCGAPGASFDQIIYSQRDATFTGGELQIEHDVARLWDGIWGVEAQYDVVRATFADGSYVPKIPPYRLGGGLFYRDPSWSARINLLHAFAQNNLGAFETPTPGYNLLNAEVSYMAKLPTPTFPTELTIGLRGENLLNDSIRFHQSYKKDEVLQPGRNIRLFASVKF

SEQ ID NO: 14306 - protein, 794 aa, Fulvimarina pelagi HTCC2506
MAAGRCRTATLHRRGLAGACAMTLLARSALAVAAEAPQVTWLDRIEVTATPIAGTTIDAAQLPYMVQSASNAELSRGRSNNLSDLLQRRFIGVDGNDVQGSAFQNDLTFHGFRASALPGASQGVSVYLDGVRFNEPFADIVSWDMLPEAAISAVTLMPGSNPLFGPNTLGGAVVLSTASGLTAPGLQGEASIGSGARKRLDASYGVAGADGWHGFVALTGFDENGWRAASEGRLGTVFGKVGKQGEQTDWSLSLLHGRSRLIGNGLLPDTRYTDEGPEPGLYRADRRSVYTSPDLTRNRNTLLSVQLDHRFDADTALHALAYSKMGRRDTVNGDSGQDYEEFVEECASGYATDGSALDADCDVARTDADTLHTGALNTTQMRQHAQGVALNLSMQWGAHALTTGATFDRGHVRYRQFARDGWVQPDRSVVADPATDRAFFSGVRGSTQTLGVFLADTWALDDATHLTAAVRWNHVVVDNVLSTADDGDRPRERFVYAKANPSLGLTRRLASAVTLYGSVAQNSRAPTAIELGCADPTQPCRVPTGLQADPRLEQIISRTYELGARWTPSANRNATLSVYPADNRDDILFLRAPDTQLGYFDNVGRTRYQGVDAALHLRSGDWQWSAGYSYLDATYRSDGQLLSGERVIALRPGLRIAALPRHNLKLGMEWQRDALTLGVGVRAVSGRVASGNEDGQVDNAEEGQAAPERLDIGTAGYALVDLQARWTINARVSLFARIDKVFDRRYATYAAVAEDVFPDGELARPQDAPVETGPARFLAPGVPRQYLIGVRWAL

SEQ ID NO: 14307 - protein, 1080 aa, Salmonella enterica
MKLKLTWLLTLFMAFVMQFSFAQEKTVTGTVTTASDGLPLPGASVLVKGTNKGQQTDFDGKYTIQVNQGDVLVVSYVGMKTTEMTVGASNTYDVALEDDSTLDEVVVVGYGTTTKKAYAGTATVVKSENIETKNFSNVSQSLAGEAAGVTVINTSGQPGSTSTIRIRGFGSVNGNRAPLYVVDGVPYSGSLNAINPSDIKSTTILKDATATAIYGSRGANGVILITTKGGSATESYIEVDVRTGINTQLIDRYDVITDPEEFIGYVWEANVNRQILTGDADPVGTVNNTLFTTLINPVYNMWNVANGAELIDPATAQVRPGVTRKFTPKNFQEESFNPAYRTEVNLRMGGGNEDVKYFISGGYLDDSGYIINSGFRRYTTRLNVNAKVRPWFKIGANLGYTYSETRSNGQTNGAENLFEFADKMPPIYGVFLRDDNQELVADPIFGGFQYDYGSISAINNGFAPRARPASDGLNPIASALYDFVGTDRHEVNGSFNATINVAKGLTFETTFGAQYSNQIFKSASNQFYGGGAPNGGNFFQRNTETLTMNFLQLLRYRTSFGNHSLEILAAHESNEFEQSFITGSKSKAVVPGIYELNNYIIDANPSTGFRQGRTLESYFGQVNYDFDKKYFLTGSIRRDGSSRFANDKYGTFGSVGAAWILSNEDFLSDSNLFTYLKLKGSYGVTGDENGVGFYTGIDTFNASNLGGSIAIAPNTFENPELTWETAKQYQVGVEFGLGNWLDGSIDYFVKDTENLIFPRRNPPSTGVAVITVNDGVLRNFGLEFDLTGHIIRKDDFTLDLSVNGSMYDNEITTMPIEPSTGLPKILDRQGNFAYAKGRSIYDFYIREYAGVDPADGFPMWNQYYDDVNGDGIFDAGDTAIQSMTDYLNANPDANVEKTVTKTYASATEKFNEKSGIPDVAGAFRLSARYKNWNLSTQFTYSIGGYAFDGQYRELIHDNNSGISGTNRHVDIRDRWRQPGDITSVPRIADRVIPNVSSGSTRFLIKRDYLALNNVLLGYTLSSKFLDKTGLDLVNLYVSGDNLFIKSKRTGYNPSTSQNGGSGRGFYAPLTTFTLGVKLKF

SEQ ID NO: 14308 - protein, 164 aa, Vibrio mimicus
MNKTLIALAVSAAAVATGAYADGINQSGDKAGSTVYSAKGTSLEVGGRAEARLSLKDGKAQDNSRVRLNFLGKAEINDSLYGVGFYEGEFTTNDQGKNASNNSLDNRYTYAGIGGTYGEVTYGKNDGALGVITDFTDIMSYHGNTAAEKIAVADRVTTCCYKHW

SEQ ID NO: 14309 - protein, 283 aa, Vibrio mimicus
ADGINQSGDKAGSTVYSAKGTSLEIGGRAEARLSLKDGKAEDKSRVRLNFLGKAEINDSLYGIGFYEGEFTTADSTATKTDNGSDLDNRYTYAGIGGTYGEVTYGKNDGALGVITDFTDIMSYHGNSAADKIAVADRVDNMLAYKGQFGDLGVKASFRFADRTENTVTDKYEDNGKDGYSLSAIYAFGDTGFNVGAGYADQDEQNEYMLAASYRMENLYFAGLFTDGEKAATNGDYTGYELAAGYKLGQAAFTTTYNNAETNDETSANNFAIDATYYFKPNFR

SEQ ID NO: 14310 - protein, 580 aa, Prochlorococcus marinus
MKLFQQLLVAPAALGLMAPMAANAADLDIKGVSDYSASSEQVTSISQFQDVYPTDWAYQALSNLIERYGCVAGYPSGSYLGNRAMTRFEAAALLNACLDRITEVTDELRRLLNEFEQELAILKGRVDGLEARVGELEATQFSTTTKLVGQTSFVIGANSYGGDARQGFRDEVFTTSAWAGSNYRSGKAGDERADEAAAASGATVFNYDMRLELNTSFTGKDLLKTRLRAGNFAESPFGSNGYVGLSAMEVAFGESGDENEVTVDRLWYQFPLGEEFTATIGGMVRQDNMLAVWPSNYPAETVIDFFTYAGAPGAYNLAKGGGAGIWWDDNDSGWSISTSYLSTNADDGNPNTGGVATDGAGSNATAQIAYADERWGAAAAYNYASTDNGVGLYAGNGTPLANDIQGFGTTNSFALSAWWAPENTGWMPSVSAGWGINSVSSNSNSGNTQVLGVDTDDILDSATSQSWYVALQWEDAFIEGNVLGVAGGQPTFVTNLNWDGKFEDAYKKAYGEDPDDNVADGNYAFELWYKFQVTDNISVTPAVFYLSRPYGELTDGSLTKGGEDDTFSNFGGLVRTTFKF

SEQ ID NO: 14311 - protein, 455 aa, Prochlorococcus marinus
MKLFNRMLLAAAGTLLLSVGTVSAAGVEPGAFYLSPIVGGYTFDGKQHLETQPVGGIRAGYNFTKHLGAEALFDYTRTEGTRSSTKTDFYRYGADALLHIFPDNRLVPYIAAGYSGMSLDSNDGTKLTRGVFDYGPGIKYFISDTWALRGDFRHLIFKHEGDSYSNYEYNLGLVYSFGAAKEPAPVAKAEPAPAPAPEPAPAPAPVVAPPPAPADSDNDGVIDTLDKCPGTPAGVKVDKDGCPVDSDKDGVADYLDKCPGTPAGVQVDKDGCPVDSDKDGVADYLDKCPGTPAGVQVDQDGCPVDSDGDGVADYLDKCPGTPKGTKVKADGCPDLETLSMSINIQFVTGKNDIQPKYAGEIKKVADYMQKYPTVKGVIEGHTDNVGSAAANMKLSQRRAEAVRSYLIKKHGIAADRLTAKGYGMTRPIADNGTEAGRQQNRRITAVLDSVTVEKQ

SEQ ID NO: 14312 - protein, 180 aa, Wolbachia endosymbiont
SYYVRLQYNGEVLPFKTKIDGITHTSGQSPLKASFIAGGGAFGYKMDDIRVDVEGLYSQLAKDATVVSDNKAAGSVTAFSGLVNVYYDIAIEDMPITPYVGVGVGAAYISNPSKADAVKEQKGFGFAYQAKAGVSYDVTPEIKLFAGARYFGSYGASFNKETVSATKEINVLYSAVGAEA

SEQ ID NO: 14313 - protein, 1228 aa, Escherichia coli
MNKIFSLKFSTASGGLIAVSELARKCVKKSFRRRHIASCLLMATLCPGYIFAGTVNSDIDYQLFRDFAENKGHFIAGSTNITITDKSGNVTGILDKAPMPDFSSVSSNGVATLINPQYVASVKHNGGYQGVTFGNKNQNPDNDHFNYKIVDRNNHAKLDFHAPRLNKVVTETAPSAITEQGATPGAYLDKERYPVFYRLGSGTQYIKDESGNLVKVGAAYSYLTGGTVPNPSSYNNGQMVSAASGSVFNYLTNGALPIYGEAGDSGSPLFGWDTTLNKWVLVGVLTAGNGPGGKANNWAVLPLDFIQTTLDEDNDAPVIYDSVNGGALDWVFDSATGIGTLTQGITKFEMHGQKAADLDAGKNLIFSGVDGKLNLKNDVHQGAGALTFKNDFTVASDSGNIWTGAGVIVDKDATVKWQINGQHNDALHKIGEGTLYVNGIGTNPGDLRVGDGTVILAQQADENGNKQAFNKLTITSGRPTVVLKDAEQVNPDNIYFGYRGGRLDLNGNNLSFSRIKNADSGANIVNNNKEIASLLTINGKGMDDKNNFQTFLGILGETDSKRHNGVLNVSYAPVAGSGVLNLSGGSNLNGDINVQNGGTLLLSGNPVQHAGNVFIEGDWNKTQFNLNNINVASGSSLHVSEYAELNGNINAGEGAFVSLGYTEGVTQRCKLDNNTGKTSCSHMTPENVVDSKASRVIATGDVTLNGGSLMHVGNASLTGGISGAPDSHLILSSDAMINLDKNSSVGRLVSEGGKVSMLSSEWSPKKFTIEESYTSNLALNMGVNIKDNVGDKIEILNLAQGANNSLDLSNLYGQSGELAYDLTIASAPSGTSHDFFSFASFDRGFTVYTPNTQVTEQDGKVLWQLKGKNPAPPESEKPVPPESEKPVPPESEKPVPPESEKPVPPETEKPVPPETEKPVPPETETPGATQPGNGLFDGKDNKKLLKDARNMFASRQYLISNSSDRWEMIIDDATRNDNVWAMNTFRTGGYDGFTAKQHGLDLGIHKAQDSDYFWGAGIGFHKGDTSNSLFRDDYKMFSGNLYLGKDFESGLFVNAAVGYKHLSENFKVKGELNDLSGKVNTNIVTAGARVGYRMHSDELQASVSPSVSVNSSWMEGGKIHAKERQVDLHSGWAASVKAGVLADKSFENSKVTGGIYRNFSVKDMPGVTLSDSWKSRNYEAKKDDHFTATIGVEGKITEKMNANLKVSSHFGGDFKTDTVGILGLKYEF

SEQ ID NO: 14314 - protein, 709 aa, Shewanella sp.
MVFKYSVVGLAVGSALIAAMPVMAEAPNDTNIERINVTGRTFNDYKVGSASGAMRGDIDLMDTPQSVNVIPDFVTDEQLATNLAEVLVNDSSVTAGTTRWNRQVFSIRGFELDSGNGYLINGHQQWSHYVQPIETLQQVEVLKGPSSMLYGQSGPGGLVNMVTKKPTYDSMLNLGFDTDGYGSTRAQLDAGGSLNEAQSIRYRGVLVKQDTKYWREYSTTDENQERDRWLGYLNLEFDISDDLLLSLKYDHTQDKTGIDAGSWLDKQGNVVGQRKTIWDAPWAFTDNTVSNLGADLTWHMNDDWKVKLGYNDQQFNRQRFDSAPQYNEDPFTSGYKIKPFDRYDDWQHKTAYVDFTGEFALAGMEHQLLIGANYLDYYYGQYIERYVNQATKGMITVIPGQPVAKPDLDYHRDSTKSESEYKYYGFYLQDLMTINEQWKLLAGVRYDEQKKDGFGENSYAVSPKFGVIYSPMTNGSIYVNYSKSFTPQGGITDPLNVNYDTNLKPEYGIQYEVGTKWELFDDSLLLTAAVFDVTLENISINEVLTASDPLSEDGKYTSITTQGGEQKHRGFEVGAQGKLGDSWFVTSSMMYLDAEYQTGDEREGKTPIDAPEWSANIWTRYEVTDNFAMNFGAIYVGERFAKVDNTISKDGYVRFDIGAAYTMDFMGKDVSIRANVRNLFDTDYIDGGQYNMVTLGQDRNFSVALEAKF

SEQ ID NO: 14315 - protein, 741 aa, Shewanella sp.
MITRNTAFRVPSLALAIGLSFTASADETARDPLLNVNEVIVVHGEGADAEQLATTHWSIDEAEIRALGAQTLDQVLKNVPGVYIRVGGDGTPRVDIRGFKTRHVTLLVNGVPMSSADDGQFDPSVIPTSQIASVEVSVGPTSVLYGPSGAGGVINIITKQGSTAPALSGRLEAGKDNTFNGDISAAGSGDDWQGLVSVSRQQTDGFPMSNDFEPTQYQDGELRVNSDKEVTNVYAQGSYWLSDKTQLIANMALRNGEWGKPSRDGTGSGKLKYERTDDYDSHTFQLGLAHQFDDTFTLRGFGYHNQSDTLEAAYADETYQALTQTQDGRSVVQGVNLQLITDFHKAGLLTTSVIAEEQSWKSVVDTYSSNAGSGTGNNSGTGTGSVSGSGSGSGSGTGSGGGTGSGSGTGSGGGTGSGGGTGSGGGTGSGSGTGSGGGTGSGSGTGSGGGNGSGGGSGGAENLNDSAWLYTAAAEYQYQSEHNYGFTLGGAFHSLDTSDGTDDNYSAMASSYWQIVPDSRLSLSVARKVRFPSMVNLYSQSSGNSDLEAEESKHVELGLDQNLPASTDFSLYGFYTDAKNYIAKDTDGFYQNMGRYEFKGVDFQINNHAIEHLDLSFSYSFLDSKEMEGDDTLDALQYRPRHQLRWQMSYEFPFETQVHLNVERILDQVYATQVKVNGKNQYQQQSLDNYTLVDINLVQPLIADKLEVYLRATNLLDENYYQSEALPQAGRQFFVGVNWQI

SEQ ID NO: 14316 - protein, 685 aa, Shewanella sp.
MECRAFKKSAIAVMVSSLVMSSAYAAVDAESSEPIEKITVYGEKIERSLKDTTSSISVIDKDALDSGQYQSTSSALSEVPNVVVLTGSVPDIRGVSGNGSASGFNSFTGGARARVSTLVDGVAEPFVADLTGDTGLWDIQQIEVYRGPQSTINGRNSIGGTVFIKTEDPTFDWQGAARVGYRNQDNFIDSAVMLSGPILDDELAFRVSGQNVTGNTFNKGLEYETNPAPFDLNELITNRWRGKFLWQPSAIEDLKVLYSFSYNDEKGDSGRNYFTGDDPWAFKPIFQRYIETKSTTHSVKVDYDLGEGRAFDLIVAYMDYDWGFESYEALATAQQYVDMNDQSYTVDGKYSFGLKDKDFNGFVGLAYFKRDQDFGSTGSSVYSGDDSTESTSIYGEMTYGLAESLWVTFGGRVMREEQLRNFNMLYQGSQLREKLDNANTVTLPKLVLQYALNDSTTLAASVRRGYNSGGGALSLAESEYYYYDEEYVNTYEISSRSAFMDGDVNFSANLFYNDFDGYQASNSARKITNIDKAVSYGIEAEFSAMLTENLQFISGVGLLDSETKQADPSYGDIIGNQLNSAPHVTANAGLKYWLGDAFSFGFSGNYVGEYYADINNTESRVAGDYVVARLSLDYQTDSWRISGFVNNLFDEQALTVNEPASRSYPDGYAAIIDPRNLGVSVMYRF

SEQ ID NO: 14317 - protein, 384 aa, Shewanella sp.
MKKTCIALMLPMLLAATSSQAVELYNDQKNSLDLSGWLGFAALNDSHDTSVIDDSSRVRFSFERSERNGWTAFATTEWGINMVSSDDSLVMQGGKLAAEKTEDFLYNRLGYVGMSHDEWGSLSFGKQWGAYYDVAGTTDLPNVFAGYSVGAYAFSDGGLTGTGRADSAFIYRNSFGPVQIALQYAAKTNGDVTLKNDDGSEMTNSELNFDSSYGASLTYSLTDKFKLLAGFNRGDFEGHLGNTQVDETNEIVGIGAMYGDYYHYADNREASGLYVGFNAHQSKNNELVGGELYDATGAELMTAYQFDNGFVPMIVLSYLDLDTDASTPIQGKWTRQFAMLGLHYRYSNDTVMFAEMKLDFSDMDDPALEAQEDNGFAVGINYFF

SEQ ID NO: 14318 - protein, 348 aa, Shewanella sp.
MNKTSLLLLGLTLPFGTMAAENSDWEQLDRRLQHLEQQQTTQLQNTELSLYGSVRPTLVYSDSSLTDDWDVGDALSRIGIKGKTEFAPGWALLAQGEWKINLNGDGSFGDARLAFAGVSSPWGQFTLGRQRPVQYSLVAEYTDIFNNANSPFAYNQESPFFTDNLALYQAKIGYFTLMGAAQFKSEEANSGADMLNAGIGFDWQQLHLGLSYLEQDTFESNLNTGKENTTGFAMAYSFTNGVYLAVAYQYKDYQLNQGEDREGYSLDSALALPLGPDYKLKLGYFQFDDGVSDPSSLNYQGVNTTIEWSPTPNVRLHAEYLYQDNDNRDTDNSIAIGVRYDFDLNWKA

SEQ ID NO: 14319 - protein, 448 aa, Shewanella sp.
MQKRLLTLAVTAALLSTTTQVHAAGFQLAEYSATGLGRAFAGEAAIADNASVQGRNPAMLTYLEGRQLSAGGIYVMPNVDVKGDVSLSSPLLGPNPIVMNGDAIDVADDALVPNFYYSNQLNDQWTWGLAVNSNYGLSTELPKTHAAAIFGNKTAVTTVEFNPNIAYRVNDAVSVGGGVRIVYGEGEIGASLPGWVDSIKPGLPAQVSAMLPPGGTELKSMKGDDIGYGWQLGTSWQINPANRVGLAYHSGVKFELDGHASGVIYDGGQNLSIEGYIPLELPAFAELSSYHQLTDNWAVHASVNWTDWSVFDQLVAYFPGEVKPKGSLESDLVKEENFEDNWRFALGTTYQVNNEWLVRAGVALDKTAAADEWRTTTIPDSDRLWFSVGAGYQATKNLNVDFALTYIRATGDAPINEQQNLLNLATVSFNGEASGDVWLAGIQMSYKM

SEQ ID NO: 14320 - protein, 812 aa, Shewanella sp.
MFSFQPKGYSTLRGFMRPAVIALAVSSTLVFPVVHAEEQASSFEKIEVVGSRIALRTATDSVAPVDIITAEQLESTGMTETAKALQFAAPSYSFPFSSVTDGSDAVRPASLRGLSPDHTLVLVNGKRRHGSALVHLSGTVGKGSSNVDLNAIPMTSIKRIEILRDGASAQYGSDAIAGVINVVLKDNDQGGSVSAQAGQTYLGDGEQWRVGVNHGISLNNDGFVNIGVEAHHKDSTNRAGLDPRQQYPKLPDGSDDPREATFNRKSHQVGDAEYDNLGLFINAAQPFSNDSKLYAFGGISQRETKSGAFYRRALDARNLTELYPDGFLPQINPKIIDSSLVLGYEFTLGEWNIDTSAGYGGNLFEYNIVNTLNASLGPDSPTEFDAGTLSTSEANLNIDASRYYNFANDSEILVATGVSWRQNGYQIEAGEPGSYINGGYDNRAAGSQGFTGFTPESEVDETRDNTGVYVELENQLTTEFYWAAALRYENYSDFGGNTSWKLAGRYDFTDHLALRGTVNTGFRAPSVQQLYFSNISTLFNPDPTTGQLVPTESGTFNTLSPVTEALGINELDPELSQSFSLGLVYTNDTGLALTLDAYQISIDDRIILSSSVTPNDSPAVAAALANTNAESARFFINAVDTRTRGVDLVVSQDFDLGNWGDLRANLAYAYNKTEIQDIHFPEILDGLGPKLFDNIEQTRMTSATPHNTGNLGLTHELGDFKTNIRLSYFGDYTVGYSTGDVNYSDQWVMDLSVRYAATDALSFTAGVQNLFDVYPEKRPDDNNFNGIFVYPLTNTPFGFNGGYYFLEAKYTY

SEQ ID NO: 14321 - protein, 713 aa, Shewanella sp.
MEDKTMAANTSTIPHGFKCSAIASALTLALGASVASQAMADETNQTQIERIQVHGEQSIGRNALGAADALLKDQGVDFSEAGGVSALPVLNGMMGDRIKVLVDGADITASCANQMNPPLSYVSANQISSVEVVAGVSPVSAGGDNIAGVIKVNSLKPKFSDSDNLSFESGEISSGYRSTSDAFLLGAKAGIASKNLSFSYQGAYEDANSYHDGHGDKVLDTLYRAQNHALTAAWRDDKQQLAIKLTHQAIPFQGFSNQYMDMTDNKSYGALVRYLRDLDNDGEFSAQLNWHSVKHEMGFFTPEKTGKMPMNTEGSDYSYQLHWRLPMGEDSTLLVGQEYYNYQLDDTWPAVPGTMMAPNDYININDGERRRAAVYGEWQQNLTPVWWLSAGVRYEYVTTDTGEVQAYSNMPMMGMPNMDAEAAKAFNAMDRSRDDNLIDTTLLARYQLSAKQQLEFGLARKNRAPNLYERYSWGRGVMATTMIGWYGDGNGYVGNPDLKPETAHTLSAVYKFAGDEWQFSTTAWYSAVTDYIDAEVIGSFNRSGLANGKRNILKFTNEDAHLYGAKLSANYLLADTDSGKWQMQGKLNITRGERDEGNEPLYQIKPLQTELALSHQLGDWENRLSWQWVATKDKVDDRRLENETDSYSLLNLSSSIKWQELSLTFAINNLFDTYYELPLGGVNLAEFKADSSGGFSQVAGSGRSFELGASYRF

SEQ ID NO: 14322 - protein, 720 aa, Shewanella sp.
MKPTYLAILLAALLHPPLASADEVNQPELDKIERVSVVGVRQRLEQAGTLANTIMKTEVIDASVIENKNAVNLSEAIDNSPGVKVSNECSMCGVKRIMLNGMKGEQTTILVDGLPVHTMISGYYAVDAIPTTGVERIEVARGAGASLIAPEAIGGTINIISYEPTENGAELDISAGENGYRKLGFLGKGVTQDGRTRATLVAQYDDRDQADADNNKVNEAPMQENRSLTARVSHDVTDSDNLVMRVANIQSEIFGGPMLGSTFADGVASSTGNVLSGYDGQSSEPQQLFEDGDVRKRYTGKAWETTEWIKTQRNEASLAWLREFNDNWNMHLTASYADHKQDSFYEGFDYTADDKMWFFDARFNYLLTDSQLLTFGADLRTEEMRSHSRSGSANPDYVSDSFDYDVKGVYLQDTWQATESLEVAMALRYDTITADFTDPNKPGTELDESILSPRVDIRLRHNDEWTSRLSAGRGYRAPLSFFETDHGILDGSLGFDIDIDELERSNSANYALSYEGKRLTSTASIAWTEVEHLAALTTNDHGIPLLTQLDEKARVITSDIALGYRLTDDMSLSLTAEHFDYDSVFKSSYAIAPVEKRVTLSMDWDVNDWEIFANLVWIGSRDLSDFGYEGYNRLDANGQVDPSSKKTTDAPSYVTLDLKVSYQLNDTLSLYTGVSNLFDYTQAGDEETPLFYDAEGAFDVGYIYGPLRGREIYAGMKFSF

SEQ ID NO: 14323 - protein, 653 aa, Shewanella sp.
MGTHPTKIALLIGSLCSFSVIAPAVAADDASVAKVDEHIVVIGRSDKTPLNIAANVNVIDAAAIEQSGATSLTEVLRGQSGIQLSDNNIGTSFAMRGFSASSAVNNTLILLDGRRLNNIDIAAPSLNAIPLNLIERVEILSGSAGVLYGDQAVGGVINIVTKSPENTGGSVQLSGGSFNTYEGRGDVSGAINKDWHYFLTGSYNQGDNYRKHNANETGSILGRIQYKTATDSFFVETSYYDDDRENPGALTPKQFKENPRQSSNSSEYVHEMTTAARSGYQHQLNQNWALAADLDYSDTLVSSLNWGAGSHNTRSLLMFSPKALANYSTRQGELNLVTGLDISRGKAEFDSMARSNVQEMQSAYLQATVPLSHTLSYVVGGRYARVTDDLVDGNVYPNGIDLDEDATAFEFGLNYRPSAEHRFYLRGDENFRFAKVDEQAYTPKDVYGLKPQTGRSYEAGWDWTVASQSLRVSLYRLDLEDEIVFDPSAEKPVGGSFQGANVNADASRRYGASADWDWQVTQALTLGLEYNYIDAEFTDGVNDGKQLSWVAEHTGRGYVSMDFAEHFQVFAEAIYTGDRFIEGDNANQGDKLSSYVLGNLALNYTRDAWLASLRIDNLFDKEYVSSGYYAGGEYDGYYTGRGRDIRLTVGYRF

SEQ ID NO: 14324 - protein, 758 aa, Shewanella sp.
MKQNTIKMSCIALAISSALAAQYAVAEDENSTGEKQATLERIEVTARKSIESLQNVPVAVTSVSADDLAENGISVMTEIQQFSPNTTLQSSRGTNSTLTAFIRGVGQEDPLWGYEPGVGIYIDDVYIARPQGAVLDILDVQRIEVLRGPQGTLYGKNTIGGAVKYVTKKMSGDAELNLNATIGSYNQQDYKIAGQLPLIDNKLYIGGAFASLNRDGYGDFITSALPDQDTENYNKDVMAGRVSLEYTPTDDLFMRLNYDKTTDESNSKGGYRMLPSVLTDAPVPDSKYDSYTSMPTWNKVETEGWGLTIEYGLNDDWTLKSVTSSRESYSPTNIDFDNTSLRILDVPAIYDDEQFSQEFQANYDGDNLKLVSGLYYFKGDSCGMFDSILYEYYKAYGGLTREVRGCNNSESYAAYAQGSYDITDKLSMTAGLRYTRETKDATVYNGIMFTTLYPETGWIPGYVRDEDAINASIPKVLDDEETWSKLNPRLGLEYQLSDDMMLFTSYSQGFKSGTFNPRATGPEPAVDPEVVDSYELGMKSEWFDRLRVNATAFYLDHKDRQFVTVLPGENASDLNQRLGNIGKSTATGLELEVEYAATESLNLFATLGLIDASFEEVISYDSDGNRIDISDTYTITNTPDTTANVGFSYNIDTDIGSFVANGNYYYRSDYDLAVVNNLLSQDGYGLLNLGLNWYSNDGHWQAGLHWKNVTNEEYLVGNYAFVTPDGNGGYIPGLGGDNTLIGYYGDPETISLTVGYNF

SEQ ID NO: 14325 - protein, 731 aa, Shewanella sp.
MKFAKRRNGRVTLGAHVLGSLTIGMAVSAAPAMATEPQSQVVDKKVEHIEVNGEYLGYNTRKVQSGKFTEDLLNTAKTVTVINQDLIKDMGAQSFTDALRATPGITLGTGEGGNPYGDRPFIRGYDAQSSTFINGMRNVGSQSRETFNIEQIEVLKGPSSVYNGRGAVGGSINIVTKKAQSEDFINADVAVGTDSLKRASVDVNHVIADEAAVRINMMAHDADTPGRDEVTGNRWGVAPSVTFGLTTPTKVTLEYYHFENHDIPDYGIPYDQATGQPADVDPDNFYGLLSRDFRDTMDDTASVLISHDFNNDMQFTSTSIYSRNSNYYIVTNPDDTTGNVANGYVWRNTKSRHSVTKTLATQLQLSGEAKLAGMTNRFAVGTELSNERTSNLSYTVDTGNGRNAGCNQAMLDNYNCTLLDNPNPHDPWVGTITLGTDATVTETDTRSLYAFNTIELTEAWMVNAGIRWDDYSTSAENSTSEFSNDTDFFNYQLSVLYKPAENGSIYAAWGTSSNPPGTSNGDGADRLGSTNADLEPEDTESYELGTKWDFFAGRLSLNGSVFQIEKNNARVATSGDRNSPQENVGEQKVKGFELGFSGDFTEHWHGFGGYTYLDATLESNGYNQAQNGNRFPNTAKNSLSLFTTYDVTEDFTVGTGAYYMGKVYGNTANTLSIPSYWRFDLTSSYKMSEFLTLRLNVQNLTDERYYDKAYTAHFANMAPGRLVMLSADMHF

SEQ ID NO: 14326 - protein, 353 aa, Shewanella sp.
MKKTFISASVASVLALASFGALAEGPSFYGRLELALTNTETGATLQSGTNGLDANYADENNAGTYLENNFSLLGVKGSEKIADGYDVVYQMEFQVENTSGTGDVFKARNTYLGLKTNAGTVLVGRNDTVFKQAEGAVDVFGNTNADIDRLISAQTRSADGVWYYSPKIANLVTLNATYLFDDNDTTAKTNESLYALSATLGDSKFKEQNYYVAVAYNKGIAGVDAYRGVAQVKFGDFKVGGLFQNSESVTDSSVDGNTYFVNVVYTLNGVNLKAEYGSDEAGFGNYYKNVNKGGATGTDISVQNFNVGADYRLSKSTMVYGQYAMYRGDHVVAGNKVDLQDDNVFSVGVRYDF

SEQ ID NO: 14327 - protein, 195 aa, Shewanella sp.
MKKNLLALAVLCAMTSGAAFAQQVAEGSWLVRARAVHLDSANNGAAGDAGVSINDKWIPEVDVSYFFTPNLAAELVLTYPQKHDVRLNGDKIGSLKHLPPSLLLQYHFTNFGAFKPYVGAGVNYTRFSSVKLPAGLDVKRNSWGGALQVGFDYALDKNWSLNVDVKKVYIDTDVRGVGTFKVDPVLFGVGVGYRF

SEQ ID NO: 14328 - protein, 1061 aa, Shewanella sp.
MKRPLHSLGGATGFKWLPLKAFLFCLPLFFISAESFAQATAISGTVSDDKGTTLIGVSVKVKNTKTGTLTDAQGKFKLSVENKNATLVFLYVGYVTQEVPLNGQTSVTVKLKEDNQNLEEIVVTGYGSQKRESITGSIATVTAKDIGRVHGGATVSTSLAGKLPGVTFRQTDGRPGSSAAIQIRNMGRPLYVIDGIQQDEGQFNNLAPNDIESISILKDASAAIYGVRAANGVVVVTTKKGAGDSQINVDAYYGAQNWSRFPDVVRTSYDYMRYRADAEVNSFGSTSITQAELDKYQAGTDPAYRSFDWRDYVLKSNNNAPQNSVNVNFTGGAEKVNYYVSATNLYQNSVIGKEYEFNRSNIQSNITATVAKGLKVGLNINGRIESRENPGVPGGDDYFLARFAVLRNTPLERPYANDNPAYLNTITNNESNYAFLNKALSGTYRNDWRVLQTNFNAEYQIPGVKGLTAKAVYSYYLADYVLNNHEFTYDTYTYRPETDIYERTGGSNNPYREREQKKEFATTGQFQLNYNNTFGKHSLGATLVAERIELKHLRNYIHSSPVSNNLPLIYFPTADRYDDSDDIETRIGYIGRINYNYANKYYLEASARRDASYLFAPDKRVGYFPGVSAGWRITEEQFMKNLLGESKILNELKFRASYGILGDDRNPNDPNQPIVTPYAYLPGYNYNQGTVILDDNAIIVSRDKGVPFDRISWLKSRTFNIGADFGLLDNKLTGSVEYFYRKRTGLLGERNDLIIPQELGYALPQENVNSDAQYGQELSLAYNNKVGELSYNVGGNVSFTRSKSLNTYNPIFFNSWDQYRNSIENRYSNIDWGYEVEGQFTSIDQINNYAVNIDGQGNRTLLPGDLIYKDQNGDGKIDQYDERPIGFGYGRQPNINFGFTIGAAYKAFDFHADFSGGAGYTWFQNYEMRWAFQNNGNLNSIFEDRWHRENMYDVNSAWIPGKYPANRVNPGTSHSDYANNSDFWLHSVKYLRARTIEFGYTLPASVLEKIKIKRARFYLNAYNLFSFDNLKEFNLDPEVADDNGLQFPQNKIVNLGLNLTF

SEQ ID NO: 14329 - protein, 799 aa, Shewanella sp.
MGKALSQRHPRQQGRLSLLTASLLLASAVYAQEVAYTLDIPAQALDQALNALAGQTGRRILFATDIAEGHSAPALHGSLTVEQALQRLLGGSNLAMRKTDDGSYVVFAQAAGEAMGLDVMTVVDNQLGTITETSKSYTPGTIATATRLVLSPRETPQTVTVVTRQHMDDFNLTNIDEVLQHAPGVTVGGLDSERSQYYSRGFPITNFQYDGIPMMRNAAYSSGNTLSDMAIYDRIEVLKGATGLVTGAGGAGATLNFVRKKPTYEFQAHITGEAGSWDNYRTEWDVSGSLNASGSVRGRAVAAYQDKKSFQDHYDRNTSVYYGILEMDLTSETLLTLGFDYQDNKPKGSSWGGVPIFDSKGDEVSVSRSFNPGADWSRWEQYTRTFFTQLEHNFSNGWVGRGQYNYQVNGYDAKLGSMLSSPDVDNGYRTSLTAGQYRGDTVNHAIEVYASGPFQWLGREHELVVGASAYRTHWKGKSYYGYSAENGGLVENFYRADGNIPEPDWGAISARQDELTNQRALYFTARFRPTDDLALILGGRVTDYHLSRDSHARDSGKVVPFAGITYDLNDTWSLYASYTSIFLPNSYKDSSGSLLEPDEGDSYEAGIKGEWFKGRLNASLAYFEIREDDRPEWAGYDYETNQDVYEGLKAKTKGIEAEISGELAPGWNIQAGYTYKTIRRDDDNKKITTEEPEHLFKVYTTYRLPGRLNQFTVGGGATYQGTTWMEVSNPAKDYAAEQYHQEAYWLVNLMGRYQVTENLSTTLNINNLFDKYYYTNIGFYSTKAYGEPRNMMLTTRWDF

SEQ ID NO: 14330 - protein, 426 aa, Shewanella sp.
MPKLTLLAAATAVAFTGFAHAQDLTPQELQAQLTQLTQEVNLLKQQQAVNAAATPSEPSAPAFEIGGRIQLDYNLFNGAYNAEHNGSRAQDIFPRRVRTFVEGELSDWDYKLLLEFAENTAEIVMARMRYSGFENGPKLQLGKLREDISLDALTSSNHIALIERSSLADTMSPYFRWGVSAYQYFPSTGLRYALGVYKNDAFGSDGKDDTDDLNFALSSRVTWSQATEPGQVLHAGLWYSARQMDGDNLSASFARGELRETNTRLINYVAGGETAAIDRLNQVGLELAFQHKALLLQGEYAQRNLTTQDPLSVLDGERYEAYYLQASYFLTGEQRSYSKGSAVFSQPKGVTDAWELAARFSSVDASSDFQGTQAQTYTLGVSYYFNPKIKVMANYIHSSVDGAGTIALVGNEDVGDAFAARLQYVF

SEQ ID NO: 14331 - protein, 373 aa, Shewanella sp.
MDLEKMMKNTLKVVLLTSMLPLAASASQELTPWYVGAGLGVNNYEHIATDNGDDNPYAWDIFAGYMFNDYFGAEIGYRDLGSADWTYAGIGNDADVKGATLGLVGVWPLGNRWSLSAEAGAMYYTLENNQRVGGVSSSYSENDFAPYFGAGVGYNFTDNLKLQAKYRRYENLDDNAGANAIVPVNADSNYWGLELSYRFGTAAAAPVAAAVVAATPVDSDNDGVYDDKDQCPATPATHKVDSVGCTIYENVKKQEDVGSIQFANDSAVVKKEYYKDIERLANYMNKNPEFTVEIAGHASNVGKPEYNMVLSDKRADAVAKILVEKYGISQSRVTSNGYGITKPLVAGDSKEAHAANRRIEAIVTTTEKQPVLK

SEQ ID NO: 14332 - protein, 874 aa, Shewanella sp.
MRPSSFKKSVLATNIAILLGSAVSIGAVAAEAEATAAAAENIEKIEVRGMRASMKASVNDKRFSDSVVDAVTAEDIGKFPDGDVGESLGRIPGVAVNRQFGQGQQVSIRGASSQLTSTLLNGHSVASTGWFDQQAIDRSFNYSLLPPEMVGGIQVYKSSQADIAEGGIGGTVIVKTRKPLDLEANSVFLSAKGDYGTVSEEIDPQTSGLYSWKTEDEKFGFLVAGSLDQTQYQRNGIETLLGWGEIVPTTFQQDRERTALNAVFQYRPTDNLEFGLNLMSLQLDANNANTSIFLFPTQQGENTCLKENAAGVCTLVEHTGNGGFAWAQTWARKASMSSDTVDLDFAYQADNYKLEGRIGKTKAEGGTDLTSNYGQSIGKPEDFAGTYDATGDVIDINIANNSFDAGDFNGQLETAGWALKKQPNTDEESFATFDITVPVEFGVITSIKSGISYADHDVTQTTEAAQSSNIVAKDASEYYSGTMSSGAGFTLPKPIFDNMIRDAYGAIDGFTLDKSGYGTLQEKNLALYTMATFAGEGVRGNFGLRYISTDVESDYYAFSQTGTYADDLSTDKASYHDVLPSMNIAFDLASDLILRASAAQVISRPNYADLFATSKLPGFNDGTPGNEKKVTGSVNLQPFKASQADLSLEWYFSGEGLFAVTYFIKDVNSFISTREKLNQQIGIDDPNLVAQGGSSCGAGIYDCWTVSENYNANGGSIDGIELQLQDSFDNGFGYSANYTFADASSPAENYADRVGVFSDSSKHTVNLVGYYEIDDFSARVAYNWRSEYMMRELPGFYGNREHQAYGTLDLSANYDVTDYLSVTFEVVNLLEEDSIQKGVSPVDAEGVISEFKDNYPVWSFDGEARYKLGVALRF

SEQ ID NO: 14333 - protein, 1007 aa, Shewanella sp.
MKKKLLTLAIQASMFGIAPSVAWAADSIEVSAVNESANRVEVEVADKQESIEKVTVTGSRIKRDSFSLSTPLQGLDAKDIADSGIGSLADILVDQIPALSEGVSSTNSQSSVQNTGLSTIDLRDLGTDRTLTLIDGRRVVSNSYSGNYVSLSTIPAAMVDKVEIITGGASAVYGSDAIAGVVNIITQQNKTGFEINARGGETTEGGGRETTVDVGYGTDFNGDKGYIFASATYDKQHGLFATDRERALYESSFAYDAKQMCNAMNTVDGDQCMRDITRDDWRERSNDIVGGRFKSNSWWYDGTELKTDFKEERDGYNGYTTGLLKVPEDTLAAAVKMNYDLSDDVRANVQVQFSRNNAFRRTDAEGQDYNDAELYIDPVTGLPGTIAAGSISPNNPYVPAEIAATAGKSITWDRRFQEVGPVESDNERTTLRTWAGLQGNLFETWTWDASLGYGKFEQRQRRSNEISIRRLQYALDAEYADDGVTIQCASEEARAEGCVPVNIFGEGSISKEGADYIRANPYINTDITQFNALGFISGELFELPAGGVQSAFGVEYRRDTQAVDTDKAMRGDAITFNDVPPFEGDVTVWEAFGEANLPLLRDEAFANKLDLDVSLRLADYSQKNIDLMSSYRAGILWEPIANYALRANYSRSQRAPNITELISPPRGDYDSIRDICDGVTATSTGAGHDSCRQDPGIAAAIATNGVFEDEGGSKYSPNAGNENLTEETADTYTLGFTMAPAFLEGFNLAVDYYDIKVTDAIGSLSNEDILAECYNSSNPYGADNEYCQVISRDTEGQITQVIQQEQNLNDIVTRGVDIAMAYEWQLDGYGELSLKTNWTHVLEFSTSYYGADGLVEDDYVGELASGIFEDRGAISLTWSNDDWRVRWSAKYKSAMVDSHDRVEEWNVLRAENQAKLDAGDASAVANPETPAFLFYSSYITHDLSVSYTMDVSQAELRLYGGVRNIFDNQGPWVADTGDLVETGNGNYSSAYGGGVGRYAYLGAELKF

SEQ ID NO: 14334 - protein, 738 aa, Shewanella sp.
MPVLHPTPAPVRRRVTRSSHRARNGTGLALAAALAAGAPSNEARAQESVALEELSVASVGTGAPSSTTTASGTIGLIGPTPGYGAGRAVSSTKTDTPQLDVPQVVTVAPREAITDLAATRVDRVFNYLPGVAQQNNFGGLSIFSYAIRGVTTSEIYQNGFPLNRGTPPPPDAQNIERIEVLKGPGAGLFGRSDPGGLVNIITKQPTAQRFVEFGNQVDSFGLTRGTVDAGGPLNEDGTVLYRFNFAAQGAGSFRDFADSDRLLVAPVVSWQITPDTRITVEADIQRNRIIFDRGVIAINKQLGFLPISRFLGEPGQSTYQSQNILQARIDHRFNDDWQLRLATHFATGTLDGESAEIRSIASDNRTVARDRNVRDYRWDVAVGQADLIGRFDTGGIGHTLLLGFERESTDSRTLYLRSNFRTNPYALDIYAPVYGQALPPLTIPRNNLERVTNTALYAQDQIVLSPEWRALVATRLDIFEDSFRERIPRSQADQSRVAASPRAGLIYQPVPWLSLYTNVGTSFRPNIGPDAAAVSPGKPLKPETGQGYEIGAKAELFGGNLLLTAATFRVDRQNVLTPDPNNSGFSLAAGAVRSQGFELTAQGQLSPELKILAGYVYADAVVTKDNVLPVGAPLINVPRHSGSLLAVYEVQGGDWKGFGIGGGVRGVGERPGDAAGSGFVLPAYIAADALAYYRYENMRFGLNVENIFNTVYYESSLNVFRVYPGSPRRITGSFTVRF

SEQ ID NO: 14335 - protein, 314 aa, Shewanella sp.
MMNVFCKTLLASALASATLASAYAAEPLTVYGKLNVTAQSNDEKGDSTTTIQSNASRFGVKGDFELSSSLEAFYTVEYEVDTGAASSDNFKARNQFVGLKGAFGSFSVGRNDTLLKISQGNVDQFNDLSGDLKSLFKGENRLGQTATYLSPSIGGFVFGATYAAEGDADQQAQDGFSLAAMYGDAKLKKSPFYAAIAYDSDVKGYEILRASVQGKIADLTLGGMYQQQEQTYKNALPVNTDSVNGYLFSAAYDINAVTLKAQYQDMEDLGDSWSVGADYSLGKPTKVFAFYTNRSMEASNDDDKYIAVGLEHKF

SEQ ID NO: 14336 - protein, 627 aa, Shewanella sp.
MKKVILLASGLLCSSLVFASDPAAIDSLINLQGVVISANKVQVNRSSVPLTISVIDREQIEASSESALLPVLSQHVPGLFVTQKGITGFGVSEGAAGTVNIRGVGSGNKVLMLFDGQPQWAGVFGHSLPDTYVASDVERVEVIRGPGSLLYGSNAMGGVVNIITRHHKQKGRRTQARVMYGSYNTQKYMVNNGFNVGKFSSFISINHDRTDGHRPNSDFNITNGFANLGYAFNEHYKMTGDVSLAKSKFQNPGKTFEPVIDNKMNILRGTASMALENNQGKMSGALRLFYNWGNHKINDGYNPGEEPLTYLFRSDDHNVGVQLYESFRLFKGNNFTVGVDYKNWGGHAWNDNNDGSKKELVDKTVNETAGYAIMQQELFGILSLNAGVRYEHSSTYGGEWVPQGGVTVRPFEGNTIRASVSKGFRSPNIREMYMWGAANADLKPESMVNYEVAVGQSFLGGDLYTELTAFFIDGKDMIYSVSVNGDGRPPYKNLNTGTFTNKGIEFEARYQICKNLNLDMNYSYLHMSKPIPGAPGHKFYAGATYMPGRFTLNVNMQSVFDLYTDAEYSKKEDFTTLNAKVAYRFGTRDKGLNLFVKGENLTATRYTINDGFPMPKAIFMGGIDVTF

SEQ ID NO: 14337 - protein, 218 aa, Shewanella sp.
MMNKTTVSTLIAATLLAAGFSASVSAHQAGDIIVRAGAVTVAPNESSANVLTLGEFSVDNDTQLGLNFGYMLTDNFGIELLAATPFSHSVSLPAPGVGEIAETKQLPPTLVAQYYFGDAQSKLRPYVGVGVNYTNFFDNDFNAHGKSLGLSNLSMSTSWGLAAQVGLDYQVNKNWLVNASVWYAQISTDVKFTAGTDQYVFDTDINPWVYMVSVGYTF

SEQ ID NO: 14338 - protein, 951 aa, Shewanella sp.
MKLLTTKPAAIALAIAAALTATHSAANEIPAEQQTETKEQVQPKDTAQTQDAEVERIQVTGIRNSIKEGMFLKQNAVSVVDLVVADDIGKFPDENLAEALQRIPGVTITRNGGEGQNILVRGLGDGYNVTTLNGRKLASENAGRDFNFDTIASELVNVLAVYKSPEARLTEGGIGAIVDIQTRKPLDLEGRTIQASAKGIYESRTEDIHPHASLIIGDKTDDDSFGALVSAVYSRKTLRADTYSAEGFFDEDEGWGVDSAGVPVDTNNNGKIDPGEIYASKIPSYMYFANAQDVRERVGGTLALQWRPLDNLDINFDGLYSRYNTDGHKYQIGFVNYDEEWTPGTPLFTDAIFDDQGRVVSMNQTGDNTMVELLNLSTPRKTDTYQMGLKADWYVMPNWSISADVAYSAAQNANNGDNRFVVARGFVDGIDIDYTRGNMLPDVVISPGLSADQKYGAHYSRNSGVDVDDKITDIKLNSQYIPDEGIISKVDFGVNYVKQVKKQTEFASSNSSQFSRGGYYLTRDGYTFDNSTVFTQGEFELFQIPSSVFVPANFDNFLDGENSISPEPWPSFDYDKLLEYYRSINQEAADKSIVASLNKAGSYEVTEAVTSAYVQVNIEEEIFDLPYMLNLGLRASQTKVTSDGYAYDLAKVELDSAGQPTNNDWKNVVQTSYDDSYTNVLPSMNFKLNLQDDLLLRVSAAEVLSRPSLYALRVWAAPSFTTRENGLPTLTRGNPSVAPEKARQGDISLEWYFHESSSLSGAIFIKDIESFITDDKGPQMVEGTEYYVTQPVSGKYGAKVQGVEAAWQQSLDEYLPEPFNGLGFQLNYTYVDSSYDDPEIDAKGLPFKGMSKNSYNAVLYYEQYGLQARVAYNWRSKFLVDPEAWGGPAWIQDYGQLDASASYDIFENVSIFAEASNLTNNRYSGYVKYEDQVNYLERFGTQIALGIRGSF

SEQ ID NO: 14339 - protein, 402 aa, Shewanella sp.
MNKTLVATALAALFLAPSVSAIEIYKDDKNAVEIGGFIDVRVINTQGETEVVNGASRINFGFSRELTHGWNAFAKLEWGVNPVGNSDIVYNNRFESVQDEFFYNRLGYAGISHDEYGTITIGKQWGAWYDVVYNTNYGFVWDGNSAGVYTFNKDDGAVNGVGRGDKVVQYRNSIGDVSFAVQAQLKNSSFYTCDIENITEEACEVEWNAGKKEAQQVTYDYTYGGSVTYKATEKLSFMAGVNRGEFDIAYGNGEQKTAVDLIYGVGATWGDFDKNGLYAAANVHKEENHDTDNIGRLIKDAYGVETLVSYKFDNGLRPFVSYNILDAGKDYVIQPNFNADPNDVFKRQFVVVGLHFVWDPNTVLYVEARKDYSDFTSADQAQEARMSLSEDDGIAIGIRYTL

SEQ ID NO: 14340 - protein, 232 aa, Shewanella sp.
MHKSLLSASLIALALAAPIANAHEAGDIIVRAGAITVKPKANSSDVKVDSGPLAGANLGGKATMDSDTQLGLNFAYMLTNNIGIELLAATPFEHDVKIRNTSLAPANGKLGTLKHLPPTLSVVYYPLDHKSVFQPYVGAGINYTWIYDEHVGSRAQSEGFDNFRAKNSWGLAWQIGADYMLTDNIMINAQARYIDIDTRAYVDNNALAAGTRAKVNVDVDPWVYMVGLGYKF

SEQ ID NO: 14341 - protein, 742 aa, Shewanella sp.
MKSRFAYSILTLALMPHLVLAAAPNAQESKPEQENTSAAQSATQASTQALAQTNVRTDTKAPERIVVRGRAMQMYVDKETEIGTKKAVNVMELPQSVQVLTEQLIDDQAARNITDLYRSIAGVSEFSYSGVTFRGFRDDANVFYDGVRGDPYSGFSVPQLFNVQRVEVLKGPASALYGGGEPGGMINYVTKKPTFVERKELTLSTGSYDMMGGSLDFTGGLTEDLAYRLGGYYQQENSFRNNADSMNAEVAGGLLYEISEDTKLTTTFDLIKQDLGGNRLRGVPVDDAGNFLVDPSYNANEKSDFQKMDALVLQAILDHQFTDDFSVKTQLRYLTNDSDQQYHESRGWVDVNGDGKANSADGTIKREYRVQARANDEISLTNDFVYRFNALGFEHEFLFGGDYHYVETEYHYKLATDKTGVGNLNIYELNYGETDPNTYQLKDMDTDGTRANRFGLYLQEHLHFNEQWSLIAGLRFSQFEDYNKKTGFSFSDNAITPRAGLNYRPLESMSFYLNYSESFNPASLSDQEQEGGDGYLDPETGNQIELGMKNEWLDGQFMTTLALYRIEKQNVAQANPLDTGKDDGIPDLVNLGEVRSQGVEWTLVGDLTDNLTMTANYAYNDTEVIKGVTNDSLTNTFGDGKRFANAPRHQAGLWTRYDIQAIDSAIAFGMDYVGEQFSLNGQTVKPHTVFDMSWTTQWDQTQVRVNLKNIFDKEYAVSGFSERNGHFPGEPRNVTLELSHKF

SEQ ID NO: 14342 - protein, 278 aa, Shewanella sp.
MYNKINYIVMHTIILVILLLPLKSSSALIDNMDKDTKAPNIYVSSQYKPSISHFRNFSIHEANSKIKNSVESEKNTIINLSSILKPNTHNTIPYNLQFQDNTTSFSGTIGYSSRGLRLEAEGSYEEFYIKNFNESLIISSSKYYSETYNTNLQSFAFTRDNKLSITSIMVNTCYDISISHTSAVPYLCTGIGGDFIGLFNATYFKFAYQGKVGVSYLINNNILLFSDVYYHKVMGNEFKNLYIQHVANSNISEEITPILANLDIGYFGGEIGVRFIFN

SEQ ID NO: 14343 - protein, 792 aa, Shewanella sp.
MHHFKTICFLFALVSFTAYSQDKNTLSGTVYDDKNNETLIGVSIYIPELNVGASTNEYGFYSITVPAGVYTLQIRYLGYFTITETLTLAEKTTKSFSLIEASQSLDEIVIESNTERLNLKTPQMSVNNLTSSTIKQIPVVLGEADIIKSLILLPGVTSAGEGASGFNVRGGAADQNLILLDEAIVFNSSHLFGFFSVFNPDVIKDVKLYKGGIPAKYGGRLSSVLDIYQKEGNSKDFNITGGVGLVSSRLLIEGPLEKEKSSFLIGGRSSYAHLFLPLFDNDNKAYFYDLNTKVNYRINDNNNIFLSTYFGKDVFGINESFVTNYGNTVVNLRWNHLFTDKLFSNLSVIYSDYFYGLVLDFVGFEWNSGITNFNLKYDFKNYLSEKIKLSYGINNIYNKFNPGKIIPNRADSGIVASKLIDKYANEFAAYIDVEHKINNNLRLQYGMRYSNFTRLGQDALNTYENDQAVLYNKEFKKYESAEATGTETFKRSDVISSFNNLEPRFSVSYTVNDETAVKASYNRMVQYLHLLSNTASPNPLDVWAPSGKFIKPQLLDQYAIGYFKSLKDGKYTLETEAFYKDIQNRIDYINGANLIANNQIETIILNGKARAYGVEVLLKKNEGKLQGWIAYTLSRSEQLTAGRTANEPGINSGEWYSTPFDKTHDFSINASYQLNEKWKFNSNFVLQTGQPTNYPVGQYEVQDLNVPIYDDNKRNADRLPTYHRLDIAATLTPKKNKNRRWQGEWVFGIYNLYGRQNAASLAFRQNRETFKNEAVQTSIFGVVPSVTYNFKF

SEQ ID NO: 14344 - protein, 940 aa, Shewanella sp.
MMRFKPSLLTLALIAAGASMHSYAADEVTTDKEAKAKEAAIEVIEVKGFRTSVIKSLNDKRFGDTVSESISADDLGALPDQSIADALTRLPGVTAVRTGGQASGLNIRGLDGDFVFATLNGHEQVTTGGKRAIEFDQYPSELISQAAVYKTPKASLIEGGVAGTVELKTADPLKSDKDQSFNINARGSFNDRADEISDAEQYGNRLSLAYQGKFLEDTLGVALGYAHLYQPYVASQFIGLRFNDDKKDVNGDGVAESISEGFELQQKGGDDTRDGYMAAIHWQPTDSLSVKGDLFHSKFTSENFARGFRVKSLKNGTISDAVVENGSMTGGTVSTDGNDNFAVFVINDNDSKYSELTSGSINVEWNNGGALTVAADVSYSKADGEFVNGGTRAVLYDDLGNEVRSAESINYQLHGLNPADVNFSNDYTNTATLGLKEVGMWPYDQQNDLVAYKLDFNYVLDSSFLSSVDFGLRYSQREFNAQRSQAGYGFEFGKNPTNQPVLQMNTDMTNVVNFGGELSGYPNFLSVDFNKAIELVNAQLAATGQSPFTPTANWSNNWTMIQSGSVNEDVLAGYVQGNLDFDLGDIKVTGNVGVRVVHTDQSSKGLQQVGYGLGEAITDELGVISNDYIRNEIGKTYTDYLPSINLSFHLTENDQLRFAAASVMSRPPIDKLKSGMGSWYDDSATPGYKKYNAWGNTSPLLDPFYADQYDLSYEHYFEDSQGAVVVALFYKDIKSFINNFTIQPYDFEGNGFIVPDTIVDNGVEFPVVKDEGQYQTAINNDNGGYIRGVELGYTQVFDFLPSPLSGLGFTGSYSYSDSEVEFTTDLSGSNLTIPLPGLSESVLNTTLFYSLDGFDTRVSMRYRSSYVSEQVAVESQLAFFDAETIVDYQASYALENGLKFLFQINNLTDEPNKTYFGEEHQTGTIQYFGRQYFLGLSYSL

SEQ ID NO: 14345 - protein, 742 aa, Shewanella sp.
MQSPGLHGRADAAAALDRLLTGTGLVALRQPSGGYTLVRSPAGPAAPSAGAALATDTTLPTVSVRASGLHADSYRAPREAAGLRSDAPLAEVPQAVNIVAPQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLTRHNAISVLGSTYGHGRNGGELTFDSTGAIGDSRLAYRLIVDQTNEQYWRDYGEHRETLVAPSLAWYGRDTQVVLSYEYRRFLMPFDRGTALDPRTNEPLAIPARRRLDEPFNDMRGESNLVQLTVDHQLAPNWKAHLGYSYNRETYDANQIRITAVDPVKGTLTRSNDATHGSRSTDSYAIAYVDGRVTLAGMRHDVQFGVDSEYRQVYRADMLRQAIKTPFSYLNPTYGLIPPSTSVSASDSDQSDTLHTASLFFQDSIHLTDKWILVGGARFVRYSQLAGRGRPFRVNTNLSGTKWLPRAGIVYKWNDALSLYGSYTQSLKPTSKIAPMSGGYVIDGSTAPEQGASWELGAKLDLPSGFAGTLAFFEIDKKNVLVSQYNDATNQTDWRTSGRARSRGIELDVSGRIGERWNVIASYAYIDAKTTEDPLYAGNRLWNVARHTASLAAVYDAGAVFGGDDLRIGAAGRYVGARPGDSANSFTLPAYATADAFATYDTRVGKQKLQFQLNVKNLFNRTYYPSSVNRFFVSVGDARQVSLLTTLQF

SEQ ID NO: 14346 - protein, 944 aa, Shewanella sp.
MFKQTYLASAIILALTSQATFAANNDIAPQDQVEVESTTQEETQADNPRPNEEAMEIIQIQGIRGSLNKAVELKRQNVQVVEAIIAEDIGKFPDNNVVEALQRVTGVQVTDRASGEVNTVSIRGLTDVTTTVNGRQIFTAAGREVAIADIPSALLGSVEVFKTRSSSQVGSGIAGQIDIRTHRPFDFSDSKVSVAAKGIYSDQPDKVDPALSALVSDRWDTAIGDVGALLNVSYIRTNYNDQVVSPGASLPYSAETGLLVNDAYWTRGLAHGLDTTKGALINGEEYLLMRDAIFQNMNVGERERPALNLSLQWAPTDNSEYLFEAFYNGYRNNSANAMLFSNVDSADNWSQVIDNGIEIYDGTNVVKSRTAYNVGGFSSSDHSHNSTDSYVFALGGKWDLDDVTLKSEVVYQTSTYESSFIAMRGISANSNKKFYGVDVDYNNKSGGVPSWAYLDDPSTAINESDLSQLALWQTSNMYDSGTKDEGDSVAWTLNGDYYLDYSIFTKMKFGTRVEKRGAKHGLYDAGALDKNIKFTDLDPNMFTVASGFFDGRGNVPTNWALVDGNYLYANRAAIEALYGADADALAMYTNYDIDETSYAAYIQSDFETELWGKQVDGQIGIRYEKADADMDFWERKQDTVTEKYYLEHSSDTNGSSEILPNLMVRFWLTDELVARFSYSETIRRPAFGDLSTAISYVEDLTNLGFGQASSGNSKLKPTTSKNYDFSLEYYFGEGSSIYGTYFRRDIEGFVYNSTTTTTREVDGEIKTYLLSRPDNSSNGELTGFELGTVYFPENLPSYLDGIGTQMSATFLDSSQDIPEYDSKTGEKTGSTTRELFGVSDTSWSAILIYDKEVYSARLSYTWRDKFLNAYDAGSFAMPRGIYRKPEQSLDFQFSYNLMDDLVLTFDATNILDDVYQEYYEDSVLFNRTNSIYTRTFALGVRYSF

SEQ ID NO: 14347 - protein, 855 aa, Shewanella sp.
MIKRTKVASAINLAVVSSIAAGTFVASSAFAAEEAAKVERIEVTGSRIQRQDMETASPVTVIDAAAIKAEGFTSVDQMLQVQTSMAGAAIGSTTNNGADGVAQVDLRGMGSQRTLVLLNGRRMVNSGSGADSAVDLNSIPVAMIARVEILKDGASAVYGSDAIAGVVNIITKKDFDGFQLDFNGSGTDKGDGQNGDVSALYGFNTDGGNYTFGAAYSDRRGVIQSDRSWTKPGASSFVPNGGLVGNVLDENGQPVLDEDGVNEKEVKINQGGNWSPLENGYNFTQDSFYQTPSERRSLFANMTQELGNDVVLTADALYTNRRSNQQLAPQPADIMLNVCGQGVDPTKCVTLDNSMATAGIVADDGMVNYRRRMNDVGPRIYSQDTDTWRLSGGLAGTLDVHTGMNWDVTYTYGKNQAKTAVANSINAKDVANSIYADQDVWFSGAELSNQIGNDVSYTEKANGGNEQQTLSAGLNGELFDLSAGAVGFAIGAEYRRESGFYNPDPIVVAGESTASQQDPTDGNYNVISIFQEVSVPFTEKLTGEFALRLDDYSTFGKATTWKIGLTYNATDELMVRTVAATGFRAPSVSELYGGNSGSFDYLTDPWGKELDEQIEVNYISDADLKPEESDSYTAGLVYSPSYLDGMSVTLDYWRFKVTNAIARANTQDGLDACFAGDTAACDQFNIGAGGDLTNLSNALTNVGSQDTSGIDFNLAYNFELIGLDWKVNNDTTYLVKFEQDGEEYTGTIDGNFGAYARVRNNFSISAGQDDWNVMYFNRFIGDMRDLSKGYNVGDILYHNISGTYHINDMATISFGVKNFTDEKPLTVSNGSDGGTVPEVYDTIGRTIYGGVTVKF

SEQ ID NO: 14348 - protein, 731 aa, Shewanella sp.
MTTQSFSVRTAALPPQRRFSTALLALTVSASAQAADTAAPAPAQLAPIDVTERAQPGVKTDHSASPKYVQPLLDIPQTINIIPQSLLREQNDNSLREALSNVSGITFNAGEGGGGSGDNINIRGFNASTDIQVDGLRDTGQTYRSDLFNMESVEVIKGPNSVFGGAGTTGGNINLISKRPLNEDFIRADTALGSDRYRRVTLDANQTLPGSAAAWRLNLMAHGNDVPGRPRVDRKRWGIAPSMTLGAGGATQWTLSYSFQTDHNLPDYGVPARNGAPLAGRNAYFGWRNLDRENVDSHVATSDIQHRFDSGLILQNLTRYSKLERDTVISAAHINIRGLPVGYYKPAGPQAYGRDSFNTLAANQTNLRTRFELLGMTHQMVAGIELSDETYHRKTYGYGIASHYPAGGYPLARPPGHWTGPTQRKTSSKDRASLQTRALYLMDNISVSPQWDIGVGLRHDWVRGALHSMPVNGAERRLKTNDRALSGRGSLTYKPTEAGRIYLAYGNSFNPSAEWLVTTGRGVTAANQGLAPERNHSWELGSKWELIERQLAVNAALFQVTKQNARETQTDGSTTLSGKQRVRGLELGVAGKLTPQWEIYANYTYLDSKTLKFASRPGQEGRPLGNTPRHSASLWNTYTWHSGWRAGYGLRAIGKRAVSSSGGGELPGYIVHSMMVAYQVNRNLGLQLNIDNLTDKVFIERVRQNAGSDARSSAIEYGSGRSAILSASWRY

SEQ ID NO: 14349 - protein, 649 aa, Shewanella sp.
MPAQPDIRLPRFSRNALTCAIALTLSAAATLAQAQDAPEMERMVITATQTKHSELSAPASVSVINRSELEALVINDLASAVRYLQGVNISEGTPYGRNEISLRGLDSDYTLILINGRRVNSREALTSNYGNDFDLSSIPMSAIERIELVRGPMSSLYGSEALGGVVNVILRQPTENWQTSVGVQYDTPTSGKGGDSTKYNFYGSGALIKDKLLANLIVDSNKRDAWRSDLKPTIDALEDRDEISALANLQWLIDTQQDLQFDISYANDERESDWNNYGTILTNNQQAERISSGLTHNGRWDWGDTRLRYYYENVEVTDDSALIAQIGHITQTNHNLDGQTTVLLGEHMLTGGAEYRWTKLENSRNILGDGTLDDSQAALYLQDEFSLGELSLTLGGRVDHHDVYGTEFSPRLYLVYPLNSEWVIKGGGGKAFKAPNMSQSQADYIIPACRGACSVAGNGDLQPETSVNYELSTQYQAADFGGSVTYFHNDVENKIITETWDRTPGAVLTYQNVNEAKITGWELQAWYDLTDSLSLSGNYSKTDAKDKQNGTPFTLTPEDSYNLKLQWQALEGLSTFIAYHYTGEQYLRTKVKSDGYGSLDIGVNYQINPMFRVKLGVTNLTDAERDQIATDLDYIQKSRSVYAGVTASF

SEQ ID NO: 14350 - protein, 418 aa, Shewanella sp.
MRANSSCKLLCGLSAAIAANLTPISGNAAGFVEDAKVNLNLRNFYINRNFVDPANAQNYAEEWTQNFILDARSGFTQGTVGFGVDALGLYSLKLDGGKGTGGTQLLPIHSDGRPADDFGRLAVAGKARFSKTELKVGEWMPVLPILRSDDGRSLPQTFQGGQITSKEIDGLTLYGGQFRGNSPRNDASMEDMSLNGRSAFTSDRFNFGGGEYVFNEKRTQVGVWYAELEDIYHQQYFNLLHSQPLGSWTLGANLGYFQGKDDGQSLAGDLDNKTWSALLSARHGGNTFYVGLQKVSGDSAWMRVNGTSGGTLANDSYNSSFDNAREKSWQLRHDYDFAALGVPGLTLMNRYISGDNVHTGTITDGEEWARETELAYVFQSGAFKSLSLKWRNSTMRRDYNTNQFDENRLIVSYPLSLL

SEQ ID NO: 14351 - protein, 737 aa, Shewanella sp.
MEFKIIIMKTFPLNRLAAHCQLAITRPELILCSAILSMPYAYADASDTQKKSTKDIEIINVVGAKDLHDNRYKTQAMNTATGLDLSYLETPQSVTSVTSQMMHDQQLNSVIEAMTSVAGINARPMDNDRYSISSRGIAVTSILYDGVPTTYDTRFNYGDNLIDTAIYERVEIVRGATGLMTGAGNPSAAINLIRKRPTQEFMGSTSVSVGSWNNLRGMVDLSSGLNDSGSIRGRVVAAYQDKESFQDRYEQQRTTLYGIVETDITDSTLLTLGVDYQDTTPEATMSGGLPLFHSDGSRTNYDRATSTAPDWASAHTQGLNTFASLQHRFDNGWELKGTYSYGDNSLKYNVLWATGYPDPVTNLGATAGSIAYVDGSRTQHNLDLRAQGMFALFGQEHQLTFGWTGQRQEFANPYYYPTAAVPPLGDFRDPNFQYPKPQWKETHTTGSFGETEQSAAYVATQLNLTDALALLAGLRLNQWQTDQDNFGSMYDFKVDNELTTYFGLTYALSEQYSLYASYTDIFAPQTLQRIDASYIDPVKGKNYEAGIKASLMDESLDMSLSVFEIRQDNVGERTGDVLPGTTIPVYREVNGTKTQGFEFESTGKITDDWNIYFGYTQFSTDDPKGNRINTSSPRQQLKLFTTYTFSGDWNKLQLGAGVNWQSRVYQTVNSPLGRVEVEQGSYALASLMASYAFTEQVKLSANVHNALDKTYYSQVGQFSQYQYGTPRSVSVNLDYRF

SEQ ID NO: 14352 - protein, 431 aa, Shewanella sp.
MKSFNKTLLAVAVALASSQTFASGFQLNSQSATGMGRAFAGDAVIADNASVLSRNPAAMALFDKDAISFGLTYADITVDVKDVNFAGGAYDLGSIDDAGSSKVIPNIFYIHPIDDKFAVGFAAFSNFGTGTDASSLSKNLPAGSPAPFDLLGETEVTTVNFNASVSYRINDMFSIGAGLDAVYGEGRLTRNMGTTPLVDVDADGWAFGGIVGATIELDKDNRFGISYRFSPTVNVEGDINTVSMTTIPGVGAVPVTTSFDSLDVPLADIFQVAGFHQITPKFALHYTAQHTQWGNFDQITAKDGTATIAAVGMTQPVGDVALKEYQWKDSWLFSVGGTYTINEQFTVRAGYMHDQGVVDEISSISFPDSDRNWFTAGMSYHINPQNTVDFGIAYIKGEEVHLIENSAITGPVNAVTESSGMYYSVQYSYQF

SEQ ID NO: 14353 - protein, 279 aa, Shewanella sp.
MKNVKTLALAATAVAAISGNAFAADRTDLHGSDYKWMQFNAMYSIGEKPDNPASGDQHNYLEMEFGGRSGIFDLYGYVDIFNLANEKTSNGDKNPGSGTSKLFMKFAPRVSIDALTGKDLSFGPVQEVYFSTLFNWDGLNGDGVNSTFWGVGADVNVPWLGKTGMNLYGFYDMNAKEWNGYQFSANWFKPFYFFDDKSFLSFQGYIDYQFGADADKTAFVPKTSNGGNIFFGLYWHSDRYALGYGLKGFKDVYLLEDGAGALALESTGWSHYLSATYKF

SEQ ID NO: 14354 - protein, 723 aa, Shewanella sp.
MLFIFGVKMAVYISHKRSAFVLGVALLALDASVPLLAAEAMPTDTVGLNGDIERLSIHYRQAYRGNVPATELPQAITVLDEQLIKDTGLTRFQDLLDYSASVARQNNGGGLWDSFSLRGFPGNENMPSGYLINGFNGGRGFSGHRDLSNVAYVEILKGPGSALYGRSEPGGTVNIVTKKPQYEAQGYLKASAGSFDQYRLEGDFTSGLTDSLAFRINGAWQEHDSFRDYVFSDKKIVTPSLRWQLSDRSSLLYEVEYLKQEQLFDRGVVVLNNDFNTVSRSRYLGEPNDGPTKVDATGHQLTYEYELNEDWSLTAGYNYRDSSLNGYSSDAELAKGRQSLYDDGRTLTRQHRYRDYASEDHSVRAELSGQFDTGSIRHNLLLGTDAYHYRLKTGLYRYRGQKGAYAIDIFTPQYGAAQPEVSLLYENRETQDAWGAYLQDQLELTERWKLHLGLRFDRYSQEIAEQVNASLSDQSDHRVSPKVGLVYQWSEALSVYGSYSEGFLPLSGTDYAGNPFEPEESKSVELGVKFNSTWFELPVNGSLAWFDAQKSNILTSDPVNVGFSATLGEAKSTGIELDITAELTENLQASLSYAYLNTRTANDSLNLDWGVLIPAGSPLVNVPKHTGSVILKQDLNDLSIDGHLGLSWRYVDSRLGDSADPSFQLPSYQLLGMFFTTRLGENLSLALNVDNLLDEHYIASSYSALWAVPGEPRNVKVSVSYEF

SEQ ID NO: 14355 - protein, 1079 aa, Shewanella sp.
MTMQTKRAAAALRRHLNVLKLGTGAMALAVASAWVVPAVAQETTSSIRGQIFTAEGEPAAGVNVEIIHTPSGTRSSAAVNSQGSFLATGLRIGGPYTIRFTGSGIQTQQVENVFITLGEPFSLDLVLQSGQQQSVEEIVVTGQRTTALVIGSGTQFDRRAIENTPTATRDLKDVIKRDPKVSLDPTNGNAITIAGANNRFNSLTVDGVKQNDDFGLNANGYPTQRVPISLDAIDQLSVLTAPYDVEYSGFTGGTVNIVTKSGTNEFTGSLFYYYSDDNLSGDRSKDNKNIISPYKDKTYGGSIGGPLIEDKLFFFVNYEKYSGDSSISYGPEGSGAGQTVRGITQAEYEQVAEIARRVYGYDAMGLGEPQPESDEKILAKVDWNLTDDHRISAAYQRDEGNNYVTSSNNTRLGYDSYSYDRSQKMESYSLQVFSDWTTDFSTEAKVGYKKVDSLRPTTSPLNFSSIIIRDPGGSQFVLGTESSSQSNVLETETLSYKLKGTYLLGDHKVEAGWERDDYDYYNLFVQRSLGEFEFNTIADFEARRASRFRYNSAAGTNNPLDAAADWGYKVDSLFVQDEWNITPDFTLTAGLRYEYYSSDDKPRLNTNFVSRYGFGNDENLDGRDLWLPRAGFNWKVQESTTLRGGVGLFSALGPTVWMSNNYSNDGITQVGVDIRRANTTPANSILNNVDPNSSAVVPAAGQLLASGSDSFVNALDPDFKIPSTWRASFAVDQVFDLGPLGSDYVVTAEAIYSRVKEAISYTDLRLVKVGTAPDGRPIYQSRADGRPSIGTNSDLMVTNTDEGEGVVLTLGLAKTWETDYGDFDLGAGYAYQNIDEVHALTSSVASSNYENVAVSDPNDPGSDTSDYEVKHRFTTSVSWSKAFFGDFETTLSLFHESREGRPYSYAFRCGSSGGNANPFGDPACTNNNRSRQLFYVPSGANDPLVTYAPGFSYDQLLPYLEENGLTKYAGRIAPRNGFTSPWVHTFDLHIAQEIPGLLEGHRGVFTFDIRNLGNMLNKDWGRLEQVSFSAGRTVDVLEARIVDGKYVYAPGSAGLKDPNSQVSARSSVWSILVGVRYEF

SEQ ID NO: 14356 - protein, 683 aa, Shewanella sp.
MSSRYFVMSLTALAVSCVYTHPLKANPLYSQTLDLIELNDQYHSSDDGMQLSYLNSLTLLRADHSGNTANISMRSASQGVAVMQDRVYFSPAPYSAPQLQLLPNLLLQQNVTSIPLADMTVGGQGAFGVVNYQSLEIANRPQSGSFLVEGSTESDLNAGMSWGVKQKEYGALFAANYQKEQGDANFFNGSDADRTKTDMLFKVNAASLLGARSPQQTEFTYQFIDDNSYRSQLGVTTADWQQDPLLLYSATAQDKHKGRQHKYQLSHQVDLGGSKVISDFYYQSYSQQLAQLGLFNGQEIDTATLADIAAFDRAPSANGADLNLLVQDNDYSAFGAQTQAINQYGEHQIIYSARYHTDKAEMRFGEQTALWQADRSLAVDESNALFAYTDDATALTSAIDSLFRWQGMQIKLGLTYEHVSVNREVNQPVARLDEADFSDSDWMPQLGVLYDAGDWRFSTDIRRAWTAASAGNTTQEAQVSLHYQVSAQYAREGIKADLRAYVQEFDNLHVDCDSYSMCADARLLTQENIPDVLTYGVELGLGYRWDLGGVELPLGLNYQYLSAEYQTSTCTDVQGCVLEGDRLAWLPEHQLQLSAGVNYGEYQLNLEAAYQSERDFSQFGSELQRVSGQWRVDLAANYDFDKHHRLYFRVENLLDESLVTAASNSGIRTENGRISYLGYQWRF

SEQ ID NO: 14357 - protein, 727 aa, Shewanella sp.
MTQLSPTRLSILACALTTAFNAQANSPTQAPAKIEQISIFGSKNPLDTTPGSAHQITEAELETFKYSDIMRTLASVPGVYIQEEDGYGLRPNIGMRGTGQNRSEKITVMEDGVLAAPAPYASPAAYYFPTSGRMQSVEILKGSSTVKYGPRTTGGVINMLSRQIPQETLAGKIDLALGQDGFGKLHTYAGGQGERIGAVAEIYRYQADGFREINTVGGDTGFTKNDALAKVRVNTDSTATYQQSIELKLKFADETSNETYMGLTDADYQASPYSRYSASQKDQMTTEHKQVQLNHIIDFSDTLSLSSIGYYNDFHRNWYKADKVGGESLSGKGIQNAADFDAGLLSELEVNVKANNRSYLAQGIQTELNWLLGDHDLAFGLRYHEDEMDRYQWADSYAMDANSVMLRTKSGVPGTDSNRVDSATAFAAYVQDKISLDAFTITAGLRWEDVETQRRDWGKKNPGREGNPDKQVESQFNALLPSLSATYQINEQVLLLAGVQKGFSPAAPGNAKGQEEQSWNYEAGVRYHQDAFSAELIGFYSDYSNMHGNCTAAQGCDDAKLDNQYNAGEVEVKGLELSLAHEFNRTGAMSFPVKLAYTYTDAEFGNSFESEFETWDKVEAGYKLSYLPENQLYISAGVQSQSWQVTVAARYTDEMRTKAGTGAIPADEVIEAKTLVDLSARYFVTHSQEVYLTVDNLLDETYMTTRVHGSIFAGKPQTVTLGYSYKF

SEQ ID NO: 14358 - protein, 668 aa, Shewanella sp.
MLYQPIKLAVILAGVLGTAIPQLSWSSEASDCGEDKKCQDYLRVSGDVMRQPVHLVSDPKQNRLPLPAYDGSGFLRSIPGFNITRKGGSGGDPMFRGLGGSRLNIVDDGQHVYGACGGRMDPPTNYIYPESYDQITVIKGPQTVKYGPVGTAGTILFEKNRHRFNQADLEGRASATGGSFDRRDAMVELSAGDKNYYLDLDMNQSSSDHYEDGNGNKVQSSYDRQNANLALGWTPTERTVLELAYGESSGEAEYADRLNKARQIDNRDAALLLQHEFESSWLTAVELQAFSNKNDHIMDRFDEGVNSGANVRRMTEGGHLWFELAPLDALELTLGLDYMSSKHDGRSMAPGDVGLDDLLNKPFKEDMRYQNYGLFAESRYRFEESDLGSSSLHAGLRLDDWNSELLIAQQGERDDTLYSGYLRYEFQTAQHQYYAGFGSAQRMPDYWEIMKASADNPAQKAFDLKAETTNQFDIGWIYQGPVEASVSLFYGEIADYILIDSSGQATLARNIDASLYGGEASLDYALNEQWSSQLTVSYTHGENDTDKVALGQISPLEARLTVNYQWQSWTMAAQWRVVAAQDRYTLGHGNIVGQDLGPSSGFGTLALNASWSYNKDLSLILGVENLFDTAYAEHVSKAGTGNDLPGSEAMFRVNEPGRNLWAKLTYQF

SEQ ID NO: 14359 - protein, 1210 aa, Shewanella sp.
MSTIYNRFKLTALSAAMLTAYGTAYAQEDNPEADANIEEVIVTGIRASIEKSIDDKRFSKNIVDTINAEDIGKTADQNIAEALSRVTGVSLQSRDGEGTTITVRGANANQNNITLNGATLTSTDFSQAVDLSAYSADILSKVEVVKTPSADHDEGSLGANVNLVTAKPLELKDNVRSLTVQGRYNDFVDDTNHKISGSFSHTFLDDTLGVIVTAYDETSSIRRDQFRVDDYVASNTARIARDQNGEVITNVRAIVPSAMGYELHQNESNRRGLTAGVQWQPTDTTDVMLNVTHSEQSLVNSFTGLKTRRPNTPNFFEGEEVIPGFPAAGFTDPQQDWWTIDTDTRTFTKYVNRAGPGDLTTSEGGSDNTNSVVSLELNQDITDTLRVSVKGGYSKSEQVTIPDNAWLNMQNYMHVPGQVVMAIGPYGSEGGIEPVGYDCTSGECTMVFGSGFVDLGENITAYEEVDDDGILQQRPGWWDNTATTTFNPQDLRAQGISFLSRTDRKVEDKNQSFQVDFDWDVDKFGLTTAEFGAKYASRSKFVDDQSYQFSSSEVADIIRNDEGHAIAVPGGSLLDISGEMITTGESFPYDDFMSSLGYGRDNATIGWTPVSGVKALELTQGAADIVGTRDDTDTRSADLDTIAAYIKTSFAFMDDRLTGDIGLRYVETEVVATGYSGFTFASDRGNNLERVFDHVKLAELRDTSLPACPEPGMYFEDENAPLAIERHLERIDGLGYDVNSGSPDTWTPIPDAGACHEPLLAARAEFITSGATGEAPFVNWETMQRHADISQSHIYAWGANWGKEFDENGALVNTNQEDRSIVAIPTTNSHKYSTILPSLNLNYIIKDDLIGRFAISKTMARPPIDQLRPGFSGTEDPWPGRTNNQVDMYNTKLDPLESKNIDFSLEWYFDESAMVAGTVFHKDMTNFATVESLRTYLDDLRNLDTSVPYDSSQLAVIATDNAADDYGLASCFPKRSIADFPFDTRDENWSDDLRDLCAQFNVNKTVNGSGATVTGIELQYTQSYDFLPSYWAGLGTSVNYTYQQSEYDKEQSSIDSNITLPSYPVADTPEHTYNATVFWEHEDVQLRLAYRGNSDSLVGTDSNNGRSGRTWNQGSLWNEGRATLDFSASWQVTDAVDLTFQAINLTDAENRTYFTSRTLAIDPIRDENGTITGWEEYDEGTPMDNDATTSRTVARYKNGRTFRLGVRVNF

SEQ ID NO: 14360 - protein, 745 aa, Shewanella sp.
MPKSMGPISLVAAAVICQLGLINVATAAENEMERMVVSATRSPTQISDLSSTVWIIDEASIREQTDSGKGIKEMLAALVPSMDVSSQGRTNFGQNIRGRAMVVLIDGVSMNTSRSISRQLDSIDPFNIARVEVLAGASAIYGGGALGGAINIVTKKAADSSDTFEAEAGFKSGFNSSDDLDYRTALAVTGGSDSLKGRFSAAWQENGQWFDGSDNPVMLDISQTGMQYTQGYDLMANMDWQLANDASLSAMAQYYRNGSDEEHGLYMGENFSGVTGDASVLETRKGLDADRSPATERTLLNLSYSQDEFLGQTLYLQGFYRKENLDFHPFPYVNETSGVYNFSASAQNTSIYGLKAVVESKPVDSLTLTWGLDWDKESFDSNQMSFDLNAANQHGGLVMRELFTTGRYVDFTVESIAAFIQSSWEMNSFLVLNAGYRYQHMENSVDDFIGYNQQVAIASGKAKGADAIKGGSTDYNIGLVNLGLVAKLSQDQQLWLAYSQGFELPDLSKYYGRGTYKADADGYLQLQNSININDTRLDGIKTDSMELGWRYLADRWQAQASVYYAVSDKVIEVNSKDLTINVKDQDKRSYGLEAQLNFDITSDWQVGTNLHLVRSEVKDEDRWNDETVTYASPSKATAFIGWRGETQKIRLQAEHSFSAESDYRFKTDDGLASELDSYTTLDLLGSIDLPVGTLSYGIENLLDKDYSTLWGQRAVYFYSPTYGPESMFDYHGRGRTFALNYQLSW

SEQ ID NO: 14361 - protein, 723 aa, Shewanella sp.
MTFKTSFVALAVFAALTQSAAAQEAPDTGTNKNKDIEKITVTASRMDKSPSSIPNTVTIIDRVQLEEQFRTTKDLSTIIGNLAPSFSPSRQKMSNTGETLRGRPPLIMIDGVPQSNPLRSGGRSGQTIDPAMIERIEIIHGANAMHGLGAQGGIINYITKKPTGDNQHVTSFDVTVPDSLKSNGVSFGASYAFSGESELIDMLGSVSYRNNGVYYDANHDVIGVDTTQGESMDSQSKDFFIKLGHNFAESRLELMVNHYNMENNGDWMPVKGDITTGKPTGAIEEKQPWEAANNQVTTTSLTYTHENIAGQQLSIQLFNQDFEAVYGGGCNKTFYDPALANNDNLVQCEGPKGESWYYEQSRNSSVKWGLKTSLIAKNIADTGIDAAYGIDLFRDTTEQDLVQTGLSWVPESTYDNFAPYLQLDYDLITDLTLSTGVRYEHAKLNVDDYKTLYGAGNKQIEGGEASFDETLFNIGISYKITPDIRVYTSYNQGFGMPDIGRILRDGNSFPGANPSISDSLSLAPIVTDNVEFGADYQGEYLSAKIAYYRSATDYGARLALNSDGFYDVKREKSVIDGIEANITAYLTSNDDLGMNLAIQRGEYDSNDDNNTDTDLDGANISPNRINLFWTHNFDNEMSTRVQANYFMDRDFEDATGEKYAEFNGYTTVDASFSMPLYTGTLTLGVQNLLNKDYFNYYSQTMGTNDRYFKGMGRTATIGYTVAF

SEQ ID NO: 14362 - protein, 137 aa, Shewanella sp.
MKKLSLVAVSLLSALVAGQASAAADTTGFYVGGALNRVAVDVVDDSDTGTGFGVYGGYNFNEWFGLEANLFATADLGDRDTDVTAGALTFTPKFTLQINDMFSAYAKVGVASMAMNFDGFGFDEDFTWFWLDIWRRY

SEQ ID NO: 14363 - protein, 747 aa, Shewanella sp.
MAIEPVKEGNVIAGHVIEKGSENSLPYATVLIVETGKGTVTDAEGYFRFKEIPAGEYTLKVQSMGYNTQTKKITVSKDFTVDVHFVMEEETIMTDEVVVSANRNETSRKVAPVVVNVMSNKLFEAVNSTDLAKSLNYQSGLRVENNCQNCGFPQVRINGLEGPYSQILINSRPVMSALSGVYGLEQIPTNMIERVEVVRGGGSALFGANAVGGTINIITKDPVSNSFQVSSTMSNLNGKVWEQYVGANASLVSSDNSYGIALYQSYRNRNPYDADNDGFSELGKLNMNTFGLRSYYRPTQFSRISLEYHTTNEFRRGGNKFDLQPHETDITEQTKHIINSGGLTYDVFFNEYRHKLSVYGSAQHTDRNSYYGADKNANAYGKTKDLTAVGGAMYVGNMDDCLFSPATFTGGVEYNYNSLHDVMTGYNRDLRQYVRIFSGFAQNEWKMTYFTLLAGFRLDRHNLIDNIIFSPRVNLLWKPTDKIQGRLTWSTGFRAPQAYDEDLHVAAVGGEAMIIRLADGLKPERSNSFSGSVDWGFNFGHFQSNLLVEGFYTSLDNVFYLTKVGTDADTGAEIQERRNGYGARVYGANIDYKIAHGREAQLQLGFTVQRSRYTEAVSWSEDQDVDPIKRMPRTPDYYGYFTFTSAPLKNFDFSLSGVYTGKMVVPHFAGYIEKDRLEHTPNFMELNLKLNYTFVLNDHLKLQLNGGVQNMFNAFQKDLDRGALRDSKYFYGPTQPRTYFIGVKFFN

SEQ ID NO: 14364 - protein, 706 aa, Shewanella sp.
MVFKYSVLGLAVGSALMAMPVLAEVASDANIERINVTGRTFNDYKVGTASGAMRGDIDLMDTPQSVNVIPDFVTDEQLATNLAEVLVNDSSVTAGTTRWNRQVFSIRGFELDSSNGYLINGHQQWSHYVQPIETLQQVEVLKGPSSMLYGQSGPGGLVNMVTKKPTYDSMLNLGFDTDGYGSTRAQLDAGGSLNEAQSIRYRGVLVKQDTKYWREYSANDENQERDRWLGYLNMEFDLSDDLLLSVKYDHTQDKAGIDAGGWLDKQGNVIGERKTVWDAPWAFTDNTVSNLGADLTWHMSDNWKVKAGYNDQQFNRQRFDSAPSLIEGSEDPFKDGYKIKPFDRYDDWQHKTAYADFTGEFALAGMQHQLLIGANYLDYFYQQQIHRGAAQTVIPGQPITQPALDYHTKPKGNASTYKYYGFYLQDLMTLNEQWKLLAGVRYDEQKKDAIGGNSYAVSPKFGVIYSPMANGSIYINYSKSFTPQGSVTSSEDVNEGDNLKPEYGTQYELGTKWELFDDSLLLTAALFDITVSNVTIEQDIPETSDGKKTITTQGGEQHHRGFEVGAQGQLGESWFVTSSMMYLDAEYKTGAGKIDGKILDGKTPIDAPEWSANIWTRYEVTDNFAMNFGAIYVGERFADTNNTISKDGYVRFDIGAAYTMDIMGKDVSLRANVRNLFDTEYLDGGSDKMVTIGQGRNFSVAVEAKF

SEQ ID NO: 14365 - protein, 807 aa, Shewanella sp.
MITRLRYCFSVILFTLCFTVFAQDFSISGKVVDANGSPIELANVIISVENGNTFFKGTSTGDRGFFKLENLSKTTYFIKISYIGYEDFDQKIILEGNLDLKIIQLQEIPESLDEVTVIARKPTLTRKPDRRIFNIENTALTEGSTLGVLKSTPGVIVSESSINIKSAPAAVYINNRKVQLTNEELIQLFENAPANSIKSIEVITNPPASYDADSGAVINIIMSKNLITGYRGSVFTNYTQGVFPRYNAGTSHYFKNDKINLNVNYSYTNKKINRDQDDTVNYLDNSNEIDQIWESNVNRNTWSETHNLNLNFDYYIDERNTLSLTSTGLYLPYFKYKIKNNTNITDDNQNFLSRFTADNLSRDDKYNIGSDLTFKHDFKNDASLTFNAHYTIYDYQRNQNVLSNFFDQNNMFDDSSEFKTLANQKTNIVTGKVDYNLPIDETSSFDAGIKYSNVKTDSDITRLDIIGGSEVINTDNTDAFNYDENVFAAYSNYSKSWDKWDLNIGLRVEQTNIEGESLTLSETNTQDYLNWFPNASLSHQISEDVSAKVNYKRSITRPSYTDLNPFTFFLNENTVVLGNPNLVPTYFDHYVIGTTFLDHFTIEAYYDNYDGDIVELPRQNNQTNVIAYTPTNLDKKTEYGFDFAFENYITDRWYLYAVTSFYNITEESDFGEGFIKQDQWSNYSVLQNVLFLLEDNSLNVNLTLTWVGKNLQQFQTIEDRLVSELSISKSVFNKKGVISLAIDDIFNLQDYDSSVQYLNQSSRSFVDSDNRFIKLGFRYNFGNTKLKTNAPDPDEEEREERKRLEDN

SEQ ID NO: 14366 - protein, 758 aa, Shewanella sp.
MECKKIIAGFFIYAGFVSSVFSQTTGKIVDANQHPVESATIVMQLPDSTYLGATISAADGTFVLEPEPEDYQLIVQHLLYQTRQVKGQARDVGVITMEAKDYNLEEVVIEGERPFVTVEQGKLNYDISAISEKHIVNNAYEAICKLPGVQDRNGKLSLVGAKDVTVILNGKASTLTQEQLIEMLKNTSASQVQTAEVMYNTPPEYHVRGAAINIVTAKADDNTIQSELSASYSNQYFSSYSGNVNFLLTKGKSSLNVSYNPGYSHIMTVMDLASQHTYDGKVYDITQTQKINTKGWKHNIYAEYGYQIDEDNELSVGYNGALSDNGKGTIDVNGNFQNSHNDKLQDSRLHNVFARYSSGFGLDFGVDYTDYTMNDKNCLESKLTDNTRQLLDYTSDQKIRKFSIYADQSHALANDWTLKYGVRYDYTDNKNAQFFNQTEGKDNVGNSSSRLYEQITNFYGGFDKEFENGLSLSLSATGEYYSIGDYHKWAVYPQASLTYSPSEKHTFMLGVSSEKDYPTYWDMQTSTTYMNAYEELQTIEGLRPANVYSVNANYLFLQKYMLSLFYERTNDYFTMDMYQAKDRLALVYRTQNWDYYQSFGMSANIPFNIGEWLSSQVNATLVNDRNRCDNFWDTPFDRKKWACMLAMQNHFSAGSNLGFDLDAMYRSSMISGISDTKPVFTVNVGAQWNFLKDKASLSLNCADLFDTMRMKVRNRYAGQHIDLNMGQYSRTVSVKFVYRFGGSISKEKKEVDSSRFGR

SEQ ID NO: 14367 - protein, 725 aa, Shewanella sp.
MTFKTSFVALAVFAALSQSAAAQDAPDSSSNNKNKDIEKITVTASRMDKSPSSIPNTVTIIDRAQLEEQFRTTKDLSTIIGNLAPSFSPSRQKMSNTGETLRGRPPLIMIDGVPQSNPLRSGGRSGQTIDPAMIERIEIIHGANAMHGLGAQGGIINYITKKPTGDSEQVASFDVTVPDSMKSNGLSFGASYAFSGESEFIDMIGSVSYRNNGVYYDANHNVVGVDTTQGESMDSQSTDFFIKLGHNFDESRLELMVNHYTADNNGDWMPVAGDKPNGVPTGAVKETQPWEAANNQVTTTSLTYTHANIGGQQLNLQLFNQDFKAVYGGGCFDSFYDPSFEGSDQVIQCGVGSKGESLYYEQSRNASVKWGLKSSLIAKDIAGSGIDAAYGVDLFRDTTEQDLVKTGFSWVPESTYDNVAPYLQLDYDLIENLTLSTGVRYEHAELSVDDYKTLWGAGNKQIAGGSATFDETLFNVGISYKITPDIRVYTSYNQGFGMPDIGRILRDGKSFPGDNPSIDDSLALTPIVTDNVEVGADYQGKYLSAKFAYYRSATDFGSRLALNGDGFYDVKREKSVIEGIEANVTAYLTSNDDLGMNIAIQQGEYDSNGDNKVDTDLDGANISPNRINLFWTHNFDNDMSTRVQANYYMDRDFKNAAGNKYAEFDGYTTVDASFSMPLYTGTLSLGLQNLFNKDYFNYYSQTMGTNDRYFKGMGRTATIGYTLPF

SEQ ID NO: 14368 - protein, 760 aa, Shewanella sp.
MPKRWISTSRVLILRRSHGVELVPQFKSRLSMLAAGSVSALALSAAAPFAALANDVETTPERLDTIIVTATRRAENVQDVAASVTTVQKPTLVAITEAGGDILQLAARAPSVYAESSNGRIAPRFYIRGLGNTDFDLAASQPVSVLMDGVVQENVILKSFPLFDIDQVEIARGPQGTLFGRNTTAGLVRFDSVRPTQETDGFISLTAGSLGTVNVEGAIGGALVEETLSARLSILRQHRDDWIDNDFSGQQDALGGFDEQAVRLQLLYTPNDQFDALLNVHARDFEGTSAVFRANILSTGSNALNGNFDRDAVFFDSPANNPQEYEGHGASLTLNGYLDGLTLTSITGYEYADGFSLGDIDGGNPAGPGFIPFQSETQDALDDLQQVSQEIRLASDTDGATSWQVGAYWFDSEFSVTTSSPIGFPPTTTVTHENQLWALFGQVSHQLNDQLRLSGGLRYTSDEKDLTVPLAAFPVAPVNVSDEEVSWDLSAFYDVNEDFAVFGRVARGFRGPTIQARDVAFFSQPSVAQSETSISYESGFKSEFADGRARVNATAFYYTVSDLQLSAVGGAGNLVQLVNADEGVGYGLEVDSEFLIGENLLVTAGFSWNETELQDSALEVAPCGSGQCTPTDPDADNDGFVEVDGNPFPQAPDYILSLTARYGVPSQWGGEWFVYTDWFWQGRTNLFIYESEEFYSDGNFEGGLRLGYAGNANGRDWEAAVFVRNLTDEENLVGGIDFNNNTGFVNEPRIWGVSLRTSLN

SEQ ID NO: 14369 - protein, 867 aa, Shewanella sp.
MLYQKLTMPYPVDCQDSQPRWQKKSLVALLLPLILLPTRSLYATTPADTLYSVHIPPGSLGNSLSHFAAQTGTALSFDPNLTNGLTAPSLNGSFSAHQGLVQLLTGSHLQLSQRTDGSYTLVKMTKKMTNKGVIVLNPLTVAGNRGYSGNEPLRFGSTTIKGKDIEKFGVIHPVDIFKITPGVLSGEARSSGSLDVNIRGLQGQGRVLTTVDGASNQTALYRGYQGVSNRSFIDPDFIGRVDISKGPTGKGGMGAIGGTVEIKTIEASDILLDGQKAGVRLKGSLLNNHSNPDDYQRNDWPSPSKTSLFDAKNRTGSIVFAIAEPSYELLFGVSQRKRGNYHSGKHGPGAKERGMPGYLCESDPQDCRIPQFSEQMAGYSLYAMGDAVPNTSEDSQSLLGKGKVRFGDGHEISAIISHYQNLYGESYVADMANLSQTFMILEQGPLTRLNMNRHSLNYKWEPASNPWINLDIGVWQTRVNDRPRTANNTLGDKKFMRTVGVNLSNTSLFDLSMQDIELNYGASFIRERTGPSAGKWKYAVNREGERKEGHFFLSGNYMLADRLTLMGGWDYKSYQIEDDSPARPGSSWLPQLTSGKVNNKRDHAHGYWVGTKLELNHETALHAKYAYAPRFPSMVEGIRGYMMNVDDHIKPEISKNIEVGLTSRFPDIIAQNDSFDIAISYFDNRVKDYISRSWMDDYWSMYISNIKEAKFAGLELASVYHSDHFDARLSMNYYTKVKFCTENDGCIARSLPSDYATNHIPPKYAVSLDLTQRFLNDNVSVNARVSHYGQRSVPAGKPRRGSAPLLAPIIWRPATVADISLTARINKHVEFELGVDNVFDKYYIQPLSLGYIPSPGRTFRAGITTYF

SEQ ID NO: 14370 - protein, 441 aa, Shewanella sp.
MTQLRTLSLALCSTLAGVTPITALAEEQKEGFIEGSTLTVLNRNFYMNRDHRNGESSPTGNGYSEAWAQGIIGRFQSGFTQGTFGVGVDAFAMIGIKLDTGDGRNGGRSAFDVLPVDGQGNARDEYSKVGGSLKARAFDTVVNVGDVFPSTPVVAFGDSRLLPESFRGVTAINNSISGLTLQGGRLHSMSQPVSSNLRDGFVTFYGGAVDSPWVAYFGGDYQATDRLSLGLYTSRLKDAWDQKYASASYVLPLSDDLALTGSLNYYNATDEGKKLLGEFDNDIWSAKLALQYGAHTLSLSHQRNEGDDDFDYLRQSDSIYLANSIQYSDFNSPKERSWMVTYNLDMSTFGVPGLSFMTRYGKGTDADYSNANSTYMRRDAQGNPLTDQKRWERDIEAKYIVQTGSLKDLSLRVRQATTRATAFESDLDEVRVIVEYPLSVL

SEQ ID NO: 14371 - protein, 372 aa, Shewanella sp.
MDLEKMMKNTLKVVLLTSMLPLAASASQELTPWYVGAGLGVNNYEHIATDNGDDNPYAWDIFAGYMFNDYFGAEIGYRDLGSADWTYAGIGNDADVKGATLGLVGVWPLGNRWSLSAEAGAMYYTLENNQRVGSVSTSYSENDFAPYFGAGVGYNFTDNLKLQAKYRRYENLDDNAGANAIVPVNADSNYWGLELSYRFGSPAAPVAAAVVAATPVDSDNDGVYDDKDQCPATPATHKVDSVGCTIYENVKKQEDVGSIQFANDSAVVKKEYYKDIERLANYLNKNPEFTVEIAGHASNVGKPDYNMTLSDKRADAVAKILVEKYGISQSRVTSNGYGITKPLVAGDSKEAHAANRRIEAIVTTTEKQPVLK

SEQ ID NO: 14372 - protein, 887 aa, Shewanella sp.
MRPSSFKKSVLATNIAILLGSAVSIGAVAAEAEAAAAATVPENIEKIEVRGIRASNKANINEKRFSNAVVDAVTAEDIGKFPDSDVGQALGRVPGVTVGRTFGQGSSVSIRGTDPLMTLTTLNGQNVASTGWYDQMNVDRSFNYSMLPSELIGGMEVYKSTQANLVEGGIGGTVIVKTRKPLDMDANSVFASVKGEYGSVNEDVAPELSGLYSWKNDDETFGVLLAGSYIDREYLRTGTEADLDWGGRSSVQPSSFLQEQERTALDATVQFRPTDNLEFGAHVLSLKLGADSIGANMYIETDTNWGEGASHCKQFNAAGVCTLSVTPESDPSNVFFQNWARKGEMTSDTFELNADYKGDGFAISGVAGKTKAEGGTQMSANFGYGWWGDKFGQVKWAGTVDATGKQIDINGRDMGFTQDQLDTTVGTSTWTGIKGPNSDEETYLQLDVDFDLDFGVINKFETGVRYTQHEFEKSEYRAIYDPAKKNEFKTSDLYSGTMKLGYDGWTIPKADLDAMINATESLVDQFAYSRSAYGLIEEDNFSMYGMFSFDGEGFRGNFGLRYIQTDVTSSGHIIDNSPADILGVNQGWSEEIHSISDSYSDVLPSFNISFDLAPDLILRMSAGQAITRPNYDNLFLSTSTGYPDDRRGNEEITYGNPGLKPMKSSQADLSLEYYYGDGNLVSATYFIKDISNFIVATTQYNQQIGVVNNDLETPADNWTVNNYENAGGGEIDGIELQLNHAFENGFGVNANYTYADGTAPAEVYTDNIGMFTESSKHSANLVGYWENDDFSARAAYNWRSEYMVREYGKYYGNRMHDAFGTLDVTLGWNVTEAIALRLEIVNLTAEDDVQYGAAGVGTEVKPALQDDFPAWSFKGETTYKLGASFVF

SEQ ID NO: 14373 - protein, 346 aa, Shewanella sp.
MKKKLLSASIALALTAPVHSFAASDQRGYKPEDVAFDESFFSFGGHVGTSVEYEDKVTRGFNNTDKKEKTITNEVFNFFYNNPQWNFMGFYSFKIENREQKEPGYYENEDGIKQLFSLNKGHDLGNGWATGLIYELEYTRSKVYSPDVSGLRKNLAEHSIRPYLTYWNNDYNMGFYSNLEYLLSKEDRNAWGKRQEQGYSALFKPYKRFGNWEVGVEFYYQIKTNDEKQPDGTINEKSDFNERYIEPIVQYSFDDAGTLYTRVRVGKNETKNTDRSGGGNAGINYFKDIRKATVGYEQSIGESWVAKAEYEYANEVEKKSRLSGWEARNKSELTQHTFYAQALYRF

SEQ ID NO: 14374 - protein, 823 aa, Shewanella sp.
MPVLQPVFRLSLIALACLSALPHTAYADDTPSARDENVERITVYGRQNSVVKNSGLATKSDMSLMETPAAVVIVDQELINSQGVDNLQDLIRNISGVTQAGNNYGIGDNLVIRGLGANYTYDGMYGGAGLGNTFNPTRSLTNVESVEVLKGPATGLYGMGSAGGVINLIEKKPQFESKHKITTEVGQWDTYSLAIDSTGGITDDLAYRLVAKTARSEGYRDLGADRDEVFGSLKWVLSDSQDLMLSGAYIKDAIAVDSIGHPIRIYNADSVGGKTAGEVTWQDLINDPNGQGIQLTDEQRQQLAASLASGDGLTPYSFGDAGLISPMAKDNEGEELRFKLTHNIYFTDNLFLNQQLQYRDYTTGFARQTGAYNYVYWKRKIKIGGVPTDVINEDPRAPLVENGVLYPFAARRQEYRQLDAEETSWQYFADLRYDFQIGNIDNELLVNANYEDRDIRLEQFSIYDADQVIKNKQGEVIYRGSLPYIYDIRNPNWGTGKFADYDPLKTANYNKKVSAWGLGVQHVGYLGYGFTTRVGVAFNEIKQSYEHLGVDERYSASQASPTPEEDSKDNGVTYNLGLTYMPIDDLSFFVNHSKGRTAYSILGSITGENTDREDSESVSNDLGMRFKAFDDQMLASLVFFKSSRTNVPYTNPDYNAGVSGAEVPVYFYDGSEDTQGVELDLNAHLNDNWRINLNGMYQDARDKQNPNDKANYDSRQKGVPYVTASAWVTYGADWFALSSPIELSLGAKYVDDRSTHSSSFGIPDGYVPSYTLVDSAISYATDSWKLQLNINNLFNKDYYSKAMFLGGMPGEERNVKLQYSYSF

SEQ ID NO: 14375 - protein, 363 aa, Shewanella sp.
MMMKKSTFSAVILAALTSSSAFAAHTFVNDAGDSLTIDGRFDLRYQDRGGDDNGEWNSGSSRFGLKGQMGLDNGWTGFGHAEWGYNSGANGDNIYDRLLYAGVDHEKYGKIAAGTKQWSTFYDVAWYTDLGRVFGTRGSGAYNLADWGIASGAGRAENSITYRNSINEKVSYGFTYQTTREDVALASNATASLKNGMGASITYKPVDGVTLGAAYHQNEVADLDASMVGVENGDNMRIMLLGANYSSGGFYAGATFHVGENWEAVSQGGTDVMFDTLGGEIYTYYHFDNGLRPTLNYNYMEDRGDETQGYERNLLIPGLEYHFQKNKFLVWTEYQFDLGKDQYDGSKFENRDDQFAAGIRYYF

SEQ ID NO: 14376 - protein, 314 aa, Shewanella sp.
MMNVFCKTLLASALASATLASAYAAEPLTVYGKLNVTAQSNDEKGDATTTIQSNASRFGVKGNFELSSSLEAFYTVEYEVDTGAATSDNFKARNQFVGLKGAFGSFSVGRNDTLLKISQGNVDQFNDLSGDLKSLFKGDNRLGQTATYLSPSISGFVFGATYAAEGDADQQGQDGFSLAAMYGDAKLKKSPIYAAIAYDSDVKGYEILRASVQGKIANLTLGGMYQQQEETYKNALPVTTDSVNGYLFSAAYDIDAVTLKAQYQDMEDKGDSWSVGADYALAKPTKVFAFYTNRSLEASTDDDKYIGVGLEHKF

SEQ ID NO: 14377 - protein, 907 aa, Shewanella sp.
MGVMLYHHSYAEDAGRAGSEAQIQVLEDVHVKAKRVPKDKKVFTDARAVSTRQDIFKSSENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRSVAQNYRVGGGGQHIGNFGAEYLERRKQRYFVQEGALKFNSDSGKWEPDLQKQQWKYNPYKKYNNQELQKYIEEHDKSWRENLAPQYDITPIDPSSLKQQSAGNLFKLEYDGVFNKYTAQFRDLNTKIGSRKIINRNYQFNYGLSLNSYANLNLTAAYNSGRQKYPKGSKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNTVGYRFGGEYTGYYSSEGEFKRAFGENSPTYKKHCNRSCGIYEPVLKKYGKKRANNHSVSISADFGDYFMPFASYSRTHRMPNIQEMYFSQIGDSGVHTALKPERANTWQFGFNTYKKGLLKQDDTLGLKLVGYRSRIDNYIHNVYGKWWDLNGNIPSWVNSTGLAYTIQHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEEVTCNADKTLCNGKYGGTSKSVLTNFARGRTFLMTMSYKF

SEQ ID NO: 14378 - protein, 979 aa, Shewanella sp.
MKLLTKCLWLFVLFPLSLFAQDIVTGTVTEAASGLPIPGANILIKGTANGTSTDFDGNFSISLNSGDVVVVTYVGFQKQEITYTGQSNLSFVMKEDAAKLNEVIIVGYGTTTMKSSTGALTAVTEKDFNQGNIATPENLLSGRVAGLSINTSGAPGSGSDIRIRGGASLSASNQPLIVIDGLPIDNDAVGGARSILSTINPSDIESFTVLKDAASTAVYGSRASNGVIIITTKKGGKKFKAEFNTQVGYNTLAKTIDVFSADEFRALVAEQRPQDVGLLGDANTDWQDEIYENQVTFDSNLSLNGSLFKNTLPVRFSARFTDRPGLRKTSEFQSNAYSLRVNPSLFDDHLKVSLNANLTLEDNRFSPGVEGGALRFDPTQPIYQEGSAYGGFFEFTDANGDPLANVARNPVAELMQTRNVSEVTRYFGNVVLDYKFHFAPEFSALLNLGYDKSTGKGTFMRPEESALGVRIVNDEGETVLLGNSSAYENERTNQQFNFQLRYDKTINDFTLGVQGVYNYQKFESQSFSTGEQNDPNTLIVPTTNIDPEVVLLTYIGKGEVSYKDKYFLSASVTRDGTSRFSPDERFGTFPSVSAGWTISDDFFAESEKFNFLKLRASYGVTGQQNIGQSLLFTSRFALGEPNSQYQFGDGSIPIAQPQFRNELLKWEETKQTNIGLDYGFFNNRISGSVEVYKNISEDLLSFVPIADGSNFSNQGFLNIGSFSSKGLEFTINSDIIQQEDLNWNVNFNAAFLDREIEDLAFGLDIETTGIAGGTGGNIGLQREGFAPGSFYVYKQVYDASGNPIEGAFVDLNGDGLIDNNDRFISKNPDPDVLLGFSSTVNYKGFDLSVFLRASLGNYVYNNVSSNNAYYNNLNSNGFLANIPTSVLETNFTQSTDEIIRSDIYLEDASFLRMDNATLGYTIQLDDTKWGDSLRIWTGVQNAFVITDYSGLDPEVGASGVDNTIFPRARVYQFGANYKF

SEQ ID NO: 14379 - protein, 403 aa, Shewanella sp.
MNKTLVATALAAIFLVPSVSAIEIYKDNKNAVEIGGFIDARVINTQGETEVVNGASRINFGFNRELTDGWKAFAKLEWGVNPVGSSDIVYNNRFESVQEEFFYNRLGYAGLSHDTYGTLTIGKQWGAWYDVVYNTNYGFVWDGNTAGVYTYNKDDGAVNGVGRGDKTVQYRNAFGDVSFAVQAQLKNSSFYTCDTTDDITQAQCQANWESGDKAAQQVEYNYTYGGALTYKVTDMLTLTAGVNRGEFDVSFGNGEQTTAVDLIYGAGITWGNFDNDGLYAAANVNRQENHDTDNIGRLIKDAYGIESLVSYKFDNGLRPFISYNVLDAGKDYVIQPNFNADPNDEFKRQFLVVGLHFVWDPNTVLYIEARKDYSDFTSADKDQEARMALSESDGVAIGIRYTL

SEQ ID NO: 14380 - protein, 552 aa, Shewanella sp.
MHKNLLLCTAACALFFSSFTFTSTSTASGLTPETRHALEEIIKLPQQYRYANASSLNIRHQNTSNTNGITNVERKGSSLTHKEDKHPVIDSSTRQKRSSNLLPSANVVSQHKDNSSLRTGYEITQPEINKNAQSDMEPKTNTASSTLKTALNTSTETHVKLPTKIDSIPTANAESTYKLTDGKASEASSFLDEAVDSKTLTSQIENSLIMPIAMFAVGISDANNQNILLDNMQITMFEPKNYPEKSIFLSTYGNKNTFFSRIQTEQDSAQTEQDSVQTEQVEVQAERDETQEKQEDVQTKQESVHADIRYAALQAGAILVALEHQNISTNFGFFGTYGKLSFAPKNAESSHKNMFDKWSLTAYGNIQHDSGIYASAFLSYGIFKENMDNNFIKDTPKMNNSKILGAAATVGQKLLTSFEGVILEPQAQLVYQRLMLGSSSDNNSSSDDSSPSDEDTSKINISKPDQWLLRIGGRLTQNKGHALSFYGKLNMIKTFSKNFQLAAMGSLVEGGFGIHAHLSQNIELHSDLSYQHKFKKVGISGINISAGMRYHF

SEQ ID NO: 14381 - protein, 738 aa, Shewanella sp.
MKSRFAYSILTLALMPHLVFAAAPNAQERQPEQESVSTAQAAIQTNTQAEAQAETKAPERIVVRGRAMQMYVDKETEIGTKTAINVMELPQSVQVLTEQLIDDQAARNITDLYRSIAGVSEFSYSGVTFRGFRDDANVFYDGVRGDPYSGFSVPQLFNVQRVEVLKGPASALYGGGEPGGMINYVTKKPTFVERKELTLSTGSYDMMGGSLDFTGGLTEDLAYRLGGYYQQEDSFRNNADSLNAEVAGGLLYEISDDTKLTTTFDLIRQDLGGNRLRGVPVDDAGNFLVDPSYNANEKSDFQKMDALVLQAILDHQFSDDFSVKTQIRYLNNESDQQYHESRGWVDVNGDGKANSADGTIKREYRVQSRANDEISLTNDFVYRFNALGFEHEFLFGGDYHYVETEYHYKLATSKEGVGNLYIFELNYGETNPSTYQLKDMDTDGTRSNRFGLYLQEHLHFNEQWSLIAGLRFSQFDDYDKKTGFSFSDNAITPRAGLNYRPIESMSFYLNYSESFNPASLSDQESIKSDGALDPETGNQIELGMKNEWLDGQFMTTLALYRIEKQNVAQANPLDTGDDDGIPNLVNLGEVRSQGVEWTLVGDLTDNLTVTANYAYNDTQVIKGVINDSLTNTFGDGKHFANAPRHQAGLWTRYDIQAIDSAIAFGMDYVGEQFSLNGQTVKPHTVFDMSWTTQWDQTQVRLNLKNIFDKEYAVSGFSERNGHFPGEPRNVTLELTHKF

SEQ ID NO: 14382 - protein, 733 aa, Shewanella sp.
MSNKKSNNKSSIFTISLTRAPLALAVSAALSASAWAQTDAIDKPDPNNDMEIMVVTADFRSASLEKMPSSITVIDAQQIQDENAQHFEDVMNSIANFNWSGGSSRPKYFQIRGVGEQEQYQGAPNSSVGYIVDDIDLSGIGMVSSMYDLQQVEVLRGPQGTRYGANALAGLIYLKSNDPTDVFEHGAEVSLGNDDLQTFSGFSSGPLSDSGKLLYRVALQQHQQNGYRDNLYLNKEDTNGRDEFTGRAKLRWYATDDLQLDLTLLHADFDNGYDVWSLTNDPTNTITDQPGVDSQRTTGAGFKATYSGAEQFELTSLTSFANTDHHYSYDGDWANSEYWASKQCEEGGNVSPCQYDYFWDKTGQRKTLSQEFRLSSTDQGRIFADSTDWLIGVYAMNLKEDNQLYSEYNTWPDEVLDSQYEATNYALFGQLDTDLGADYVLSVGLRVERRNSHYSDTNNDNFDPSETMWGGHIALSKVLNESHNVYARVARGYKAGGFNMTLPVELNDKKEFDTETLYNYEIGLKSHWFEGLIDTNLALFYMDRQDQQVAASQQDPNKPQRFILYTENAGSSNNYGAELDATWYATDNLQFYSSLGWLQTAYGNYQYQDKYGTDVDLTGRDLAHSPHLTYSLGGTYRANSGWFANLNMSGKSEFYYSDSNDSRSEPYTVVNARLGYEASAWSAYLWGRNLFDEEYGVRGFYFGNEPDNGWAEKQYIRYGDPRQIGVTLNVKFM

SEQ ID NO: 14383 - protein, 882 aa, Shewanella sp.
MHHLTLAAKAVRASIITMGSASVLFSGMTIAAEENAKVERIEVTGSRIKQVDMETVSPVTVINAADIAMTGEKTVADVLNNSAINSFGSWRGISGYGSGASSTSNVNLRGLGSSATLVLLDGRRMPGTSSSSGSVADTSSIPMAIVERIEILRDGASAVYGSDAVAGVINIITKKEFDGLQLDYSTEQPRVEGGDANRLSIATGYNTDKGNITLTYEYYDTKAVMDRDIWNMDDPSYSAYSGFSSVPNGSSASGWYSNSEICEQTENTVDTTDGNNVGRCLYNHGNVTKLFGDQTRNSILSNFSYEITDTIQFRGRASASLAETETRYAGTPVSTNYPVMSADNKFNPLGEDMTLYMRSAQIGERDTLTETNNVDILGGFVGTLDFGNGIDWELNAQHSRSTTNSFNYNLINDEIVQQGIDSEQYDIFNTSGMSYQQWNQQMTELYRKAAHTGVYQGKFESTQLDGLASTLLVDNGDVSVAMVGGLEYEMIKFKQTSDPESASGIISGGSGGDDVDAERDRSAAYLEFQVGLPANVELSAAVRYERYEQEGSLTGAQGQVVNSSTFDAVVPKFGLSWRPVDSLLLRASYGDSFRAPNMSEMFSSQSLSFEKAVDSLWCNEPGNVDAVYCATNNQHKTWYGGNPDLEAEEGNSLTLGGVWNVTDDWNVELSYFSITYDNKIESVDVDDILRDEIKNGSSPYIHRGADGKIEYIEAGVRNLASVETSGIDFVTAYNLETAIGDFNFKVDLTHVLDFKKQDNAEAEMIDYAGVTDTPDWRGNFATSWKYEDFSAAWTVVYIGSQSADYYNTLEETDRYVDYSSYFKHNIQFAYSHAYNGTITVGVNNLFDADAPNYYTYADYRDVNVGLYDVLGRTYYLRINQKF

SEQ ID NO: 14384 - protein, 939 aa, Shewanella sp.
MMRFKPSLLTLALVAAGASMHSYAADDVKEKDLKAKDAEIEVIQVKGFRTSVIKSLNEKRFGDTVSESISADDLGALPDQSIADALTRLPGVTAVRTGGQASGLNIRGLDGDFVFATLNGHEQVTTGGKRAIEFDQYPSELISQAAVYKTPKASLIEGGVAGTVELKTADPLKNDKDQSFNINARGSFNDRADEISDAEQYGNRLSLAYQGKFLEDTLGVAVGYAHLYQPYVASQFIGLRFNDDKKDVNGDGVTEAISEGFELQQKGGDDTRDGYMAAIHWQPSDSLSVKGDLFHSKFTSENFARGFRVKSLKNGTISDAVVENGSMTGGTVSTDGTDNFAVFVINDNDSKYSELTSGSLNLEWNNGGALTVAADVSYSKADGEFVNGGTRAVLYDDLGNEVRSAESVTYQLNGLNPADVSFANDYTNTSTLGLKEVGMWPYNQQNDLIAYKLDFNYVLDTSFVSSVDFGVRYAEREFNAQRSQAGYGFEFGKNPDNQPVLALNGDMAKVVDFGGELAGYPSFLAIDFNKAIELVNAQLAATGQSPFTPTANWSNNWTMIQSGAVNEDVLAGYVQANLDFDIGDVKVTGNLGVRVVHTDQSSTGLQQVGYGLGEAITDEQGVVSTDYIRNKVGKTYTDYLPSLNLTFHLTENDQLRFAAASVMSRPPIDKLKSGMGSWYDDSATPGYKKYNAWGNTSPLLDPFYADQYDLSYEHYFEESEGAVVVALFYKDIKSFINNFTIQPFDFEANGFIVPDTIIDNGVEFPVVKDEGQYQTAINNDKGGYIRGIELGYTQVFDFLPSPLDGLGFTGSYSYSDSEVEFTTDLSGSNLTIPLPGLSENVLNTTLFYTLDGFDTRVSMRYRSSYVSEQVAVESQLAFFDAETIVDYQASYALDNGLKFLFQINNLTDEPNKTYFGEEHQTGTIQYFGRQYFLGLTYSL

SEQ ID NO: 14385 - protein, 653 aa, Shewanella sp.
MPAQPDFTPRLSRFSRKALPLAISLGLSAISATALANNSATGEMERMVITATQTKHSELSAPASVSVINRTELEALVIDDLASAVRYLQGVNISEGTPYGRNEISLRGLDSDYTLILINGRRVNSREALTSNYGNDFDLSSIPMSAIERIELVRGPMSSLYGSEALGGVVNVILRQPTETWQTSVGVQYDTPTSGEGGDSTKYNFYTSGALVKDKLLANLIVDSNKRDAWRSDLKPTIDALEDRDEISALANLQWLIDKQQDLQFDISYASDERESDWNNYGTILTNNQQAERISSGLTHNGRWDWGDTRLRYYYENVEVTDDSALIAQIGHITQTNHNLDGQTTVLLGEHMLTGGAEYRWTKLENSRNILGDGTLDDSQSALYLQDEFSLGELSLTLGGRVDHHDVYGTEFSPRLYLVYPLSSEWVIKGGGGKAFKAPNMSQSQADYIIPACRGACSVAGNPDLQPETSVNYELSTQYQTADFGGSVTYFHNDVENKIITETWDRTPGAVLTYQNVNEAKITGWELQAWYDLTDSLSISGNYSKTDAKDKQNGAPFTLTPEDSYNLKLQWQALEGLSTFIAYHYTGEQYLRTNVKSDGYGSLDLGVNYQINPMFRVKLGVTNLTDAERDQIATDLDYIQKSRSVYAGVTASF

SEQ ID NO: 14386 - protein, 890 aa, Shewanella sp.
MTTQTTVARAVRFSLLALVSASVTPQVFAADEAAVIDDKVERIEVTGSRIKRTDLENASPIVVVSAADIEKGGFNSVQDVLGNLSQNSGGSMTQQEVHGFTPAASAVNLRGVGAGRVLTLINGKRVPKYPFGAGGTDSFVDTANIPLGAIERIEILTTGASAIYGSDAMGGVINIILKKDVEQSTFKYRHSDTFDGGLQNNQFSFMTGVSSDKANLTFFAEYEDRQALKASDRPEWGTDIIPGNYYAGYSSYGANLVDSNGKLLKSLSAAECDARGYVMMSNGKCGFDRSAQRDFSPEQKRYSTMINLTKDLNDNHQLYSRLDYTHASTYTEIESATVGYDFMFNVSGDNVTIVDELNGLSQVFDKNTAFGGDFAGAADGDYYYTRRMSELGPRTSDFETNNFSFLLGSKGYLTDTIEYDTSWSIARQTVDSTTAGSPTYQSMWNYLTAGTNGNSLLDVISPDDAAMLDFQGGKKGQSTLSSFNAGISGEAFELPAGTVAYAVGVEYGKEWFYDKSDSFTSNGGVIGKGGSSAQGEREQYAGYAEVAVPVIENLTVTLAGRYDYYDDLSDVGGQFSPQVAVEYRPIDNLLLRGLYAETFRAPDMQRLFGEPTAAYSTVIDTPTCEAAGGTGPACEKIDSLPITIGANPELEAETGKNYNLGMVWDYNDLNLTLDYWIVEIDNLVNSPSAQYILDHSDAFADKIFRDASGKLIQVNTQAINMSSQETSGIDFSVGYRYETSGYGDVTARLEGTYLLKWEEQLTPDSEPLDLIDGDDSAPQIRGNLNLGWNYDDFATNLLIKYTDSMNGQRKEAFINNGLADKYAVTIDSHVEVNWAASYMLTDAIKFSGGINNIFDAGPEIDETQNSWPHYPRSYYNVIGREYYLAVEMNF

SEQ ID NO: 14387 - protein, 853 aa, Shewanella sp.
MIKRTKVASAINLAVVSSIAAGAFVASSAFAAEETAKVERIEVTGSRIQRQDMETASPVTVIDAAAIKAEGFTSVDQMLQVQTSMAGAAVGSTTNNGADGVAQVDLRGMGSQRTLVLLNGRRMVNSGSGADSAVDLNSIPVAMIARVEILKDGASAVYGSDAIAGVVNIITKKDFEGFQFDMNGSGTDKGDGQSGDVSALYGFNTDGGNYTFGAAYSDRRGVIQGDRDWYDPLDNTSSIIPTGTLNQKVIDANGNWVKRTETYDYSNDVYFQTPSERRSLFANMTQELGNDVVLTADAIYTNRRSNQQLAAQPAQIKLNVCGDPRVQDPTAGCLTLDQGMIDAGIKADARGQVQYNRRMNDVGPRIYNQDTDTWRLSAGLAGSLDVHTGMNWNVDYTFGKNEAKTGVDNSINATLMANSIYADPYAWFEGSPLTDDMKDVSYQQQSTGGNEQQTLSAGLNGELFDLSAGAVGFAIGAEYRRESGFYNPDPVVVAGDSTAAQQDPTSGNYNVISIFEEVSVPFTEKLTGEFALRLDDYSTFGKATTWKIGLTYTATDELMVRTVAATGFRAPSVAELYGGNSGSFDYLTNPWLPASEQTGQILVNRTSDPDLKPEESESYTAGLVYSPSYIDGMSITLDYWRFKVTDAIARADVQVGLDACHAGDAEACSTFNITADGDLFNLTSALTNVGSQDTSGIDFNLAYNFELFGLDWKVSNDTTYLIKFEQDGENYTGTIDGNMGAYARVRNNFSISAGQDDWSVMYFNRYIRSMTDVYTDYDANDNPFVAVRGVDSILYHNISGTYHVSDNTTVSLGVKNLTDEKPLYVTNGSDAGTVPQVYDTVGRTIYGGVTVKF

SEQ ID NO: 14388 - protein, 936 aa, Shewanella sp.
MFKQTYLASAILLALASQATYAAEAEATQSPQAEETAQPSSGGKAQNNNEEMEIIQVQGIRGSLNKAVELKRQNIQVVDAIVAEDIGKFPDNNVVEALQRVTGVQVTDRASGEANVVSIRGLTDVTTTVNGRQIFTATGRSVAIADIPAALLGSVEVFKTRSSSQVASGIAGQIDIRTHKPFDFEDSKVSVAAKGIYSDQPDTIDPNFSALASNRWDTSIGEVGALVNVSYIRTNYKDESVSPGASFPYFVEDGTRITSGWNVGSAHGIDTSAGATIDGKEYLLARDAMFGNILEGERERPAFNISLQWAPNDSSEYTFEAFYNGYRNESFNSMLFSFVDSPANWQQVIQDGIEVYDGTNVVKSRTAYNAYNFTSGDHSKASTDSYVFALGGKWDISDEFQLKSEVVYQQSTYENEFTAMRGDATVYGVEIDANADDGIPSWSYLDNPDTVLDESDMTNPDLWQTADFFDNGSKDEGDSLSWTMDGSVYVDYAIFTKVQFGARYEKRGATNFSRTVSSAKKIAYTDLDPSMYMVTSGFFEGRANVPDSWAVINGYNLYKNRSEFEKLWGFEARKLQLMKTFDISEQAWAGYLMADFDTEVFGKRLDGQMGVRYEGTKADMDFFDNDAKDANGNVYTAVSSDTTDTSKLLPSLVMRYWLTDDFVARFAYTETIRQPAFADLNSFTYYVPDLSKTNYGSASGGNPDLEPVTSKNYDFTLEYYFGNGNSIYGTYFRRDIEGLVYNSLSTTLYDYDGDGVDETYILSRPGNTSNGKLTGFELGAVYFPEGLPSLLDGLGAQLSGTLLDSSQDIPEYNTGTGERIGVTTRDMFGVSDESYSAVLIYDKDFFSARMSYTWRSEFLNAYDAPNFAMPRGIYRKPEQSLDFQLSYNISDDLVVSFDATNLLDDVYQEYYEDSTLFNRTNNIFTRTFALGVRYSF

SEQ ID NO: 14389 - protein, 942 aa, Shewanella sp.
MQSPIARQLGSLIPQQAHPVARVHKRLTSRLSALSLAMVLAGLSHNALAIGKLEGQIRDNSSQQPLAGATVTLKELNLSQQAGRDGRFFFVGVQDGDYTLVVNYLGAMPNEHRISIRDKQTTLQDINLSSQDDVEHIRVVGQQGALSKSMNRQRGADNVLSVVSADVLGNFPDSNISESLQRVPGLSIERDQGEGRFVRVRGMAPDYNSVSMNGTRLPSPESDRRAVALDVVPSDLLQSVEVSKTLTPDMDADALGGAIEVKSLSAFDRDDTYLNLNAEASQDTLTDNTNPKLAASYSDIFADKLGVAIGASWYNRDFGSDNVETGGKWEFAGDNGFEDAALESVDARDYEINRERLGIGVNFDYRPSDDTDLYLRTLYSEFDDTETRNSAKTKWKSPQQENALSQGKTTRSLKSRTENQNITSFVLGGQTRFERWTFDYQASHSTASADKPRDIAGANFVAKIDNTGFSNTNQPQIIAPEDYYQNDNFELDEIEVAASKAEDTINSGQLDLTRQLTIADYSVELKTGVKLSRRDKSNREDIWIYSDLGDQGVSDEDLLLSQYAGNELDYDLGRFGSGINAAPLWQLIDSLDADSNRDDIESTINDFDISEDINAAYLMGHIDIEKLRILTGLRFEQNQWDSSGYGYDGAKGEFIDIKHSRDEDHWLPALHLTYRYSDNTVLRAAWTNTLVRPTFGQLAPGYLLEEDDGDIDLTFGNPQLKSLESMNFDLSLEHYFGNIGLISAGLFYKDIDNFIYQADLAGRGDYIDAHSAVTFVNGDSADIYGVELSYVQEFNFLPEPFNALVLNSNLTYTDSSAQISWLEDGQLLSRDIPMPSQSDLTANLSLGYENSYASVWLSAAYKSEYLQEVTELSDERYDLYQDNHLQWDFVAKAHLTSNLTLYFKGVNLTDEPYYSYTGDSSYNAQYEAYGRTFQLGVQYTNY

SEQ ID NO: 14390 - protein, 245 aa, Shewanella sp.
MEFIMKKIIAVSLLSLVSSTAIAGVESLYVSGKMGASIVQVSNQKWLTSDNEFEKTNLGNTHDSVFGGNIAVGYDFAKTTKLPIRTELEFGMKEKASINHNLESFNDPGVLSSSDDAKTDITLNTVMVNTYYDFKNATKFTPYVSVGLGMASINHKMRYDYNEHIVSLNQYTHEQYTQSKTTNNFAWSVGLGSQYRVNNHFSLDMGYRFLDAGKSEANYYADDQKNTSKVKVRSHDIMFGVTYRF

SEQ ID NO: 14391 - protein, 735 aa, Shewanella sp.
MKSFLVALLLGFAIFCNAQNKITGAITNSENKILETVLVSIPELNKETISDSNGNFLFLDLPKGKFKISFSLVGYDEKLVSVFINKAEINLNIRLESSSNHLEEVKIAATIFNKIQSQNVMKIEHKSIRELQQKGAVTLMEGLASIAGVSQVSTGTSIGKPVVRGLSGNRVLVYTQGVRLENQQFGEEHGLGLNESGIESVEVIKGPASLLYGSDALGGVLYFNPEKFAKPNSYLADFSQKYFSNTNGSNTSFGLKSSSENWKFLIRGAYNNHGDYKMPSDSLVTNTRFEEADVKTALGFSNSKFSSVLRYNLNHLNLGIPEQIGLQTTKRDPDYPRQGVVNHILSLHNNFYFRNSKFDADFGYISNSRKEFADSTIPVLDMNLNTLNYDLKYYLPNIGKLEAIIGVQGMSQSNKNLGSELLIPDAKTNDIGALLTTNYEWKSNVIQAGFRYDTRKINTESHGIIGDEGYFEAISKKYTSFNASVGYKTKLTDNLSFRLNVASGFRSPNLAELTSNGVHEGSNRYEIGNSNLKNEQNIQTDLNLEYGNSHFEFFANGFYNNISNYIFIAPNGSIMADNDVYDYVQANAKLYGGEFGVHFHPHPLDWLHITSSFETVTGLKENGEYLPLIPANKWNNNIRTEFNLNNWIKKGFATLNIESVFKQNNNSTFETKSKDYRLVNVGLGGNININKLKFDISINSNNMLNKSYISHLSRLKTDRISNIGRNIVLGVSFFL

SEQ ID NO: 14392 - protein, 724 aa, Shewanella sp.
MLFIFGVKMAVYVSHKRSALVLGVALLALDASVPLLAAEAVPTDTAGLNDDDIERLSIHYRQAYRGNVPATELPQAITVLDEQLIKDTGLTRFQDLLDYSASVARQNNGGGLWDSFSLRGFPGNENMPSGYLINGFNGGRGFSGHRDLSNVAYVEILKGPGSALYGRSEPGGTVNIVTKKPQYEAQGYLKASAGSFDQYRLEGDFTSGLTDTLAFRINGAWQEHDSFRDYVFSDKKIVTPSLRWQLSDKSSLLYEVEYLKQEQLFDRGVVVLNNDFNTVPRSRYLGEPNDGPTKVDATGHQLTYEYELNEDWSLTAGYNYRDSSLNGYSSDAELAKGRQSLYDDGRTLTRQHRYRDYASEDHSVRAELSGQFDTGSIRHNLLLGTDAYHYRLKTGLYRYRGQKGAYAIDIFTPQYGAAQPEVSLLYENRETQDAWGAYLQDQLELTEHWKLHLGLRFDRYSQEIAEQVNASLSDQSDNRVSPKVGLVYQWSEALSVYGSYSEGFLPLSGTDYAGNPFEPEESKSVELGVKFNSTWFELPVNGSLAWFDAQKSNILTSDPVNVGFSATLGEAKSTGIELDIAAELTESLQATLSYAYLNTRTANDSLNLDWGVLIPAGSPLVNVPKHTGSIILKQDLNDLSIDGHLGLSWRYVDSRLGDSADPSFQLPSYQLLGMFFTTRLGENLSLALNVDNLLDEHYIASSYSALWAVPGEPRNVKVSVSYEF

SEQ ID NO: 14393 - protein, 723 aa, Shewanella sp.
MTMRFNLLPLAAAVTLALNPLALMAEEQTASTTETQDQNIEKITVMGKYTVSRNIDTATGLGLTLRETPQSVSIMTADRIEDQALNTVVDVVNNTVGLSSSKTDNVRNGFSARGFTVQNYQIDGVPLSWSLGGDAGETVSDVSIYERVEVVRGATGLLTGAGDPSASINLVRKHADSSDLKGYVDVATGSWDKKQVTADVSNGLNEDGSVRGRLVAKYVNSDSYQDLYQDRKTILYGVVDSDITANTLLRVGGSYNHNDPKGAMWGALPAVFSDGSATDWDTSATTAADWSRWETKNINYFANLNHYFSNGWQLVANYNRMEYETTTKMIYMSGMLDKDTGVGLSGQRYHSHGESNSNNFDVQLKGDYDLFGQTHEFVTGALYSKQKSYADTYEPIRDDMTGWDSQVVDNFYEWQQNQFAEPEWSSNANRQLNMDTEQKGFYAATRLTITDDFKLIAGGRISSWNREGVSYGTDTNFGDDGVFVPYVGALYDINDAHRIYASYTGIFNPQNNFDADQNYLDPLEGKAYELGLKSAYLDDRLHTTVAVFQIDQDNLATLAGTIVIGGQPVNYYEAAQGTKSKGFELEVVGEPADGWNISAGYSQFNAEDAEGKRVATTSPQKQFKLFTTYQFVDLLPELTIGGGVNWQSDSYSEGGGVAIKQDAYSLVNLMARYDLAENMDLQVNVENLLDEKYYAYMTASGIAYSAYHYGAPRNFTVSFNYRF

SEQ ID NO: 14394 - protein, 683 aa, Shewanella sp.
MSSRYFVMSLTALAVSCVYTHPLNANPLYSQTLDLIELNNQYHSGDDGMQLSYLNSLTLLRADHSGNGANISMRSASQGVAVMQDRVYFSPAPYSAPQLQLLPNLLLQQNVTSTPLANMTVGGQGAFGVVNYQSLEITDRPQSGSFKVEGATDSDFSAGMTWGVKQKEYDALFAANYLQEQGDANFFNGSDADRKKTDILFKVNAASLLGARSPQQTEFTYQFIDDDSYRSQLGSTLADWQQDPLLLYSATAQDKLQGRQHKYQLSHQVDLAGSKVISDFYYQSYSQQLNQLGLFNGQEINAATLADIADFDHAPTADVIDVALLVQDNDYSAFGAQTQAINQYGEHQIIYSARYHTDKAEMRFGEQTALWQADRSLVSDDSGAILAYTDDATALTSAIDSLFRWQGMQIKLGLTYEHVSINREVKQAFAGLDEADFSDSDWMPQLGVLYDAGDWRFSTDIRRAWTAASAGNTTQEAQVSLHYQVSAQYAREGIKADLRAYVQEFDNLHVDCDSYSMCADERLLTQENIPDVLTYGVELGLGYRWDLGGVELPLGLNYQYLSAEYQTSTCTDVQGCVLEGDRLAWLPEHQLQLSAGIKYAQYRLNLEAAYQSERDFSQFGSEQERISGQWRVDLAANYDFDKHHRLYFRVENLLDESLVTTASNSGIRSENGRISYLGYQWRF

SEQ ID NO: 14395 - protein, 187 aa, Shewanella sp.
MPKLSLISFIVGLTLASSIMSTNAFAGDSAHILGGSLGYGSQEFETKNGKYDAGDTLSGDLYYRYMLNENFGVEAGYLAGSGGVASALVSIISEIKNLSYNGVRTTAYGEYALSRGNSLYAKLGAAYTQVSYEMDKQGMDSNDVGFYGAVGWQYRFKSGFGLNLEYEYLPMKELELQGINFGMSYRF

SEQ ID NO: 14396 - protein, 861 aa, Shewanella sp.
MKRPQILPSACAIAIAMAFAPNISYAADNGADKVERIEVTGSRIKRTDIEGPSPIQSIGKEDIANMGFDNLQQLLERMPANGAGAFSTRGNSQDSTANGGASISLRGLGPDATLVLINGRRVAASAFAEGITNSFVDINNIPVSAIERIDILKDGASAIYGSDAIAGVVNIVLKKDIEGIEVNLGYGDTPGTGYDETTASIVWGVKSEKGSASVILDYFKNDTLAATDLGRFGTADQSPYGGEDFRSSRGFPGYFYVDGVKTIDPSCPPDRATASGSCLFDYGPYNLVIPEAERIGAIGQFDYHFNDDLTAFLELAAQHNSSIAGGAPTPLDEDAALTVPGTHPNNPWGKDIEIGRFRTVDAGARRWDIESDTLRLVAGLRGTIKEWDWEASVQRGRSESTQTGDRTQGWVRTDYLQAEIDAGRYNPFGGTMNSQDVIDAITTSLVRQGLSSMTSYAANISGQAFTLADRDIMMAAGVEYREESVSDVPDEQFQRGLIFGTEAVSAAASRDQYAGYVEFSIPVTDNFELQLAGRYDHYSDFGSTTNPKVAFQWGITDELTSRGSWSTGFRAPSLAQIGLGPSRESSFFIDTYRCAADGVDCEALDYNTEFQGNSELDAEESETWNLGLIWAPSQKFDIGFDVYSITQDNKIDKQPLGDIYTANCNDQNSTVCERLVPQAGQTLGPISIIHSSFINLSSQDVQGVDLSTHYGLELDSFGDLKFGLEYSYLHNFEKDGLDYTGEYKFPQHRWLLTTNWTMDNFAANVNLSYIGEFEDTPDIDFDGVLDFETNKSRMVDAQLLVDMSGSYRFNEMFKLTLGVNNLFDEEPPFAIGDGDTDLYGYVISVHNPMGRYIYTKLTMNF

SEQ ID NO: 14397 - protein, 354 aa, Shewanella sp.
MKKNLLATAIAASLAFCSFSSQADGPEFYGHVDLSITDSEKGYAAQNQKDGTVLENNFTWVGVKGSESVSPYFDIIYQMEFGVENFDNSNKTFNARNTFLGVRSVAGTVLVGRNDTVFKASEGGFDLFGNTNADIDLLLAGQTRSADGISYYSPKIADLITLNATYLMSDNYDQRDSQGNEVYSQDQMYALSATLGDKTLKTHNYYVAAAYNDGIDNIEAYRGVAQAKFGDFLFGAIYQHSEHIDDRFSNLSGDTYFVNAAYLMDDLKLKLVYGKDDSGLGKYVSRMVGSQDSANLEQVSDVDLQQLTLGADYRLSTKTMVYGHYTRFDGDLMLAGTKQDLDDNLFTVGLRIDF

SEQ ID NO: 14398 - protein, 346 aa, Shewanella sp.
MKKTFISASVASVLALASFGALAEGPSFYGRLELALTHTDTGATLQSGTNGLDIGEKGTYLENNFSLLGVKGSEKIADGFDVIYQMEFQVENTSSKGDVFKARNTYLGLKTNAGTVLVGRNDTVFKQAEGGVDIFGNTNADIDRLISGQTRSADGVWYYSPKIAGLVTLNATYLFDDNDTTAKTTESLYALSATLGDKAFKAQNYYAAVAYNKGIDSIEAYRGVAQVKLGQFKVGGLFQNSESITDSSVDGNTYFVNVAYDLNGVNLKAEYGVDEAGFGKYYKALGKAGADDINVQNFNVGADYRLSKSTMVYGQYAMYKGDYKDAGAKFDLEDDNVFSVGVRYDF

SEQ ID NO: 14399 - protein, 731 aa, Shewanella sp.
MKFAKRRNGRVTLGAHVLGSLTIGMAVSAIPAMATEGQTQVVDKKVEHIEVNGEYLGYNSRKVQSGKFTEDLLNTAKTVTVINQDLIKDMGAQSFTDALRATPGITLGTGEGGNPYGDRPFIRGYDAQSSTFINGMRNVGSQSRETFNIEQIEVLKGPSSVYNGRGAVGGSINIVTKKAQSEDFINADVSVGTDSLKRASVDVNHVIADEAAVRINMMAHDADTPGRDEVTGNRWGVAPSVTFGLTTPTKVTLEYYHFENHDIPDYGIPYDQATGEPADVDPDNFYGLLSRDFRDTMDDTASVLISHDFNNDMQFTSTSIYSRNSNYYIVTNPDDTTGNVANGYVWRNTKSRHSVTKTLATQLQLSGEAKLAGMTNRFAVGTELSNERTSNLSYTVDTGNGRNAGCDQAMLDNYNCTLLDNPNPHDPWVGTITLGTDATVTETDTRSLYAFNTIELTEAWMVNAGIRWDDYSTSAENSTSQFSNDTDFFNYQLSVLYKPAENGSIYAAWGTSSNPPGTSNGDGADRLGSTNADLEPEDTESYELGTKWDFFAGRLSLNGSVFQIEKNNARVATSGDRNSPQENVGEQKVKGFELGFSGDFTEHWHGFGGYTYLDATLESNGYNQAQNGNRFPNTAKNSLSLFTTYDVTEDFTVGTGAYYMGKVYGNTANTLSIPSYWRFDLTSSYKMSEFLTLRLNVQNLTDERYYDKAYTAHFANMAAGRLVMLSADMHF

SEQ ID NO: 14400 - protein, 758 aa, Shewanella sp.
MKQNTIKMSCIALAISSALAAQYAVAEDENSTGEKQATLERIEVTARKSIESLQNVPVAVTSVSADDLAENGISVMTEIQQFSPNTTLQSSRGTNSTLTAFIRGVGQEDPLWGYEPGVGIYIDDVYIARPQGAVLDILDVQRIEVLRGPQGTLYGKNTIGGAVKYVTKKMSGDAELNLNATIGSYNQQDYKIAGQLPLIDNKLYIGGAFASLNRDGYGEFLTSAVPGQDTENYNKDVMAGRLSLEYTPTDNLFMRLNYDKTTDESNSKGGYRMLPSVLTDAPVPDSKYDSYTSMPTWNKVETEGWGLTIEYGLNDDWTLKSVTSSRESYSPTNIDFDNTSLRIFDVPAIYDDEQFSQEFQANYDGDDLKLVSGLYYFKGDSCGVFDAILYEYYKAYGGLTREVRGCNNSESYAAYAQGTYDITDKLSMTAGLRYTRETKDATVYNGVMFTTLYPETGWIPGYVRDEDAINASIPKVLDDEETWSKLNPRLGLEYQLSDDMMLFTSYSQGFKSGTFNPRASFAEPAVDPEVVDSYELGMKSEWFDRLRVNATAFYLDHKDRQFVTVLPGENASDLNQRLGNIGKSTATGLELEVEYAATESLNLFATLGLIDASFEEVISYDDDGNRIDISDTYTITNTPDTTANVGFSYNIDTDIGSFVANGNYYYRSDYDLAVVDNLLSQDGYGLLNLGLNWYSNDGHWHAGLHWKNVTNEEYLVGNYAFVTPDGNGGYTPGLGGDNTLIGYYGDPETISLTVGYNF

SEQ ID NO: 14401 - protein, 653 aa, Shewanella sp.
MGTHPTKIALLIGSLCSFSVIAPAVAADDASVAKVDEHIVVIGRSDKTPLNIAANVNVIDAAAIEQSGATSLTEVLRGQSGIQLSDNNIGTSFAMRGFSASTAVNNTLILLDGRRLNNIDIAAPSLNAIPLNLIERVEILSGSAGVLYGDQAVGGVINIVTKSPENTGGSVQLSGGSFNTYEGRGDVSGAINKDWHYFLTGSYNQGDNYRKHNANETGSILGRIQYKTATDSFFVETSYYDDDRENPGSLTVDQFKDDPRQSFNSSEYVHEMTTAARSGYQHQLNQNWALAADLDYSDTLVTSLNWGAGSQNTRSLLMFSPKALANYSTRQGELNLVTGLDISRGKAEFDSMARSNVQEMQSAYLQATVPLSHTLSYVVGGRYARVTDDLVDGNVYPNGIDLDEDATAFEFGLNYRPSAEHRFYLRGDENFRFAKVDEQAYTPKDVYGLKPQTGRSYEAGWDWTVASQSLRVSLYRLDLEDEIVFDPSAEKPVGGSFQGANVNADASRRYGASADWDWQVTQALTLGLEYNYIDAEFTDGVNDGKQLSWVAEHTGRGYVSMDFAEHFQVFAEAIYTGDRFIEGDNGNEGDKLSSYVLGNLALNYTRDAWLASLRIDNLFDKEYVSSGYYGGIWGDSYYSGRGRDIRFTLGYRF

SEQ ID NO: 14402 - protein, 402 aa, Shewanella sp.
MKPTTLQKAAVLLCICAFLSANAQKTNTQKFGKGLFNLIGKDSTWSMKIGLRFQTLATSNWEIHHGLSNPASSMMIRRSRLKFDGFAYSPKLKYKVELGLSNRDLSGASKYTGNAPRYILDAVLKWNFSGNFVVWFGQTKLPGNRERVISSANLQQVDRSLLNSRFTIDRDMGVQLRHHFKLTNRFLVKEVFSISQGEGRNITTGNIGGHQYTTRIELFPFGDFANKGDYKGSDLKFEPSPKLSLGFVYDFNNNASKTRSNQGSYMTNDTGFYVTNIATLFIDAMYKHNGFSLMAEFANRTAGDAFAKNADGSLTGDVVQVGNGLNLQTGYLLSKTLEISGRYTNISLDKVITGKGAENQYTLGLSKYISGHQLKVQTDLSYTDIGFKTNQLLYRLQVDIHF

SEQ ID NO: 14403 - protein, 713 aa, Shewanella sp.
MEDKTMAAHPSTIPHGFKCSAIASALTLALGASVTSQAMADETNQTQIERIQVHGEQSLGRNALGSADALLKDQGVDFSEAGGVSALPVLNGMMGDRIKVLVDGADITASCANQMNPQLSYVSANQISSVEVVAGVPPVSVGGDNIAGVIKVNSLNPKFSDSDNLNFESGEISSGYRSTSDAFLLGAKTGIASKHLSFSYQGAYEDANSYQDGHGDKVLDTLYRAQNHALTAAWRDDTQQLAIKLTHQAIPFQGFPNQYMDMTDNKSYGALVRYLRDLDNDGEFSAQLNWHSVKHEMGFFTPEKIGKMPMNTEGRDYSYQLHWRLPMGDDSTLLVGQEYYNYQLDDTWPAVPGTMMAPNDYININDGERRRAAVYGEWQQNLTPLWWLSAGVRYEYVTTDTGEVQAYSNMPMMGMPNVDAEATKAFNAMDRSRDDNLIDATLLARYQLSAKQQLEFGLARKNRAPNLYERYSWGRGVMATTMIGWYGDGNGYVGNPNLKPETAHTLSAAYKFAGDEWQFSTTAWYSAVTDYIDAEVIGSFNRTGLANGKRNILKFTNEDANLYGAKLSANYLLADTDSGKWQMQGKLDITRGERDEGNEPLYQIKPLQTELALSHQLGDWENRLSWQWVATKDKVDERRLENETDSYSLLNLSSSIKWQELSLTFAINNLFDTYYELPLGGVNLAEFKADSTGGFSQVAGSGRSFELGASYKF

SEQ ID NO: 14404 - protein, 250 aa, Shewanella sp.
MKKTCLCLALMLSPQAFAGDLVQWWDFSATALYGEDYDLAPSDKQATITLETAGGWKYGDWFAFQDFIYFKGNHTGMDSTTYGEISPRFSASKILGEKIAFGPVTDLSLALTYEEGEGPVHSLLYGLGVDVAVPYFTYLNFNTYRRDAMSTGNNSDGWQFTPVFRIDIPVGSANIVLDGFIDWVFATDKDGYEENFHFNPQLKYDLGKSLFGEHKANKLLVGIEYDLWTNKYGVKGVDQDTYSVIAQYHF

SEQ ID NO: 14405 - protein, 449 aa, Shewanella sp.
MFSFPAAMRGARNLTSVSLPTLSRGVRLGITMLGRSPRPGRAIEGSSTMKLNLLAGAALAAVFAASGVSAQETGWYGAVDLGQHWPQSISTESNQTLPDGEYAHWAWKTDKDWTGFVRLGYQFNKNWRAEVEGGYRPGDLKAVRGNAVRQQPVALCTPGVTRTSSSQRCGSPDGSIDSWSLMANVIYDFAPDSWLNPFVGAGVGVNRLDVKTLGQFSGVGAVTPGNVAVQNLTVDDDDMAVAWQAIAGASIKATDKLKVDVTYRYLTGSDHSWQSSGSGLLQPGAFSGQYTDQSLTVGLRYSFASPPPPPPPPPPPPPPPPPPPPPPPPPPPPPPPAFEAREFIVYFPFDQSVLTPEAQSVVTEAAKYSNDGKATKIIVVGHTDTSGSPKYNAKLSERRARAVADALVSQGVSQNVLGVDWKGESAPAVATGDGVKEPLNRRSTISINF

SEQ ID NO: 14406 - protein, 449 aa, Shewanella sp.
MQKRLLTLAVTAALLSSTTQLHAAGFQLAEYSATGLGRAFAGEAAMADNASAQARNPAMLTYLEGRQLSTGGIYVMPNVDVTGDVSISSPLLGPDPVVMKGGDALDVADDALVPNFYYSNQLNDQWTWGLAVNSNYGLATELPATHAAAIFGNKTSVTTVEFNPNIAYRINDAVSVGAGVRIVYGEGEIGASLPGWVDGIKPALPAPVQAVLPPGGTELKSMKGDDVGYGWQLGASWQINPAHRLGFAYHSGVQLDLDGHASGVLYTGGQDVSIEGYLPLELPAFAEIASHHQLTDNWAMHASVNWTDWSVFDQLVAYFPGDVKPKGDLESDLVKEEHFEDNWRFALGTTYQVNNDWLVRAGVALDKTAANDEWRTTTIPDSDRLWFSVGAGYQATKNLNVDFAVTYIKATGDAPINEQQNLLGLAAVNFNGEASGDVWLAGIQMSYKM

SEQ ID NO: 14407 - protein, 90 aa, Shewanella sp.
MNKTQLIDVIAEKAELSKTQAKAALESTLAAITESLKEGDAVQLVGFGTFKVNHRAERTGRNPQTGKEIKIAAANVPAFVSGKALKDAVK

SEQ ID NO: 14408 - protein, 994 aa, Shewanella sp.
MIQKTFTKTRIATSLSLILGATALPALSAEEVSLKDKENVEVIAVTGIRSSLVKAMDIKRSAQGVVDAISSEDMGKFPDSNLAESLQRISGVSIDRSNGEGSKVTVRGLGPDFNLVTLNGRQMPSSNLESTVISNSRSFDFANLASEAVSGVEVYKTAKAEVSSGGIGATINILTARPLNTPGQKASLGVKAVMDQSTDEGDSVTPEISGLYSNTFADDTIGFGISFSHQERNGATKEAVVPQWHTQAIAPVDGWNGGINNTDWEDGDTFNRPQQFRYNFTEFDRTRDNGQLVFQYAPSDRITITADYTFSEQTVESTSNGIGAWFWEGETIDGSLNEFTTGTNHSPVVWHSGAGPDLSFSTSSDASINKNESIGLNLEWQATDNLRFELDYHDSSAKSKADSPYGNSSTMEYAVNSRQSTTIDFRPDFPVMSISQLDGLTGSPAELITTGSSLRNSQFENDLSQIQLRGQYVFDEGVITSVDFGISKTENDIRASIMTAQRDTWGGEGSVDDVTDSLFTPGSSSSQLDNLPSTGTNAAGETIDLFDLFYNFSFVDASNEVASYAAPANSNNEVSPGIWPCADRFCVNDQWTTDELISEEYTAIYAQINMEFEIADMPLDISAGFRYEETDVKASAMVPAYTGVDWVSNNEFATVDTGESAFTNFDGDYNNFLPNLDISLEIDDDWVARASFGKTLSRPTYNNIRGGVGIGEIRQGFATASSGDPGLIPFESVNVDLSLEWYFDEGSYASVGYFRKDIENFIGTTKNKSELFGLRSPTSGPRFDEAMAAVGSSDNTAIRQYIFDNYPESSTITGVDASGTTTGQIHSVAEDELIQFDVTVPFNERDATIDGFEIAFQHALESGFGIQANLTFVDSDAEYDPTVFDSQFALPGLSDTANLVAFYDKNGIQVRIAYNWRDEFLVKTDNNLNNPRINESYSQIDINASYNINEDLVVFFEGINITDETQRMYSRSRNELLNAIQSGPRYNIGARYTF

SEQ ID NO: 14409 - protein, 814 aa, Haemophilus somnus
MKLYHLLFAFLIIPFLSFAQESNAAGTITISGTLVDKSTKTPLEFATVSLLSTNPGSTPQGGITDIDGKYSIQVVPGTYDVKWEYITFKTLIKKAEVLTADKDYGTIELEIDVAELDAAIVIAEKTTVDIRLDKKIYNIGKDLTVRGGSASDVLDNVPSVSVDVEGNVALRGNDNVTILIDGRPSALVGFNGAEALRQIPSDAIEKIEVITSPSARYDAEGTAGILNIILRKNKLLGFNGSMQLDTGYNPQLGLSFNGNLRSEKWNLFTNTGFRYRETPGNSTTSTEYLSPSAQNSFVNEERVFDRLGRNFFTSLGAEYFINDQSSIVANIVYRLGNDDDLNTNIIDRLDANGNLNEATSRVEAESEDDTRIQYSLDYKNDLDENGQKITASIQYSTSVEEQNANILETETTTNTINDVERTLSEEDEKNATAQFDYVLPIGEDTQFEAGYRGNYRDISNSFFLEEQLTFPNGPLVPDAGLNNTFDYEELVNAVYSQYGKEYGKFSFLAGLRFEHTNVTISQETVNTVDKKDYSSLFPTLNLGYEIQDGENITLGYNRRVRRPRGRFLNPFPSRSSESNVFQGNVDLDPTFTNSVDLGYLRRWKKVTLSTSIYYNSSDDNWEFIQEDTGQITDNGDPIIRRTPVNLSTQERIGYELTLTYRPFKWWTINSDFNLYRVTTDGDFNGQNFDFENTTYFARLNQKFSIPSGIDLQTRLNYRGASENAQSTNDGIFTMNLAASKDIMGDDATISLNVSDLFNSRKRQGTTITDDFITDSEFQWRERQVNLSFVYRFNQKKKNGRGDGGDGGDDYEFEG

SEQ ID NO: 14410 - protein, 414 aa, Haemophilus somnus
MSNKEMKDKERDIFDDLFRSKLQDFEADTMPGDWEAIADRLPVKKSVPFRRTLRYWGAAAVISLLVVTGGVYVFNRDREHLPIAETIRKETEAVENRLTERSESVTPAVVASKPVDRMAKRAVAQVTAVTTSRSDITVDEVVLSPEEDCDTVVVISSKISEASEAIAVTETATLTGTHFLFADAAPVKTEEKKVRAKRWSFGMGGGSVSAGTSNSLNAYALKNTLMTDQELLQLNSPYFNSQSPKTNIRHKTPVSIGLGVSYSINDRFSLQSGLNYTFLSSEWETGAIYHGETKQKLHFIGIPLSLSYKIAEWKRIQFYAAAGAMTEINVAGKLNAKIFVENNEIRHEKKHIRMKEWMWSVNARAGASYPLLRFLSVYAEVGAGYYFDNGSDIETIRSEKPFNVNLQAGFRFGF

SEQ ID NO: 14411 - protein, 724 aa, Haemophilus somnus
MANQTGKKVVSLSLLALSIGQAFATEEVNESQPTNKQKTDENMVVTATRYSQDTDKIPGSVHVISEKELEQQTAVSDDLTSVIANLVPGMTPSRQKLSTQGENLRGRTALIMVDGVPQNNPLRNGNRNGYTVDSSMLERVEVVQGASAVQGNGATGGIINYVTKSAKPGDHWKQTVGTRVTSNLKEDGTGGKVYYNLSQYDEDYDLFIGGAWEQQGLYYDGNGNPIGMNSIQGETQDSNATNFLAKGGYNFDGGNQRVSFSASRYQLKGNQNYVSVPGDWQNGVPGTVVPGTPSGDPTSNYAELYNFGYDHYDFFGGELKFQAFYQDFEAVFGEASWWPTANKQYDQGAIVSTKKGFKLSYVKTDLLGWDDSWVIGLDGLEDTTKQTLTQSGKDVTPDMMYQSLAPFIQGDMLVTDSLRLSGGVRFENTKVTVADGQTLWGYGNAGHRQVDIIGGEQNFSQAVFNAGAVYDFTPSISSFVGFSQGFGLPDIGRVLRGNWIGGPAVVAPVGGAPIDFNTMPAVKPVVTDNYEVGLSYSDDKWFVSGSTYMSIAKDGANLSLNSGGTYDVVRQRTDIKGYEFTATYNILPTTQIQALYAHVEGQVDTNQDGSVDSDMDLKNLSPDRLLMAVNHSFSDRWNGRLQYNHMFSRSKEKNDAGSAQQFDGYGLMDVSMFYDMQRYGRISVGIENLLNEQYINYFSQIRHHNAYYFSGRGRTFSLGYEIDF

SEQ ID NO: 14412 - protein, 699 aa, Haemophilus somnus
MFFKSHLTLLIGAILAAPVVQAQNEVQNTASETDEHMVVTGRDYGFKVDTNSTAMRVEATQLETPGQVTVIDEQLIDEQRASTLGDVLKNDSSISAGGVSRNRESFSLRGFSLDSGSSFLRDGKQHWSHYRQPIELLERVEVLKGPAGLLYGKSAPGGLVNMVSKKPTYETQVHVSQDIGSNNESRTIADVSGSLNDAQTLRARAIVSKQSYDSWRSYSDGSTPSTERFVGGLFVDYDVNDDVTVSFHYDKTNDNGSVDSGAYIVDGKPVLGRDFIWDAQWSNIENDVENVGFDVAATLSSVWSIKGGYNHQDFERHDTESFSKPDTYNAATGTYEYQGYDRWDNWQFDTAYIDLVGEFDALGVSHQMLVGANWLGYYYSTQSQSIKGQTATVGQPLEKPSGLDYRNGKKGDATERDSYGIYVQDMITFNDQWQVLAGLRFDREENDTDTYNNILPKAGVIYHPASNGSIYLTYSESFEPKDPINDDQDINNGKALDPVKGRLYELGSKWELMDNQLFVSGAVFEITQENKVISQDINGNPDFESETTQAGKQVHRGAELSTMGYVTEAFSLSGSMMYLDAEIQDEFDSSIDGNRPADVPEFSANVWTRYSFENNTDVNLGAIYVGERFGDEKNTYKKDAYTRFDAGVAHTVKYDENLDIIARFNVENIFDKEYLAGGSQTKTVLGEGRNYMATLQFRY

SEQ ID NO: 14413 - protein, 384 aa, Haemophilus somnus
MKKTLVALAVAAVAASANATTVYNQNGTKVEVGGRVDVMLGKFGDAQRTDLRNNDSRVEFKAEHEVQNGLKAIGAVRFGLGDSSEEDSSFKEIKLSKLWLGLKHNDIGKVTFGKQNTTADDVQLNDHTYIFGGNNNLVTSGDKVVSFRTADIQLAEGQTLGFGLDYGFGEAHKKDINTKDAKDNKHIKLKNTYGVSAFYAGNFGDIKVNANAGYTVRNNNDLEGPINSKTDNQHKAWRLATQVEFGPASLGVEYGQTTSENKKLFIGSARYLLVGAKYEVLPDVLNVYTQWQRNGFRSATADQFDLNLSLAGVKLKDSLKHKGINGILNEHQKAVQNVFIVGADYAFNKNLKAYAEYANSRVKAHKKQENVRESFYAAGLRVYF

SEQ ID NO: 14414 - protein, 811 aa, Haemophilus somnus
MKLSDFKFLVFILFSFNCFSQNKISGTITSISGAKLPLVEIYNKTTGTKSFSDKNGAFSIEVEKLSNYDFTFYKENYSIVEIEMAPSEKNKIIILEKITTLSEVVIKNQKEKIFALNKLRDIEETAIYAGKKTEVIAIEKLTINKSTNNARQIFAQVVGLTINESSDGGLQLSIGGRGLNPNRTSNFNTRQNDYDISADVLGYPESYYATPTEGLAEIQVIRGAASLQYGTQFGGLVNFKIKKPTTKPFEITTRNTVGSYGLFTNFTSLSGTNGKFSYYTFYNYKQGDGFRPNSNFESKNYFGNLNYQFTDKTSLHFDYTHFSYLAQQAGGLTDVMFNKNPLQSNRTRNWFAVNWNLFALRLKHKFNPTTDFSLQLFGLDASRKAIGYRSNRVSNPDALETERDLIIGEFKNWGAEARFLKRYKIKNNISAFLIGAKYYQSDNSGIQNAGSSGSDANFEVASNEFPFYQNQSNYKYPNLNLAVFGENIFKISPKFSITPGFRFENIKTQAIGFYRQINRDFAGNIILDKNISEHIIKDRNLLLLGIGLSYKPKNRIEFYGNISQNYRSVTFNDIRTVSPSQVIDKNISDEKGYTSDIGVRGQISDKITFDTNIFGLYYDDKIGEFERRNPNGSAAIVRFRGNIGTAVTYGFETMLDWSLSKTFFATKKQLTWNVFLNTAITESEYLNSEIFNIKGKKVEFVPLYNIKTGTGIGYKNFMSGIQMAYVSSQFTEANNNFTDKNDNTYGIFGQIPTYYVADFSCSYKLKHFKIESGINNFTNNSYFTRRATGYPGPGIIPSDNRTFYATLEFVF

SEQ ID NO: 14415 - protein, 254 aa, Haemophilus somnus
MLNFKETFSTLDKNSETINKDLASLPNTKSIQDMTKVYQAKQSLNHPVGLQNLCSLDTNKYDQFQAIRQELGKNPFRRFGVIDAKTNNGTMNGIGVQVGYKQFFGKKRNWGLRYYGFFDYNHAFIKSNFFNSASDVWTYGVGTDLLYNFINDKNTNFLGKNNKLSVGLFGGIALAGTSWLNSQYVNLSMMNGIYNAKVSASNFQFLFDAGIRMNLARAKKKDGDHSTQHGIELGVKVPTLNTSYYSFMGAKLDY

SEQ ID NO: 14416 - protein, 2893 aa, Haemophilus somnus
MKKFKKKPKSIKRSHQNQKTILKRPLWLMPLLISGFASGVYANNLWDLLNPKVGGEYVHWVKGSQYCAWWEFAGCLKNVWGANHKGYDAGNAANYLSSQNYQAISVGSGNETGTYSLSGFTNYVGGNLTINLGNSVVLDLSGSNSFTSYQGYNQGKDDVTFTVGAINLNGTLEVGNRVGSGAGTHTGTATLNLNANKVNINSNINAYKTSQVNIGNANSVITIGSVSLSGDVCSSLASVGIGANCSTSGPSYSFKGTTNATNTAFSNASGSFTFEENATFSGAKWNGGTYTFNKEFSATNNTAFSSGSFNFKGVSSFNGTSFSNASYTFDNQATFQNSSFNGGTFTFNNQTNPTNNAQHPQIQNSSFSGNATTLKGFVNFQQAFNNSNHQLTIQNASFNNATFNNTGKITIEKDASFNNTTFNTSVDTNNMSVTGGVTLSGKNDLKNGSTLDFGSSKITLAQGTTFNLTSLGSEKSVTILNSSGGITYSNLLNHAINGLTSALKTNESLSNPQSFAQGLWDIITYNGVTGQLLNENAATSKPTDSSPSKSSTNSTQVYQVGYKIGDTIYKLQETFSHNSIIIQALESGTYTPPPVINGSKFDLSASNYINADMPWYDHKYYIPKSQNFTESGTYYLPSVQIWGSYTNSFKQTFSANGSNLVIGYNSTWTDHNVSSSGTVSFGDTSGSALNGHCGPWPYYQCTGTTNGTYSAYHVYITANLRSGNRIGTGGAANLIFNGVDSINIANATITQHNAGIYSSSMTFSTQSMDNSQNLNGLNSNGKLSVYGTTFTNEAKDGKFIFNAGQAVFENTNFNGGSYQFSGDSLNFSNNNQFNSGSFEISAKNASFNNANFNNSASFNFNNSNATTSFVGDFTNANSNLQIAGNAVFGNSTNGSQNTANFNNTGSVNISGNATFDNVVFNGPTNTSVKGQVTLNNITLKNLNAPLSFGDGTITFNAHSVINIAESITNGNPITLVSSSKEIEYNNAFSKNLWQLINYQGHGASSEKLVSSAGNGVYDVVYSFNNQTYNFQEVFSQNSISIRRLGVNMVFDYVDMEKSDHLYYQNALGFMTYMPNSYNNNLGNANNTIYYYDKSIDFYASGKTLFTKAEFSQTFTGQNSAIVFGAKSIWTSLSDAPQSNTIIRFGDNKGAGSNDASGHCWNLQCIGFITGHYEAQKIYITGSIESGNRISSGGGASLNFNGLQGILLTNATLYNRAAGTQSSSMNFISNSANIQAQNSYFIDDTAQNGGNPNFSFNALNLDFSNSSFRGYVGKTQSVFKFNAKNAISFTNSTNLSSGLYQMQAKSVLFDNSNLSVSVGTSSIKANAINLSQNASINASNHSTLELQGDLNVNDTSSLNLNQSTINVSNNATINDYASLIASNGSHLNFNGAVNFNSANITTSLNNSSIVFKGAVSLGGQFNLSNNSSLDFQGSSAITSNTAFNFYDNAFSQSPITFHQALDIKAPLSLGGNLLNPNNSSVLDLKNSQLVFGDQGSLNIANIDLLSDLNDNKNRVYNIIQADMNSNWYERISFFGMHINDGIYDAKNQTYSFTNPLNNALKITESFKDNQLSVTLSQIPGIKNTLYNIGSEIFNYQKVYNNANGVYSYSDDAQGVFYLTSNVKGYYNPNQSYQASGSNNTTKNNNLTSESSIISQTYNAQGNPISALHIYNKGYNFNNIKALGQMALKLYPEIKKVLGNDFSPSSLNALNSNALNQLTKLITPNDWKNINELIDNANNSVVQNFNNGTLIVGATQIGQTDTNSAVVFGGLGYQTPCDYTDIVCQKFRGTYLGQLLESSSADLGYIDTTFNAKEIYLTGTLGSGNAWGTGGSASVTFNSQTSLILNQANIVSSQTDGIFSMLGQEGINKVFNQAGLANILGEVAVQSINKAGGLGNLIVNTLGSNSVIGGYLTPEQKNQTLSQLLGQNNFDNLMNDSGLNTAIKDLIRQKLGFWTGLVGGLAGLGGIDLQNPEKLIGSMSINDLLSKKGLFNQITGFISANDIGQVISVMLQDIVKPSNALKNDVAALGKQMIGEFLGQDTLNSLESLLQNQQIKSVLDKVLAAKGLGPIYEQGLGDLIPNLGKKGLFAPYGLSQVWQKGDFSFNAQGNVFVQNSTFSNANGGTLSFNAGNSLIFAGNNHIAFTNHAGTLQLLSDQVSNINITTLNASNGLKINAANNNVSVSQGNLFVSASCAQQSDPTTANIANPCALSAQSTNGASSNNASNNAPIALSNNDESLMVAANDFNFSGNIYANGVVDFSKIKGSANIKNLYLYNNAQFQANNLTISNQAVLEKNASFVTNNLNIQGAFNNNATQKIEVLQNLVIASNASLSTGIYGLEVGGALNNSGAIHFNLENTQTPTPLIQAEGIINLNTTQTPFMNVNNSMANNTTYTLLKSSRYIDYNINPNSLQSYLNLYTLININGNHIEEKNGALTYLGQRVLLQDKGLLLSVALPNSNNASQNNILSLSVLYNQVKMSCGDKAMDFTPPTLQDYIVGIQGQSALNQIEAVGGNAIKWLSTLMMETKENPFFAPIYLKNHSLNEILGVTKDLQNTASLISNPNFRDNATNLLELASYTQQTSRLTKLSDFRSREGESDFSLLELKNKRFSDPNPEVFVKYSQLSKHPNNLWVQGVGGASFISGGNGTLYGLNAGYDRLVKNVILGGYVAYGYSDFNGNIMHSLGNNVDVGMYARAFLKRNEFTLSANETYGGNATSINSSNSLLSVLNQRYNYNTWTTSVNGNYGYDFMFKQKSVVLKPQVGLSYHFIGLSGMKGNDAAYKQFLMHSNPSNESVLTLNMGLESRKYFGKNSYYFVTARLGRDLLIKSKGSNTVRFVGENTLLYRKGEVFNTFASVITGGEMHLWRLVYVNAGVGLKMGLQYQDINITGNVGMRVAF

SEQ ID NO: 14417 - protein, 383 aa, Haemophilus somnus
MKKTALTSASLALLVAAGSAHAQNSVTLYGVIDAGIGYVHNASSGSNLAGMLNGNLSGDRWGLKGQEDLGGGLKAIFTLENGFDVGTGKLGQGSREFGRQSFVGLTGATWGTVTAGRQYDPITDMVQGVTADNFFGSAFATPGDVDNNDNSARVSNAVKYVSPNYAGLQFEALYAFSGVAGQAGQGYTYSGAVSYSNGPFSLAGGYLRATNASSTTARSSWASSTTDSIFDSHINDGYVTAKSVSIAQIGGQYALGPITLGASYSNTQLKSDGASTFTGTEKYNSGKAFVAYQATPALVAGLGYAYTAASGDTSAHYHQLSIGADYNISKRTDFYAVAAYQHASGTQRLADGTTQDAQASIGSYGYNGTDSQALAIVGIRHKF

SEQ ID NO: 14418 - protein, 702 aa, Haemophilus somnus
MPIASRAPVSLTLLALLFGSKLAAADLFNDPSGVPEVLTATRLKQSPAEVPGSISVLDRELIVASGARDIPELMRLVPGMMVGYLSGNQPTVNYHGTSMSGARRLQVLIDGRSVYRPGLASVDWSDLPLALEDVERIEVFRGPNTVSYGANALMGVINIITRAPGESPGTRLKYTAGQRGIRDWYASQSIALEDSDFRLSLSGQEDDGFDHDLDGHALRDGRRLSRFNLNASHSLAPNQSLEWQLAAKEGSNQHPYAYRSPFPQVPDDVDNSDTLAHDYAGSLRWNVDLDPRHSFYIQGYAQHWERRQEWNACEAGIAFSPQLAQLWELNPDYLRRFADDPTRLPPGSPQELQLATQVLDQLRNSGLRPVCGRVDRNIRESRYDLEMQDTLSLGDNLRLLNGLSYRYDQANSETFYGGRVSSQIWRLFSQLEWHAGEHWLLQGGGMLEDVEGSGSSFSPRLAVNYLFNPQHSLRAVYSEAVRSPGMYENDVDWRYRVRHLTPAPYGQSEAYYFASAHGPGDLGKEHTRSREIGYNGFFRETGLAMDVRLFHEEITGLISDPLSVVDFSPDNGDRIRFSGAEGQLDWRLGLRDRLRATYAYLDYDATSRYDRRLTARHGGSAGWMHDWGQGWSSALFYYGDDSLNGHRFERVDLRLAKRIPLGKAALELAGVLQQRLDDQPLTFPDNRYDSRHLLYFSAEVTF

SEQ ID NO: 14419 - protein, 409 aa, Haemophilus somnus
MKFTKLSLIAALAVSAAVAGGDIAPAPAPVEEAPQTTIDGKLTGYYITADNGKDYSPTQSYDMFDKDWSQLGLAATLDVNHKFTDNIAMNLSAIGYVNTNRDIPFDYIGEYFEGEPQGAFINVANITATFMDTTFILGRQLLNTPMLAGFDWLLAPGSFEAYTVANHSIENVTLLGSYVRTWRPNNAGNNWIDFTSDSDMQAVTGDPLAEGGNNWTVSAAYDNEKLSGSIWYYNVDAMNYTQFYVDGGYDFDVAKLAAQYVYTDWDNEDASNVIGVKATATLGSFNLMAAYTNISDNVAGWVGVMDGLYTSSWNTASGGSEGNNFKVKAATEFAGLTASASYAYYEYDQNSIAGTEDDGYEVDVILGYDFKSTDIVVIKDMDLNVVYTNTDYGLGGDTNALEIYANYKF

SEQ ID NO: 14420 - protein, 201 aa, Haemophilus somnus
MKKISIAATVLLSCMASGAMAQDTFTGFFMGGEVHHSKHGYEGTLSQTAKSETQKKSGKIGFGLFGGYGFNFGDSNFVGQAEVKLRTGGSKITSNNELLSKEKFSFSVGYLQGYRISNNFMPYLKVSLNSHFYDLNAKKICDSCTIKGNSVVGIGAAVGVKYAVTDKFDVGVEYQKVFLRNIKGDIRFKPQSLSLSASYYF

SEQ ID NO: 14421 - protein, 1138 aa, Synechococcus sp.
MKLISIRKMKKRINVPANVKMGRICAIWLFCIALQAISIPILAQSAKITLRLKNVTVEEVLTSIENQTEYRFLYNKDIVDVSRIVSISVKNELMTLVLDRLFKGEGVSYTIEKRQIVLNKVSSRAQDNKQPVKVTGKVVDESGEALPGVTVMIEGATQGTITGIDGNYQLQVPEGSTLKFTSIGYTTYTQKITRPMTLNVTMKEDSKQLDEVVVVGYGTTTRKNLTTSIATVKTEKISRAATSNMSQMLLGRAAGLEATLTSPQPGGAVDLSIRGAGTPIFIVDGVMMPSTSLEVGNGNQVMPNSINRSGLAGLNPADIESIEVLKDASASIYGIGAANGVVLITTKKGTETRPQITYEGNYSIVKNYPYLEPLSGEEYMNVANIFNKENYLFTNGMYPYGDKPFDNKWVPQFSPQQIAAAQTTDWLDCVLKDGSINNHNITITGGSKLLKYYLSGNYYKQEGTVENSAMERYALRTNISSQLLPFLKLTAIVNVNENEYTNSTSGGGGGGNGYDAIQSALTYPSYLPIRGEDGKPTLYSNYPNPAEMIKVSDRTKTSGYYLNFAADVDIIKDMLSFRLMYGINKENANRNLYVPSDIYFMDMYKSRGHLGYVERRNQTMEGTLTFKKQFGDLLRVDAVVGMGRYTNDSNGLELDYEQINDHIAADKVEAAEGAFYPTSFRAADERRSQFARASVDVLDRYVVAATIRRDGTDKFFPGKKYAYFPSVSLAWKLSNEPFMKHISWIDQLKIRGSYGQTGNDNLGSSLYGTFSLAAQYIKFSNNSVTYVPYLLSGPDYPNVTWEKTTMKNIGVDFSVLKDRIWGSFDMFRNDVTNLLGYDSASPLSMTSSVPMNYGHYVRYGWDATINSLNFEIPRVFKWTSQLTLSHHNAVWKERMPNYYYEEYRIRKNEPVNAYYYYETEGVINIDKSNMPESQKSLPVDAQQPGYPIIKDANGDNKITIDDVKMRNTLPKIHIGFGNTFVYKDFDLDVFMYGQFGRTRYNYAYRWALVGDVYYTSPKNSNKYVYTIWNSQTNQNGNRRGIASTKAVALPGNVGFEEDYQNASFVRIRNITLGYNLSGKKLGRVGDYVSSIRVFIDCQNPFTFTKFVGVDPEIKTGGDGSKAEYPMTRTYSFGAKICF

SEQ ID NO: 14422 - protein, 702 aa, Synechococcus sp.
MKLFGNITIQRRTGRFFDLTFFIVFTMFMSISPLVWAQNEEAPGEEETAQKQAMEADYVLNDMVVTAQRLPDDFRTGDVDQENAPSFFTVIPREQFIGKMENLAQVLKKEAGIQVKQSGGLGSFSTVSLRGSSSDQVMIYLDGILLNDASGGGVDLSNISLADVSSINVYRGVSPASFGKAGIGGVINIKTLRAQKGTKYNVGLGYGSFDTKKAFGFINHKPGKADFLLSADYLGSANDFEFKNDMGTSWNKVDDQIQKRNNAEFYQYNVLAKAGWDANRNLRFDLVNQYFFKDQNLPNWINMETASTNLTTSRNITTMRLGLNNVTPLALNTAASISYSDKEEKYDDQEGSVGLGKQLNKYNTQRWTGDLYTEWISDYNILAAKIEYQHEDYSPEDLLQEDDPRDSNRDYIVATLQDTLMLLSQRVILTPAVRYAWLDDELESGTTVWGSQLEKSERKDEYWMPQCGLKVKPWEWISLKANAAQYVREPSFFELFGDRGFFIGNEELEAEKGTNFDVGFEVNYLTGWTLINRVYLSSAYFKNDVDDLITRIYDSRGVGKSVNISESEITGVESQAAADFLNLFTVSGNATWQDAVNASEISTFNNKQLPGRYEWATSGKVEFHYKGFKIYSEYFYEAGNFYDAANLLEAPEKKELNAGAAYLFKGFSIELQGKNLRDKRYEDYNGYPLPGRAYYLTIKFEG

SEQ ID NO: 14423 - protein, 571 aa, Synechococcus sp.
MKLFHQLLVAPAALGLLAPVAANATELNINGVSDYAASGEQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFSTTTKLKGQATFVIGANSFGGDARQGVADVLGIVNPNAVGFVGEKRADAAAADIGATTFNYDLRLFLDTSFTGKDLFRTMLRGGNFADSAYSGGGYVGLDAMETAFEEGSPNNVVVNRLWYQFPIGSNFTATVGGRVRQDDMLAVWPSAYPTDTVLDFFTYAGAPQTYNLQLGAGGGLSWESNDFSISANYVSGNGSNSTPGVADTNAFLRDASDCGGIATDCASSSGTVQIAYAPENWGLAAAYNYASGNNGAGIYAGNGTPTANLFSALGTTNSFGLSAWWTPEEASWIPSISAGWGYNSVDISNADFGGAFGLNGSIDGATSQSWYVGIQWADAFLKGNTLGMAVGQPTFVTSWDNDSDINGGSDFVADGNYAWEWWYQFQVTDNISVTPALYYLSRPLGFATNNLEGGSDDTFNNFGGLVKTTFKF

SEQ ID NO: 14424 - protein, 375 aa, Synechococcus sp.
MQQTTLRGGIALAVLALASGAAGAQSVTLYGLVDTGIEYVSHANSSGNGLVRIPSVTGTLPSRWGLRGAEDLGGGVKAVFTLESGFNTDTGTAGQGGRLFGRQAWVGLAGSYGTLTLGRQYSMSFLSLGDADLLGPSQYAIGSLDTYIPNARTDNTVVYKGTFGGLTVGATYAFGRDAAGGVPASGTCAGEQAGSASSCRTVSAMLKYDAATFGVAGAYEEQHGGAGATASFFNGSAPIPFTNAGDKDRRLIANGYARLGPAKLGIGWIGRTLMSAAGDVRSNLYFINGSYPLTAALTLDAGLLRIINTDQGRSATMAVLRGVYALSRRTALYAQTGYLWNSANAQYTVSGGGGGTTPGRGVNQLGAMVGMRHAF

SEQ ID NO: 14425 - protein, 843 aa, Synechococcus sp.
MNLVMRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDMFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 14426 - protein, 977 aa, Synechococcus sp.
MVIILPNFFLQKPVCRLLAVVGFLGFSGAIASQSSSPANIDSVKTYMKKNSFEKNVGSRFVTNRSIDSFGVSDTVDIKMLQRSQFLSIQQLLKGNVPGVYVQENNGEPGTIQSMLVRGLSSPVFSNKDVSSVQPTVYLNGVPLMLENSYVYDIKQFDINPIGAAANMLAGLDISSIESIEIIKDPLQLAKLGPLAANGAIWITTKDGYYGGENVSIGVSAGMAFAPSSVRMTNGSYEKAFRQRFYDTYSLTPGKQPYYLMDTRDVRYFGKPDWADDYYQSSLLYNVNASIGGGSKKANYVFTLATTKDAGAADNTSYTKYNIGFALNMVPLDGLNVSTIINAAKIDRVRNRNFRDRFAEMEYMVDFSTPLAPAGNLYNDFLISNDLTKDDNYNNLLNGLLALSYTKQRFNATASIKLDYTTNVRRAFWPMALLESVNFVSNYSGYNQRIIGETSASYLLPLADIHKLNVQWNGSITSDLYHYNYTRAYDGDDDMKPTTSTGNFKQYRYVDRLENRWVSTSIALDYKYKNLLNVGLLARYDGNSAIQSDHRWMFTPAASAEWNLKNHFFTGSTALSGLSLRASYARIAKSFQSDRYELGPQYLATSITWSGEPLLSSANGFATITRPYASGWVGYDLKLPYSDKMELALKGSFFDNRIIAEISLYKNYEKNLLTYLPVTQEMGYEYKLASGMDISNQGLELNLSASILKNTPLKWDLSFNASYNKNKLEKLPENQKTTVIGDHKLQVGQSVDAFWVYQNKGIYTNDSEVPVMNGKPLNINGVPFKAGDPVWTDVDGNNQINDNDRVLTGHAIPPYTGGLTNQFAYKGFDFSFNLFFALGHSALNLRDQQRYDFATLDNIQSLQSVKEIFFWQNTNQRDDYPIYNPQSSVHPYRAEQDLFLEKLSYLKLRNITVGYTLPIKKVGSNIPKSLYFYLTGSNLLSFSNFSAGDPELVNFNGTYDGYSLPIPRSISLGLRFKF

SEQ ID NO: 14427 - protein, 389 aa, Synechococcus sp.
MRPVHRFAFPITLSTLCCAAACAQSGVTLYGLLDGGVAYVSHAAAANGASGSAFRFGNAMSGNRWGLKGSEELGGGLSAVFQLESGYSLGTGMAAQGGREFGRTAIVGLSSTRWGTVRMGRQYDPLVDLVSALTEDAYFGLTFGPPGDVDNYDGSMRVNNAIKYTSPLVGGLRVAALYGFGGVAGATSAGQTWSVAGSYAYGPFSVAAGYFSANGGNTMNDAGVRTWSASTDSPFNTAANVGFGSTHAVNIARIAGQYAAGAWTVGTGYSRTEYVPDGASVFQVRTRFNDGSAFANYRIGAALNVGIGYHYTWLAGASAAHYHQLNAGVDYLLSKRTDVYAIAAFQRASGTTLGADGTRVTAQAVIGDYGLNAGANTQTIVAIGMRQRF

SEQ ID NO: 14428 - protein, 240 aa, Synechococcus sp.
MLRGGNAFFHFHCIRVFPMKRHTLAACLLLASPIALAKQGFYLGTDQSVSFYSYQSDDLEQDHLYDVSPKKVGVGIGATLGYQFIDWFALEAGVSYWLANPINQTVSYSYFEGHLDKAIISLETQSLNLNIGPKFSWRVANQLSLYGKPTLHYTTTSTNWDQYTASYIDDSLIMTTNERKKTRNSSVHSGIEVGSEWHFTPRFSMTLSYQYLTDALYVDSPEIKKEFDQQAIKIGVLFDI

SEQ ID NO: 14429 - protein, 759 aa, Synechococcus sp.
MCDTCRDDDGTSPSIRVQGGVVQGGMGANNVAVVATGSGKVAIENAELLGASGMYATFGAQVDMKGGRILAHNTNILGSQGYADGPYGGVVVTEDGQVNLEGAKVSATGLGAAGLWLLGDKDTSPRASLRNTDVHGEVAAIALGFNGEANISGGSLSVEDGAVLTTLTPDAVEYYYDYALSMEHLPADAPLTPVRVTLSDGARASGETLIAHGGLLPMTLRLSSGVDARGDIVTLPPSAPPDSAEQPDAEPEPDAELEPDAAAQSDAKANARVMAQVDGGEPVAVPIPAPSHPDAPIDVFIDSGAQWRGMTKTVNALRIEDGTWTVTGSSTVNSLHLQAGKVAYATPAESDGEFKHLRVKTLSGSGLFEMNASADLSDGDLLVVSDEASGQHKVLVRGAGTEPTGVESLTLVELPEGSQTKFTLANRGGVVDAGAFRYRLTPDNGVWGLERTSQLSAVANAALNTGGVGAASSIWYAEGNALSKRLGELRLDPGAGGFWGRTFAQKQQLDNKAGRRFDQKVYGFELGADHAIAGQQGRWHVGGLLGYTRARRSFIDDGAGHTDSAHIGAYAAYVADNGFYFDSTLRASRFENDFTVTATDAVSVRGKYRANGVGATLEAGKRFTLHDGWFVEPQSEVSLFHASGGTYRAANNLSVKDEGGTSAVLRLGLAAGRRIDLGKDRVIQPYATLSWLQEFKGVTTVRTNGYGLRTDLSGGRAELALGLAAALGRGHQLYTSYEYAKGNKLTLPWTFHLGYRYTW

SEQ ID NO: 14430 - protein, 997 aa, Synechococcus sp.
MNTFTFKKSQLAASVSLIIAASTFNLVYAAEENTAEPELEIIEVKGIRGSLIRSMDVKRDASGVVDAISAEEMGKFPDTNLAESLQRITGVSVSRSNGEGSQITVRGFGPSFNLVTLNGRQMAGTGFTRSFNFENLSSEGVSSLEVMKTARADSPTGGLGATVNIVTAKPLQKPGERFSFMAKGIHDTSVEEGDKVTPEIAGIYSNTFDDERFGVSANFSYHRRDFQRQAANVRSWLVNPNLSVDAANIVDNRPMDAEGNPAKQFFDPNAGENGEFVSAAFFPQEVSFAKDDIQRERLNAQATFQFAPTDNLTFTLDHTISQATTGNNSLSWGIWNGSFGGNANAYELDENGTAVYYNSAGDDASFTAFRETSEVDSKATGINVEWLATENLSFNFDAHTSKTTTDNGKDPGLGANARIILGSADISTKEYSFREGDVPGFNVNWNNGTQEVDPNQIGSNFSIFTRTPGESEVSQVQLDGKLFTYTDIGLETVKFGAAYTKQTLSGWGGSNNANAPGFNNGTFAEIFPDSMFERVDLSGFLDEFSFGPNGVAPGYAYTYDLDEAFARQSAFLTEDVIGSDVYQIGTFDGFPTNKVEEETISVYLSTNWVFNVSDYDVFVNLGIRYEETDIVSPAKSRVAQQVYWAGGSEWLTEFASGGELVEVDYKGNYDLLLPMIDVKVDLSDSLVSRVSWGQTITRPTLGDMLGNLSLTPSPKLNSRSGSRGNPNLQPFKSTNFDLSLEYYYNKGSYAAVGMFWKDVDNWIDNTQVTTTFEGLHDVYLGQRWNNAVTAIEGRGEQATDSAIYNEIVANGVGIGENNRVLPDSATDPLIEWTINSPENVGSRKVNGVEFAIQHLFGESGFGAGFNATIVDGDVEYDNYYLASQAVLAGLSDSANLQGFYEKDGLSVKITGAWRDEYLIAQGLPDSGATAPPQYAEEYLQWDISVNYEVNESTTVFFEGVNLTNETERSFSRFESQFLSAAQYGPRYAFGFRYSMGN

SEQ ID NO: 14431 - protein, 132 aa, Pseudomonas stutzeri
KEYGVLDSKKYIPTNGNTIGYTYKVTDGLVLGANYLLAQERNYDDGEVIPQKVSNGVQVGAKYDANNIIARIAYGRTNYKENTIEKLDLGKKQQVNGALSTLGYRFSDLGLLVSLDSGYAKTKNYKDKHEKR

SEQ ID NO: 14432 - protein, 717 aa, Ralstonia eutropha
MQPAAALRSCPARVPGQSVPARARLAGALSMLFGVLPGAALASEDLFFSELPIVATVSRLPQRLADASASVTVIDRDMIKASGARDLNDVFRLVPGFQTYPNNTDAARVTYHGLTDEDFSPRLQVLIDGRSQYSPLFRNGVNWATLPVALEDIERIEVVRGSNAVSYGSNAFLGVINIITVEPALVRGTSISTNIGNQGVRDLTLRHGTHLGESGDLRITYQSKKDDGLKDQFDWKDSFESRLIDLRSDLWLTNRDQLQLSLGHVDAVTRRGRLARSNGVLTGGEDPENPLRDFTQSDSYVQAMWRHALDDGADIQLRYAYTESRGSEMHTERYGNVLFKVDAVGDLGTRHELEAQHSFAPTETTRLAWGGAYRLDSLTSDNYLPDGTVYRRVARIFGNLEWKPAEWLTTNLGAATEYDSIAGRNFSPRLSTSFHLNPENTIRIGASRAFRTGATVDYVGNVRATPYGTTDGSPVPPIAVQDMYGDPDMAQEKITTVELGYLGEWSALRSSLDVRLFRERVPNRTLSIRRRVSDPALCDQPLTGRCASPYFTLPIQRVKIEGVEYQWRWQPFNDTRLLLGQSFIRIKSDFLASAMDYPVPTTLDDPRQAARIDAHTEQSAPERSTSLLLMQKLPGNIDFSLAGYWVDAMKWTRNSSVDFYRRFDMRLGYPFEFGPTRGEIAYTAQSINGAHGEFKSSGEPADRVVDLRHWITLRIDL

SEQ ID NO: 14433 - protein, 889 aa, Ralstonia eutropha
MKTRSFLKLSSMTLAIATISTGAYSAQLEEIIVTAQKRAESLQDVPISMTAITGERMKDAGITSFADLNGFVPNLAISENAVNTIITMRGISVGANQSFEQSVGVYVDGVHYGKSRQIRTGLFDLQQVEVLRGPQGILFGKNTLAGAINVTTAEPEMGEGMSGKVAATVESDDGELLEAHLNYSPSDNLGFRFAVRDRSDDGYMDNGFATAANGAPTAMPTTDETIWRFTTMWEPNDSTAIKLTHGESDFVRVGGPGAVTTFAPETNIPASNSVMFAMMGASFPDYAANVAAGDIDAFRDGRSIGGLALAQSLGRDLDRTEEKFEGTDTQTSDTALRIDIEMKNGYSFHSVTGRNTYDYEDGMDADWLPVTFVGRSDISEYKQTSQEFRIASPTDQTFSFVAGAYWSKAEQDIDRTVIVDGTLGNPDLMKVITGLGDPANGTASFLAFSKAQIAGAILGAQGVTDPAAIGAWMGTPTGIGTVNAFWGVDGMAMWNQAGRVSNYASTTDTVAAFFQGTYELSDTLTLTAGVRYTEEDKEASAKADLTASYTGLATPNETPFLAALQSASFGVWAHDFNEKRSTNQVIPAANLQWEQSDTSKYYISYSEGFKSGGFNSVDDQNPNILADGTVQRTVPGIGFEYDDESARSFEIGGKHVLLDGAMNLNWAYFNSEYEDQQVSTFVGLGFVVANAASSEIQGIEMDMTWQATDELRLGLAMAFLDGEYGSFDAAGCTASQASALLGLGDLTSSSPVTSAMGCQQQFLGDGNPSGSAQDISGGQLGSDYSGSITADYIKPLSNGLIWFAGLDVNFTDMYYMTGDLDPIDIQSGFEKVNIRAGIRGENWDMMLFGRNITDEITATGAADVPLAGGAHFSYMARGAVWGARLSYSF

SEQ ID NO: 14434 - protein, 386 aa, Ralstonia eutropha
MNRQVFALAVSAAVSVAFAASASAQTSVTLYGVLDEGINYTNNVGRGHVYELASGDAQGSRWGLKGAEELGGGLKAIFQLENGFDVSSGRFNQGGRMFGRQAFVGLSAERYGTLTFGRQYDSVVDYLAQTTANGSWGGLLFSHPYDNDNTDNTFRLDNSVKYTSPSLSGFQFGGVYSFSNDTGFANNRAYSFGGQYAYGGLLVAAAYLQADNPGNGANGAITANDASFIAARMRVFGGGITYTFGPATAGFVYTNSNYLDPTGNGYLGVTPLVPPGVLLNSLKYQNFELNGKYQISPMLFVGAQYVYSMETFDASTGGVKPKIHSFGLMADYNLSKRTDVYIQGEYQQVTGDSTYSILDEAFTPGTQSPSSTSKQVVVRAAIRHKF

SEQ ID NO: 14435 - protein, 602 aa, Ralstonia eutropha
MKRILPLILALVAGMAQADSNSDYRAGSDFAHQIKGQGSSSIQGFKPQESIPGYNANPDETKYYGGVTAGGDGGLKNDGTTEWATGETGKTITESFMNKPKDILSPDAPFIQTGRDVVNRADSIVGNTGQQCSAQEISRSEYTNYTCERDLQVEQYCTRTARMELQGSTTWETRTLEYEMSQLPAREVNGQYVVSITSPVTGEIVDAHYSWSRTYLQKSVPMTITVLGTPLSWNAKYSADASFTPVQKTLTAGVAFTSSHPVRVGNTKFKRHTAMKLRLVVRVKKASYTPYVVWSESCPFSKELGKLTKTECTEAGGNRTLVKDGQSYSMYQSCWAYRDTYVTQSADKGTCQTYTDNPACTLVSHQCAFYSEEGACLHEYATYSCESKTSGKVMVCGGDVFCLDGECDKAQSGKSNDFAEAVSQLAALAAAGKDVAALNGVDVRAFTGQAKFCKKAAAGYSNCCKDSGWGQDIGLAKCSSDEKALAKAKSNKLTVSVGEFCSKKVLGVCLEKKRSYCQFDSKLAQIVQQQGRNGQLRISFGSAKHPDCRGITVDELQKIQFNRLDFTNFYEDLMNNQKIPDSGVLTQKVKEQIADQLKQAGQ

SEQ ID NO: 14436 - protein, 263 aa, Ralstonia eutropha
MQSKNMNTALLAAALVMPSASVFADNNSHSTTAPQAKEKPFTTVYFAPRTQYRTASERFLQRLMLTGVVQDPNSIFARMYWSFETDSDLGKNMEQWKSSYEEAEFNKPFPLGESDFWLEPGVVFHWESAGSRIDPYLGIGYHFDPTLGAVLRYRYNHQNHDSQTLQGDWDDSSEHRVDIYLTKYFTPDFWVQYNPTYYSKTHGDKFEYANGKNHTLQHNFVFNFHATPRFYPFFELGYLDEYKDGDDTKNEYQIRVGFKYNLN

SEQ ID NO: 14437 - protein, 669 aa, Ralstonia eutropha
MRRCRRWSEPSIGALLLLCASPALAQDTDAGNLGDEEPEVHSQVASFAVTRLQESPAVVTAMNAEEIRNSGARDLMDLLLQIPGFFFGVDTQGAVGPGFRGLWGYEGKVLLVVDGKEMNEQLYSTMQLGNEFPIELIERIEVVRGPGSVIYGGNAELAVINVVTRGVQGSTDLMVSGMYGQMGSVNGRRGLTVSGRKVFESAPGLSIFASAGLSQAQRSNGVFQDFFGNSAQLGGNSRLDPTMVQAGVGYKDLQLSVLYQRYGTSAIVAFDEVLEAPAPTNFESLHAELSDRFRPDERVEIIPRLNLTFSKPFSDSDQDSPFFYDKQVLRLRGRTLARWAALDWLQLTGGVDVTSDQGWVNGPVGVGLQTGFGPEEADSVSYVNLAGFVEAFSVNPFVNVVAGARVENHSAFGESFVPRLVLLRSVGPFSGKALFSRAFRAPSIENISLGADVRPERTTVLELEGTLRMGEGHALSANAFDMGVADPIIYSYDAVTNTEAYRNLGRLGSRGVELDYHVRGSWGRAALNYSFYTPSGRNDVEDYQVPGQPNAFTGMPTHKAALTGSIKVLPWLTVSPTAVLVGKRYAVDVPDDEGNAAVEELPTQLLLNLFVRAQDVGTRGLEIGAGVYNLTGTNFRIAQPYNGGHAPMPVFSREFMVRISYLLDPVSDE

SEQ ID NO: 14438 - protein, 357 aa, Ralstonia eutropha
MNKNAITLALLATVVAPAMAQSTVSVSGIADAGLRSVSNSGLASVRSMVSGANATSRLVIRGTEDLGNGNSAGFHLEHGLALTNGTAASSTQFWDRRSTVSLASKTAGELRLGRDFVPSYSNWSRYDPFSHVGAASAGNFVSATPTGPIRSAFGSNGNTTVRANSAFQYLLPGGLGGLEGGLMLTAAGARSAADGQNKVTGLRLGWAGGPMGVSAASTTTENDLTTSGRFTDRALGASYDLGMVRVSAVVRQFKQAGAKQTNQLIGAWIPVGQGEIKASWQRADLAGQVGATVIDANDARQIGLGYVHNLSRRTALYTTYSRITNSGASVRVVPGGTSGMAAGGTSKGFEAGVRHNF

SEQ ID NO: 14439 - protein, 702 aa, Ralstonia eutropha
MKPFTRAALLLAGTAMAAPAMASTASADGQPERDYLPSDIVVKGERADDYGTDDGSTATKTPTPLIDVPQAVSFITEDQLEDQAVHQLGDALRYVPGISMETGEGHRDEVFIRGQESTADFYIDGLRDDAQYYRSLYNIERVEVLKGANALIFGRGAGGGAINRVAKRAEFQSAISGEASVDSFGAFALLADVNHAASDSLALRLNATYEEFDNDRDFYEGRFIGISPTLTAALGPDTTLYASYTYDNDERVTDRGVPSLNGGPLTGFDSTFFGDPDFNFATAEVNIARLRVEHAFNGGLSANASLQFADYDKAYQNIVPSGTDGTDVFLGGYRDTTVRRNWIGQANGIWEAGTGTIESTLLFGFEASSQDTQNARQTVSFDDGDPLTTDDNATPLAETIFIPAYTLNPTSRSRDSQLSTLSFYVQEQLQIGDYIELVGGLRWDRFDLETIDLINGVEGDRVDEEFSPRAGVIVKPTPDLSIYASYAQSFLPQAGDQFLVLSPDSAQFEPEKFTNYEIGAKWAPLSNVLVSAALFRLERTNIRATDPADPTLSVLAGESRAEGFEIGAVGEVTDFWKANLGYTYLDGELLNDNAFGDAGQRLQQLPRHSISAWNRFDVTDTIGFGLGVIHQSEQFASFSNDVVLPAYWRVDAAAFYTVSDRLSLQVNIENLFDETYYPSAHGDNNIQPADPFSARFGVRFEL

SEQ ID NO: 14440 - protein, 875 aa, Ralstonia eutropha
MRMKSGPSYTARISRLLLLAGTAISFPAMAQQAQSDAAESDPNIIIVTAQKRSENLQNVPISIQALGTQKLEQLGVANFTDYAQQLPSVTFQALGGTPGTNVVYMRGVASGGDGNHSGSLPSVGVYLDEQPVTTIGGNLDVHVYDIARIESLSGPQGTLYGASSEAGTIRIITNKPDTTGFYGSVDAEVNTVNKGGEGYKFEGMINAPISAMAALRVVGYYQRDAGFIDNVPGTRTFLGTPVLDENDQYAGNLPDGISVNNNAFVKKDYNYTDTYGGRAALKVDLDDNWTVTPQVMYQKTKSRGSYGFDPSVGDLQVQHFFPEFRNDKFVQAALTIEGKIGNWDLTYSGAYLDRRTFQSSDYTDYAEAYDALYANYTYEGTFYCSGLAGCFAYQDANGNTIDPRQKVIGTDHFKKLSQELRIASPADQPLRVVAGLFYQRQSNDIHQDYQIANLAPNLSVNGHPGTLWLTEQKRVDKDYAAFGEVSFDVAPTVTLTAGGRYFKYDNSLIGFFGFGRNPGDTGQYDGDPPNAAYSNRTGVAQCFTTAGERLYDRSTDTYSSSRTLLPAAVPGGPCTNLAVYQDGTLKPVRTKDDGFTYRFNATWKPNSDVMLYATWSRGFRPGGINRRADVEPYKADFLTNYEVGFKSTLAGGMVRLNGAVYQQNWKDFQFAFLGANSFTEIHNGPNARIRGVDMDASIGRGPLTVNVSAAYTDTKTLKNLCLFDDPSFTCTADGPTGETNLISAPKGTRLPITPKFKASGTLRYTVPMGDAKAHFQLNGMYQSSASSDIRTAIYETFSGDVINPSAQLGRLKAFGTVNAAVGADWDSYSIELFVSNIFDERGQLSRFQQCGSCGQRPYIVPTTPRMFGLRAGAKF

SEQ ID NO: 14441 - protein, 803 aa, Ralstonia eutropha
MTKSDHRCAVRKSGVGYFGGASLVALASCFLLPSVAAAQAESAEPQEEIATQDIVVTAQRREERLSKVPVSVVAFGAEALQNRNITSEQDIGTLVPGLQVKNGQNSNQLSYSMRGQSLDPFSGTSPAVLPYLNEAPYNPGNTATAFFDLGSIQVLKGPQGTLFGRNATGGAVLYTTPMPGDTFGGYVTVRGASRDYGQMQAAVDLPIAEGKAALRLAFDATRGNGYVTNINTGNTLGDKNSRSGRVTLLLTPTDTLRNVTIVQYDRVKGTEGVGGIYTYYSATDPQFVSDGTNHVPVSGLTNTLAAIYGTNDGPAAPGFWPGAVEGYTKFTRANPYKVWLQYDLPHSAENVFVSNTTELEIGADTKLKNIFSYMNGKSNTPGNLGGGPFGSLWLFKLAGINATGAPGGQTFESNTFSEELQIQGSLMEDRLNYTAGVFYSNQKRFEIVPINIGADVVPGGIADISYAYRNRQESKAIFAQVSYKVTEQLTATLGGRYTWENVGIRQAPGNVFGVDPDSPAADQSRKLSAPAWTASLQYQIDPNNMVYFNQRGSFRSGNLNGTVAPFTDPLTGQPANFFKNEKVHDFELGYKFNGRIGGAPVQFNVAAYKVIVKDAQRALYALVGGAPAGFTVNVPQAETQGFEVDAFAGLTSWLDVGFNLAYTDAKYTKRSVPIPFVGNLLVDSYPDAPKWAGSANIEIKFPLPEEIGKISLRGDYYGQTGFFFSNTNGTSTPGTHLDGYWNVGARLNWKEIMGSQVSAAVFVRNLTNESYYISGYALGASNGVNTAYPGEPRTIGAEISVKF

SEQ ID NO: 14442 - protein, 1011 aa, Ralstonia eutropha
MKSILSLILFGLLTSGLFSQTGTDVRVTGTVTDMSGMPLPGVNVIVKGTSTGTSTDFDGLFSLDVPSSSTLVFSFLGFQTQEIAVNGAADLNVQLVEDTSTLDEVVVVGYGTQKKKEITGAVSVVGSETIEEQNPVRVEQALQGRVAGVNISSNSGSPGSASTISIRGISTNGDNRPLILVDGAVIEDLSVINPNDIESINVLKDATAGIYGVRAANGVILITTKGGRKNSDLRVDVDTYVGLQETTRKLPVLNATEYGVIINEAYAAGNQVPPFPNLAVLGQGTNWQDEVFRQALLSDINATVYGGGEKSAYSIGAGYLDQDGIVGGGAVNFNRFTGRGSYDLDILDNLKFSSTAIYTHSNRKTLSENALGSVLFNAVNMAPTFSVRDANGDFTIANGLGNEVINPIAQIANTFNNNEVDKITGTVGFSYNFWDHFTAESRYQFNYSEVRGRSYLPSGLNFGDGKVFNNLGVNQYFVNDSFFRDYTFDNFLTYQNTFADDHNLTVLLGMSAFKTSGEFYNFTGRDVPGTTFAEATLDGAGEVIDARDISGPAEFDQRLLSYFTRVQYNYKERYLLSAVLRRDGSSNFGPENKFGYFPSASIGWVASDEPFFGSSDLLNFLKLRASYGILGNDRIGAFGYVSTLNAEGTYVFDNELVNGVAAGQLSNPEIKWERQKTFDVGFDARLFNNRIDLTMDYFKRRTDDLLLVPQVSGILGVYAPGAGAPIVNAGSVENQGLEFSVSYDQPIGDEAGFNLRYNFTTLQNEVLEVGNESGFIPGGSFGFGQEPPARMQAGFPIGYFYGLQTNGIFQSQAEVDTHATQTDATLGDLRYVDQNGDGVINGDDRVNIGDPIPDVTMGLNLGFNYKNFDFTAYAFASIGNDIVRSYDRNQNLTNKTNYVLDRWTGPGSTNSYPRVTVGPNSNLLFSDFYVEDGSYVRLQNVQLGYSLGNEVLDQLGIRKLRFYLAVTNAFTLTEYKGYDPSASSGAPIGGGIDQGFYPVPRTYTAGMNFKF

SEQ ID NO: 14443 - protein, 907 aa, Ralstonia eutropha
MKHSLVLVGLRAGVFALLGLIVAPDSARAGCSIGGTVQTCTGDVSAGVAVDPSAATLLVNSLTTSITPTSGTAGVSAGQFTSDISSTIDLGPFQIITSGAGGVRFISARNVDLTFKGAISTNGGAGIVAYSGGEPSFDVRVSSTGNISTRGAGAAGITAGTSCCGGVTLDSTGDISTNGNSSNGLVAQAGAFSSAVTSKGNVTTAGDSSAAIAAFSSGSLARISSQGNLATSGSSAPGITASGRDIAINSIGNIVTSGSGSDGILARSTSFGQLSSISSNGNITASGDGSYAIHAITSSIGNTTVTNLGGTISGGPGAGAGIYLQGGNANVLTNYGTVTSAAGTAGSAILGDTGNIVVNNSGTIIGSVNLGRGTNSFNNLAGAVFAPGAWIALGDGMTLTNSGLLAPGGSAAIQTTNLSGNLILNSGGTYLVKVSPTASDQIVASGTAALSGTVNAVFNPAAYVTKRYTILSAAGGLNDTRFSTLVETNLPANFHAALSYTTKDVYLDLILNYGLPGGLKGNQAAVGNTLINVFTGSGIPFVYAGLTANGLTQASGEVGTLPQHTTFDAMGQFIGLLTDPLIQSTAAPASWSGRAGFAGEREANQANRRADAFAMFTKAPPLPFVQHWNVWTAGFGGSQSSNGQASVGSSDTTSRIYGAAAGADYLFSPNTLAGFSLAGGGTNFSINGLGSGRSDLFQVGAYMRHTDGPAYVSAAAAYGWQDITTDRYVTITGVDHLRAAFNANAYSGRVEGGYRFVGPWSGGVGIAPYAAAQVTTIALPSYSEQVVSGAGSFALNYASRSPTDTRSELGFRTDKSFAVTNGVLSLRGRLAWAHDFNPDRATAATFQAVPGASFVVNGAAQARDSALTSAAVEMHWMAGWSAAATFEGEFSDTTRSYAGKAVVRYAW

SEQ ID NO: 14444 - protein, 475 aa, Ralstonia eutropha
MQTASTIARLTLLAVGVAGALAAADANAAAFQLKENSAKGLGRAFAGSTSTEGDASVIATNPASMRLLDGTLIQGDVSAISFGAKFRGQGQYGNGQPISGGNGGDAGMIAPVPAAYFHLPFGEKENMHFGASLTVPFGFKTEYDRDWVGRYNGVKTELQAVDLGVAFSYDVNPYLSFGASVFAERLNVDLTSAVDTGTAINATAQRTAAARVLAAGGTAAQAAAASQAAARQAAQLGFSPGTADGYLRIKGDEVSVGYTLGMTVTPVEGTNIAFSYRSKVEHKITDGKADFTIPQNAAAFLATAAPGTFIDSNGRATITLPASATVGFTHRVNDQWQIMAEVTRTAWSKFDQVTVDYDSNQPDSVLPFHYRDTTFASIGTDFRVNDKLTLRGGLAYDQTPTTDAHRDVRVPDTTRKWLSLGLTYAASDKMEYSVGYTHLFTKDPNVTSTSATANTVTGKYKVSGDVLAASMQYKF

SEQ ID NO: 14445 - protein, 762 aa, Ralstonia eutropha
DGGIEQDKNGGAGFGLGRLFLAPADAQNLSSAEVNNNAQEEVKTAPSKKKDKSDVIVVTATGLSQASSTTKTHTPIIESPQSISIVSRDEIELRASPTIADALAYTAGVQAEPSGIDSRVDEVSVRGFGAGGFSSNNNFVDGLRLPSGGQWTRTSFDPFSLQQIEVLKGPSGALYGQTAPGGVVNLVTKRPTKKSQGEFFLQGAGYTHLGNWQGQASGDVSEKLNKDGTLSGRIVGLARYGDTQVNHVQTGRYYVSPSLTWEISPDTKWTVLAQYQRDQGGSTFQFLPATGTLYASKGRHIANDANIGEPKWDNFNRNQVMAGSFFEHHFNHFLTLRNNTRYTYLNTLYRATVLSGDTLQSCSAAIAGCVAGETVNRRAVEGRGRSQGVATDTQLEGHVDTGAVRHVMLFGTDYFYTDWTHDRDLVKSSLVLPMLNIFDPVSRGSAGYGAALSPQVYTSTISQQNGIYFQDQIKFKRLRVTVGGRQDWAKDDTLNRLTGKRYLTHSNAFTWRAGAVYLFDNGLAPYFSYAKSFQPQVSDPSTSLDGTPFKPTTGDQYEAGIRYQYGKSIYITFGAYQITQRNMTTPDPNGALCGTSTCLVQTEEGPVRGLELEGRATLPWNMAIIFTGTRSDAKVTQSNTASQIGNYLPQAPKWMASLFIDQRIRHGFFTGLGIGGGVRYTGHSYGDTNNTLSIPGYTLFDSFLRYDFANRFPRYKGLSLSINMRNIANKRYVATCTAASACYYGQGRSLTLRLGYSWGGTA

SEQ ID NO: 14446 - protein, 618 aa, Ralstonia eutropha
MYFFRFPLLIVLLVFCIVGVSPFTAGASEDDQTLSLFSGGDQPLVSSGRTPRPTSRIAENVTVITAEQIALLNAHTLADVLNTVPGFQLEQVQTPGSFTFFSLQGATDAQAHVQVLIDGVPQNNLLQGAADVGLIPVQQIDRVEIIKGAASAAWGQALGGVINVITKAPESERVIGGTAAASMGERLTTDMRGELSGTVRRFGYYLSGGNLHSNGLLPGNRINNSNVYGKFTYDLPSKGSLMLGFDFRKADRGLDETLLYHDTTEAHRAYTFLTFTYPLTERLTLELAARASHRNDETLLGHFDQGLVVLDNNFTVRESRRGGSAKLVWGDSLTNLVAGVEYEHGETEQWDALVPNSPFLTDRTMDRWATSANGTFSYGALTILPGVRFDHTGLSSDALSYTLGATYRLTEKTVLRGYGARGYSLPNAIWNNGPQKVWTVQAGAETEAVPYLWLKGTFFYNDTWNVEVGDFNLSSPGVTLREQIKQGFELEARTIPLYGFSLAGGYTFTDARDGETKERLKSVPEHGAKLALNYDNISLGLRGVMTGNYVQWNAPIGNNAKDSAVIWDLHLTKMLFPAWELSPELFFSVHNLFNGSQYQSDSFKNAPRWLEGGVRWRF

SEQ ID NO: 14447 - protein, 331 aa, Ralstonia eutropha
MSKMNYILPLALLVSGAATAATEATENPWYTGARLGGAHYSDFAENIWTPDNQDQNDLAGGIFLGYNYKPWLAVETGYTYLGEAQFGNNRSVEQQGIDLVGKFTWQATDSLDVFAKAGGFYYFADGKGEFNTSHDRGLIPTTGAGVEYFFNKNVSARLEYQYYHDIDLKDSGVDTSWNTHFYGVSLVYSWGAPAPITMTAMEPAVAEPQKTIDIEPLIIEIPFAFDSVKLAPKYIDQLKPIAQQLIKYPEAELIVIGHTDSTGPESYNQQLSERRAALVADYLATHFAIAKNRIKESGRGELAPKASNATKDGRALNRRVSVFTPGLTVVK

SEQ ID NO: 14448 - protein, 813 aa, Ralstonia eutropha
MPANPFPAPLSQANRHAAAHRGRRCSRATTIIAMAAAVLAQRPAVAQQDTVAPKQDSAVLPEVLVVATAPLPGIGVDSDLVPYTVQTVRGEQLDGTRASNLTDYLARNLAGVNVNDIQGSPFQSDITYRGYRASSMPGMPQGLSVYLDGVRVNEPFGDVISWDMIPEAALSSVSLVSSANPAYGLNSLGGALAMTTRSGLDSPGFTADLSYGSGNRKRADLSGGVRSDSGWHAFAAGTLFQEHGWRDNSSGRLGNVFAKAGYAGETNSVDVSLLHGSSTLTGNGLVPAFHASGNGTEADLYQTNRRAVYTYPDQTRNQVTQVAVNSRHWFDDKTSAAALAYVRTSRRDTANGDVNPDYETYIEACEDGFNADGSPRGDGCGVTRAEGAALRPAIINTTHMRQQTVGVALSLAKETEHHVLNAGTTLDRSRLTYSQYAQPGTFTDDRGAVADPDAPNALVSGVSGNARTFGVYLSDTWSVTPSTFLTASARWNLATVSNTLQNSDGTEQPRESFTYRHLNPALGLVQKLGAGVTVFGGYAQNNRVPTVLELGCADPAQPCRLPAGLQADPYLKQVVSHAFETGVRWRRGKDTEVTATLYRIDNHDDILFLRAPNTQFGYFANFDRTRNQGLDLTAHHRVGDVTLRLGYSYLQATYQANGQLAAGERTIDVHPGMRMAGVPRHTFKFGIDWQALAGLTLGADVVAVSSSVASGNEDGLRSDPQPGQPPKTADWHVPGYATVNLRAAYQVSKRFEVYARVANLFDRRYETYGQLANNVFPGGNLVQPHVAPGDSATSLFVAPGAPRSVWLGVVYKM

SEQ ID NO: 14449 - protein, 675 aa, Ralstonia eutropha
MVMFPRPYQSALLCVALSLPLTVAAETQRLEPLTVTAPRLERPWLDTPAALGVVEREDLEQARQGLQLDESLVRIPGVTAQNRYNFAQDLRVSMRGFGARSAFGIRGVKLLVDGIPETTTDGQSQVDAIDLTALERIEVIRGPSSVLHGNATGGVLDITTRSGPPETFLQPRLEAGSFGYRRIGVQAGGQAEDLAWHVSGWDFAMDGYRDHSVAEKRLLHSRLDWDLAAGHRLTALATFLDAPRTDDPGALTAAEVAADRRAANPNAIAYNAGQSVTQERLGLVYRGDLSEGESLQARVFHTWRNFDNRLPFESGGMVGYDRAFYGAGVQYTRANRLGDLPGRVTLGLDLERQQDDRRRHDNLLGVRGDLVLEQRETAEAAGVFLQQEIDLTERLQSTLGLRRDWVRFAVDDRFLSDGDDSGSRTFQETSHSLGLSYAWHPQHRIYGTYGTAFETPTFTEYANPAGGGFNPAIAPQQARNLELGFKGFAGAVQYDLAVFRVDVRDELVPYELDRIYYENAGRTRRQGLEAGLSWFASTEWTFTGAWTWSDFTFREFEDDGVDLAGRELPAIPRQQLFLEAAWRPGRDYYILDMLALDRQYADNANTERVSDTAIFNARAGRVFRQDGWDVETFIAVNNLFDQDYFANIRPNAALGRYYEPAPGRNFFVGLHVTRR

SEQ ID NO: 14450 - protein, 652 aa, Ralstonia eutropha
MLLALIVLGGMCAFAEESPVLELKQTVVTSDSFGTPVRETAKNMTVINAKEIKEKGAKTIADALRGVPGVVVRQMDGASPMVDLRGSGATAQFNTVILLDGIPVSGLAGFNLNTVPVDEIEKIEVLQGAGAVMYGDGAIGGVVNIITKAPTNKAVYGGAGLEVGSWRTIRENVYLGGKIGDKFLLNASYSGNSSKDYRDRSPQYENKKDKRDSLWLRGKYLLDNGSIAINYNHSEDKDYYTGSLSKKQFDDNPKQIGSWSGYTYGINDIINAKYNQKINDKIDILLTGGYYHNKDKFQKNSTSEYFLRPEVKLTYAKDSYVTLGLDYRDGKRKFKDDVLINGVTQKAPNDKRESFAGYIMNKSTFGNWQFTQGYRREKVKYEYSSKVYDPMTWQLKEIKPKSADYSNNDSFEFGVNYLYSDTGNVFFNYARALRTPTIQDAGAWYGPVKTQKNDIFEIGLRDAYKNTSISTSVFYINSKNEIYYDKTNSLNEKNKNFDGKVRRIGAQLSLAHYFDKLILRERVSYIVPKVTSGIYDGKEFAGVSRWTANVGATYNIIKGLTANVDGYYQSNAYAEDDFDNYFSKGNNYVTVDASLSYAFENGIELYTGVSNLFDKKYANAVTSTRSTFGAGSRKVYYPANGRSVYAGIKYTF

SEQ ID NO: 14451 - protein, 420 aa, Ralstonia eutropha
MKLARFLAAALVLTCSAIPVMSHAEIKTGVLTLSPMIGGITMEGDQPVDSEGLAYSLGLGYNFTQQLGLEAVVGGANLEEEGSGDDVDFWNYRLDGLYRFMPENKLVPYLAAGVGGYSLDGDDEFMTNYGAGLLYFLGENVALRADVRHMIGFNESNLENNIIYTAGFQFQFAGTEQPVKKEPVDSDGDGVTDDLDQCPDTPKGAPVDAKGCPLDTDGDGVFDYLDQCPDTPKGAPVDAKGCPLDTDGDGVFDYLDQCPDTPKGAPVDAKGCPLDTDGDGVFDYLDQCPDTPKGMNVDEKGCDLKLTLRINFDFDQAVIKPEFKGELDKAAAFVRANANVPFILLAGHTDSKGRDTYNQRLSEKRAEAVRQALIDNYGLDAAKLKSRGYGEAQPVATNDTEEGRYLNRRVELICCVVLPE

SEQ ID NO: 14452 - protein, 936 aa, Ralstonia eutropha
MLRSAWRGALAASTATAALLAVAPAAQAQDGEVAEVVVTGSRIARQDLVSSSPVATVSQEEIAVVGANNVEEYLNSLPQLIAGATKSTNVAGSADATATLNLRGLGAKRTLVLVNGRRFVPTTQEGIVDVNNIPASLVERVEVVTGGASAVYGSDAMAGVVNFILKDRFQGLEMDAQYGVSDEGDADAWNASATMGAAGEKASAWLHVSLEQRKKLRGTERPISVVSYIDANGNFVPSGSAGRLGGTLVGIPTPNGSGGFVNRDYALDNMIPRPFVNSDFNFDARGDYAIQIPLDRVNVYGRGEYEFTPDISGFVEVTYNNLDSRAILSPTAPNIRQTTNVPGLPANASFITPEIRALLNARPDPNAPFSLRFLAPEPFPKREIAFNRDIYRLLGGFEGRLSDSWQWGVSYSYSHVATTEVQKGDISRRTFVEASTPSAADPTKCANGNPRCVLVTNLTNWSPELVDYLLVDNISSTEITDQVASAYATGDLFTLPAGEVKAAIGAEWRKISSVDNPAPVLLDFASAGFGERNRTAGSYSVKELFGEAIVPLIADAPMMDYVGLELAARYSDYSLAGEVWTYKAGGEWRVNPDIRFRALYQRAVRAPNITELFGGLVNTYPFIVDPCSASANPSGQVAALCVAQGVPASALGSYQQNGAALEARLVSNPNLDPEKSDTLTLGMVYTPSQIPGLSLTLDYYDIEISDAIERLGGGAQGVLAGCFASGDANNPFCRTFSRSPTTYEIVDFGVPLANVASLKTSGVDMAASYRWSMDSLGIGDDDADLRATLMGTWVDKNVFRANDTAAPTDRVGTVGGDTPAIPEWRANATLNYASAGLELTWNVEYLSSVKDRKYANNLAAGVANPKAGIANPKVGAYWYHNVRAAYDLDRFTVYGGVRNLFDKDPPMLSSPIESNTDPNTYDMIGRYLFVGVSAKF

SEQ ID NO: 14453 - protein, 630 aa, Ralstonia eutropha
MKKTKKTILLSLTLVASLLHAEDNGVFLSVGYQIGEAVQKVKNANKVQKLSDAYENLNKLLANHGHSNQEINANSATAINQAIGNLNANTQNLIDKTDNSPAYQATLLALQSTVGLWNSIAYAVICGGYTDKPNHNTTETFYNQPGQGSDSITCGSNGLGTLPAGKNSHLSIEQFATLNKAYQIIQAALKKGLPALSNTTTTVEVTIKTATNAKNINVNNDNNNAADATISITDTYINDAQNLLTQAQTIINTLQDNCPMLKGKSSDGTNGANTPSWQTNANQNSCSVFGTEFSAISDMISNAQNIVQETQQLNTTPLKSIAQPHNFNLNSPNSIALAQSMLKNAQSQEAVLKLANQVGSDFNRISTGVLKNYIEECGANNSSESVSNNTWGKGCAGVKETLASLESSNASFSSQTPQINQAQTLANTIVQELGHNPFKRVGIISSQTNNGAMNGLGVQVGYKQFFGEKKRWGLRYYGFFDYNHAYIKSNFFNSASDVWTYGVGSDLLFNFINDKNTNFLGKNNQISFGLFGGIALAGTSWLNSQFVNLKTISNVYSAKVNTANFQFLFNLGLRTNLARPKKKDSHHGAQHGMELGVKIPTINTNYYSFLDTKLEYRRLYSVYLNYVFAY

SEQ ID NO: 14454 - protein, 976 aa, Ralstonia eutropha
MLAQQQSRLISGIVKDESGEPMIGASVLDVSTKQGTIADIDGKFTLEVTSSSKLQISFVGYKDQIISGKDLKKDMIIVLKSNTEMIDELVVVGYGTQKKVNLTGAVASVSTSDIQGKPVTNIVEALQGTTSGLVIQQSNSAPGARPSINIRGLNTMNNNDPMVLIDGIIGDIQNVNPSDIENISVLKDASSTAIYGSRASNGVILITTKKGSAQKNEVTYEMQYGWQSPTCLPKVVDSWVYAEMRNEALVNSGQPAAFTPEQIAYYRNGGPNCKWIEELYKKNSPQQSHNLSFSGGNDKTTFLVSLGYMDQNSMFKGPDYGQQRYNGRLNLSHKVSERFNFSTTVAYARNEVKDHAYWTEWIIEQATRMPSIYPIKDENGAYTYPSGSNSNALARLEQGGYRQNSNDDVSATLNAELKIWDGLKLKGMIGGQLYNNRTHENRKAIEAPASGDTENRMTEQFARSLNLTTNVMLTYDKSFGKHTVGAMVGYSYEGGSDKGYDTYRVTETSDFDIMVGTQTSNVGNSGSGSDWSIYSEFARLNYNYDEKYLFEANLRNDASSKFAKGNRSALFPSFSLGWRVSEERFFEKLKEHVSSLKLRTSWGLVGNNRIDNYQYLSSVTVSPKYNFGNTIVNGASFAAVNTDIKWETTAMFDLGIDVGFLNNSLNITADFFNNVTRDILIGLPVPGMFGGGSPVQNAGKVRNRGWELNMNYRFKTGQVEHFVSGNVSDAANEVIDTRGVEWINGADVNTIIKEGYPINSYYAYRVNGIFQNDEEVAQGPWLDGITPKPGDLRYVDKNNDGLVKESDDRFILGDNFPHYTYGFSYGFTWKGFDFSMFWQGVGRRNVWLRGESVEAFHNNNEGPVFDFHLDRWTPNNPDASYPRLTVGAESANNAAKSNFWIQDGSYLRLKNAQIGYTFPQKWMRKVYVKNLRIYLSGQNLFTLSHIKGGWDPETTDGGGRIYPVSRVISMGLNIKF

SEQ ID NO: 14455 - protein, 758 aa, Ralstonia eutropha
MSHRQLGLTVSRLAICAGLMGSFFAAEARAQTEPGAVAHGADQQPAAIGLEEIVVTATRRETSLQKTGQAISVVSGAEQLLTGRQVLDDLKTSMPNVNFASTSNTTQMFVRGIGNTFLTAGGDPGVALYQDTAYISDQTTSSVSFFDVERVEVLRGPQGGLYGRNATGGAINIISAKPTSEMTGRLSVLAGDYGRLESEGFVSGPLGFANTDFRLSYQLHRLDGFVRNIYEPTVGAAGFAAAPDRLDDMNSDAVRLQTATQLGSGGVLRVIVTHYRETDNGAALAVVPDSGFIYPAQHLYGLVPTSDPRNITVDEGYNKIRLTNYNANLDQPIADGMLTVTGNYRRSHRDFLNDCDGTSANSCSFRVETSSDDYFGDIHYASSNEGPFRYIVGATYTHFIQDQIATIPFEFPTFYLTGNPADRAAFDFPTASGGRLRTNAWAAYADARYALSDVWSLIGQVRYSRARKKALETLKLPAFGLVVVDSPNRASDSGVPFKVGVEGQLTNDVLVYGNFSTGLKDAAINLGTLQTAPVAKETVQSVEVGFKSSLFDRRLRINGAAFNSDYKNLQISQLKGTLATLANAPKAQISGAELEVTAEPVSGLRFNGSVGYLDPKLKRFENTPNLPADFVPQPVLVSLDGNQLPYVAKWNVTLGATYRFEPTAGIAVELGGNYYYQSRIYFNEFNALRNSQKPVGRVDLSASIGPSNDQWKVYGYIRNLTDETVLAGTTIYAGLLGAEKGVSYAPPRNFGIGFSYNF

SEQ ID NO: 14456 - protein, 697 aa, Ralstonia eutropha
MNQSPLYIAILAALSASTLSSVTYAETDKLKKIIVAAPAEEAAPQEDDHTRAELLKNGNSETGDVLRQINGVSAARKGGHGLDPQIRGQQYSQLNILLDGAKIEGGCPNRMDPPTSYSEISSYDDVVVIRGVNSVLNGPGGSGGTILFNRQKPTYNPEKTVSGEVSVGKSNILNYETNAEVQAVGKTGYVVVQGSRKEANNYTDGNGDIVKSSYNTNQGHIDLGWTPSENHHLKLSAEKSRTEDALYPGAAMDAPETEGTMLRLKYEGRQLSETIADVDVDLYHSTVDHVMNNFDLRTPPSPMMKRETPTSTESNGAKFKLTSHVGKTQFDYGLQLESINKDATLWNRSVTPNTSLNYMWPDVTNTTKSLFAETNTLLSQQSNLIFGLRYDQVHAKADDINTAPTGAPGNMPSLVYAKTYSDYNGESAANEDNLSGLLRFENTFASNYKWYLGASHTKRTADATERFMSKWGMMGGIQTSWVGNPNIKPEQHNQIDLGIGQKTAQLNWNVSVWYDKVNDYILRDLATNQYDNGVKMTAKDQTEVYVNVDAELYGADLEADYRVTSAFTAGGQFSLTKGRNTTDNRNIAMISAPTGSLHAIYRPSNWHLGGRFNFALEQTDIDKAYTPEANHGETPAWSTLDIYGGYQLSKTWQINAGIDNLMDHAYYDHLSYDPVDPTVYKNNEPGRNYWAKVTAKF

SEQ ID NO: 14457 - protein, 213 aa, Ralstonia eutropha
MKTLSLRTATCSAIAACAMLGAFATPAAAADDAQGNWMVRLRGTYLDMAHSSDPVGGVGRSDRITVNNKWIPELDVTYFFTPNFAAELVLTVPQKQNVYLDGNKIGTFKHLPPTLLMQYHLIPNGTFRPYIGAGLNFTHIWGENIANNALQLDSWSVGPALQIGMDYKLTKNWFLNADIKKIWLSSDVKAGDVKVSKVSLDPWLFSMGVGYRF

SEQ ID NO: 14458 - protein, 889 aa, Ralstonia eutropha
MKTIRKSVLAASASAMVVMIAAPAMAQSGGNEVEQVVITGIRASLLQSIESKRKADAIVDVVTAEDVGKFPSTNVAEALTIVPGVTVDRAFGQGEKVSILGTDPALNRTLLNGQTVASADWFILDSPGRTFNYALLAPQIVGKVDVYKSPEARIDEGSIGGTVIVNTRKPLDLKSGTIAGAVSYLYTDRSKKGDLQGSLLASWKNADSTFGASFSIQRAEDQLRRDGVETYGTIAANQWAGGNPDNPVDSRTKGCVGSCASTLTANLGARSPNAFGASYFEQGRTRTTYTTALQYKPNDQLSLEFNWLKIDADYDNTNQSMYAFQGNTWNSLGALTGLTVNNGVVSKASFNNALSVLDVQHREAGLKSDTFHLKGGYKGDGWDLNGEVGKSTADGGTKRQVFLEFLNWASYTVDISGAPKSPGSLTYTTNVLGNPSAFATDPGWSGNLVSKPTSDEEKYAQFDFGKDFDGVIQRVQVGYKRREHQTGQQYAGIAITGVAAPASSFNPSTVPSNYLKGFDGVGTQMQNRFRIDGNAMVSYVESGKWLAAGATMPKPSIFAAAEFTAGNWNIQEDIDALYAQANFKADNVRGNFGVRYVKTSVDSAGYVCKPGAACNKAADWSWKSTKKSYDNVLPSVNIIVDAREDLVLRFAAAQVIARPNYSDMTNYFWLSDGILTGGGGNPALEPYKSSNFNASAEWYFQPQAILSAEVFYKDISNYILQRTQPESYFNQSQGKVTTYQISRPFNAGSAEVKGLAMAYQQTFGGGFGLLANYTYADASGQSGAPLPYSSKNQVNLSPFYENGPFSARATFTWRSKYFTGVDRGDDMFVKAAKTLDATVGYAVTKNITMSLSGQNLLDSEYYAYANTTALPRGVYRTGRKLQATLNVAF

SEQ ID NO: 14459 - protein, 808 aa, Ralstonia eutropha
MKSTVVPAVTPVQAHRFIARRLELIVRAVFAGILLSPAAQVPAAQAQQSSAAVRSYSIPAGPLTVVLTRFVGESGIFLAGTAELAQGKASPGLQGAYSVGSGLQALLAGTGLEAVASPNGEYVLRRLAAPSGADMVLPAVTVAAAAASQVTEGTGAYTVRSANTATRLDLSPRETPQSLSVVTRAVMDDFSLTSVNDMLATATGVNVELVEPDRTYFSVRGFEVSNFLVDGIGLPFATGDQLGDLDTAPYDRVEILRGANGLLAATGNPSGTINFVRKRPTDQLQASAALTLGSWSNRRIDGDVAGPLNESGSLRGRLIAAAQKKDSYLDRYSLEKNVFSVVLEADLAPDTLLTFGHAEQHNRPKGTMWGALPLYYTDGTPTDYSTSASVGTDWTYWNTDDIHTFVELRQNLADGWQAKGTVIRRELKSDGKLFYLSGVADRTTGAGLTSWPSEYDHTERQWGSDLHVSGPFTLGGRRHELVFGVNWAESKNRLHSRDDDTGLPLTEYEALAGHFPEPAFDAGLTGAAAFTNRRSSLYATARFNLTDDLKLITGASVTRATSSGMQYGVVHDYRETRTTPYLGVVYDLDDRHSVYASYAGIFSPQHQIEQSGSVMSPIEGRNVEIGAKGEWFDQRLNGSVALFRTKQDNTAEYAGFANGRSYYSGVDATTTGFELDLSGRVTSIWDISAGYTQFRLEDEDGHDVRTYVPRRTLRLTSTVRIPFVPGLKLGANLKWQDDIHRDQGGGIVTKQKSYALLDLMASYEIDKHFNLIAKVGNVTDEKYLNSLLWAQSYYGAPLNGSVTLQWKY

SEQ ID NO: 14460 - protein, 865 aa, Ralstonia eutropha
MRRPPIVLLSLLGLAVVAAGAAPALARGQPQETGVLTRAPEVIQPVEPEYPEAARAAGLTGVVMLEVEISETGEVTDAVVTGPAGQGFDEAALAAARKLRFSPAEIDGAPAPVRIEYRFTFSLSAPPAAPAPPPVNLLGRVLERGTRLPVAGAMVEAGGQLTHTDGDGRFALAGVADGAVQVVVTDVDHVRLDSTETIEPGNATQVTYWLQKTAAQGEYEAVVVGEREEKQVSHVAIAAGEIRRVAGASGDAVKVIQNLPGMARSFLSGELIVRGGNPRDTRVYVDGEEVPQVFHFGGLTSVYSSELLKDVEFEAGNFGVRSGRAIGGRVNLVTRDPGERAHALADVNLYHATALYEGRPSEDLGIAIAARRSYADAVVTRAVESMDDPPGVSTAPRYYDLQAKAAWKATADDTVRLDVFGSDDRMVLTGVEDDQSLEDMDFLEFGTRFYRAGLRWDHRAGEATRLRLALGGGWQDVDVDADERFRMRQELWSTHLRAEVHHELAPRVKLVTGVDGQWYPKVRIEVDAPPIPPPGQILNPNAETRRLAMTMDGVEAGAFVEATLEPVDGLFVVPGVRADVHRALADLSWVDPRLAVRWQLRPETALKGAAGLYHQAPPLPYVTEEFGNPDLHEEGAWQYSLGAEQRLLPRLLLDVQLYYKRLFDLALPSDGVITRDGQLVAERYRSAGTGRSYGAELLLRWDPDGRFFGWVSYSLSRAERGEPAAAGSRLESEGDAYDQPHNVVAVGTLELPELWHGLSAGFRARFTSGSPYEPIRGAVYDADADRYEPIQTGELSGRMPPFFQLDLRVDKKWTSRTWTFAAYLEVQNVTNRENPEAVAYSFDYSQRGWYSGLPLFPSFGLRAEY

SEQ ID NO: 14461 - protein, 341 aa, Ralstonia eutropha
MKKSLLAIALMSTFSYANAADVDNTWYIGAGAGQSNYESVDAVSHLGDDSDLAWNAVVGYQLNKYFAVEAGWQDLGTNDDTHLWGGLDGAQSIDVDGFTLGLVGTLPLSEKWFLTGEAGAYQYHLAHQMSADKYVSATDTAPYFGAGVGYKITDSLEVSAKYRRFANIDESAWNTANMDAQTVGIQMVYRFGVKPTPTTAAVVLPAVIKETKPAPRPEPVYETKIEQSSVAVLFGFDSSSLSSTAKAKLDEVIRLSKQSDNDTILLNGQSDNQGDSEYNQKLSEARVQQVADYLNANGVEVQTLEQQATGEQNAHANSRTDRALERRVIITLTSETQVVVS

SEQ ID NO: 14462 - protein, 197 aa, Ralstonia eutropha
MLTVWPIAYMSGKLGLTWMDDVEFTSNWIDSTEGFDLGTDAGVTLSCAVGYDFGDYRAELELGYQSNDVDTWADSDDGYVSDAEEAGGEVFVISVMAKGAYDIDLGGVELSPFVGAGFAFISFDDAPVCFSGSEYRSKSATTFAYQIGASLALPVADTILLEGRYRYLGTANFNFDRPEAEADFASHSALVGLRFSL

SEQ ID NO: 14463 - protein, 697 aa, Ralstonia eutropha
MPAIAEEDKPSNDLSENNDVERVVVFGNQFNHYKADEAFGAMRSDINLIDTPQSVAVIPSFITDEQLANNLGDILENDSSVTAGGQKWGFQYFKIRGFDLSSSSGYLVNGHQHFSYYLQPTEILEQVEVLKGPSSMLYGQSGPGGLINMVTKKPTYENMAKVGFDVNSNGSTRYSLDAGGSLNDDETIRYRTVLSKQDSVSARKYKQNGEHNEGDKSVGYLNLEFDVTDDLLLSLAYSKTNDKSGIDGGRLDDEGNLIGSRETIWDMPWAQTDKEVTNIGADITYQINTDWKVKLGYNEQQYDRNYVASRPNQCYKNNCYDDMADGYFIKPFDRYDDWNFQTGYVDLTGRIDTFGLEHQLLLGANILDYDYARTLYTYEDANGNNFIEVKPGDIIEKPDFYNNSTRSTSDSSYKHFGFYVQDLMTINDYWKVLAGVRYDEQHKEGYGNNSYAVSPKAGLIFNPTIDSSIYVNYSKSFMPQGSVNNKSDVNDGLNLKPQYGEQYELGAKWALFDESLLLTGAIFDIEVSNIKVTEEIVDDPNFDQITTQAGKQKHRGFELGAQGQVTDQLFLTGSMMYLDAKYERRAGDNIDGKRPADTPEWSANVWSRYEVNDQLALNLGAVYEGKRFADNQNTVSKDGYIRFDSGVSYGMSVAETDVELRLNIKNLFDTEYFGGGGKTSTTVADGREFTLGVNATF

SEQ ID NO: 14464 - protein, 703 aa, Ralstonia eutropha
MGIDTRRNALVLACIGAASGAAASDDAATVLEQVTVTATREEARLVETPASVGVVQGEDIALDKPAHPAQVMSQTPGVAVGVTNGEGHTTAIRQPFTTSPVYLFLEDGIPSRSTGFFNHNGLYEINIPQAGGIEVNRGPSSALYGSDAIGGVVNVLTRTPPTKTEADGSIEAGEHGWRRALVGGGSGYADGGWRADLNLTRTEGWRDDTGYDRNSGTLRWDHFIGDSTSLKTVLGFSDIDQETGANSPLVRDDYRHDPTKNYLPIAFRKVSALRLSTNYEHETADSLLSITPYVRDNSMDLLASFALRFDPTIAETGNRSYGLMAKWRRDFAPLRARMIVGVDFDLSPGERRENRIDPTTRGSGASREFIAYTVGPRIYDYDVEYRGVSPYVHGEISPTDRLRLTAGLRYDDMRYEFDNQLGAGEVVQVGSNFYGQVANTRVSYHRATPKLGATYALGENTHLFASYNQAFRAPSESQIFRPSRAGSLEAAHALTQSALELDAIKAEQYELGVRGVVAGLSYDLVAYELTKRDDIVSQRDPATTQTITTNAGETRHRGVELGLGAPLARQLRLDLALSYARHEFVDWVTAQADFGGKEQQSAPRLMSNARLTWTPNDAFRAQLEWTRIGSYWLDDSNTVKYGGHDLFNLRGNLALTPAVSLFGSVNNLTDRRYADSAQLSTGSTPAYSPGLPRTVIAGVEAKW

SEQ ID NO: 14465 - protein, 750 aa, Ralstonia eutropha
MAESESPIDIITEQSLQATGATDIATALGKLLPSLNFPRPAISDGNDAARPATLRGLSPDAVLVLVDGKRYHTSALINYNPYVGRGSAPADLNSLPMSAVARIEVLRDGASAQYGSDAIAGVVNIVLKHGAKTGDNSVSVNGGFMDKGDGEQNGIDGSVGMGFGGTGGDTTPGWVRLSWNYQNTMSTNRGENTNRATTVPGTPNPGGVPYQRHGDPKSTFYQGLAAFGYEFSPNLELYGHFSASRREVTSNGYYRAADNPARNVPSIYPNGFLPQIYNPVNDRSAVLGIKGSTESEWNWDLSASYGKNDMSFNILNSINTNLFYTTGASPTNFNSGGFETQQGTVNLDISRAFDWGLAYPVNVAFGAEHRQDRYRITAGSPDSYFFDPNTINPADGAPYPGGAQVFSGLEPSVAGKFGRHSNAVYANLEANLTEKLSGGIAGRYENYSDAGATRSGKLSARYAFTDTFSLRGTISNGFRAPSLAQQNYASVVTLIQNGELVQVGTYRTSDPVALALGARPLSPEKSSNYGLGGVWQPTANFTSSLDVYQIRIWDQILYSDQLQLAQPIGQVAAVQFFVNGATSRTRGVDWVNSYIADLGELGQLTLGASANYNKTTILELSNPNFGRASQGLLTDATPRTKYMASADWAIGGFTLNGNATRYGSIKRISDPVDGSQDQTYDARWILNLSASQTWNAFTFTVGADNLTNQYPTKAQLTTAYDDRAGGLQYSSLSPFGFNGRYWYGRVTYRF

SEQ ID NO: 14466 - protein, 598 aa, Ralstonia eutropha
MPPFKSSVGSLFGGLQLGYNRELPSRVVLGVETDLSFPNYLDFDDIIWSGVNANGRVTEKVDYYGSLRGRIGYAPARWLIYATAGLAYSQGRLTEDPFDPATQKKIGFRAGWVAGAGVEAPVDGNWTARIEYLYSNFGSLNVMLPSGTSYGSTFDLHTVRLGLNRKLGGSAKEPSGAGDTITSPIYWEMQGQSTYIQQGYPAFRSPYYSTNSFTPGAQSRETWSNSLFLGVKLWDGGEFYYNPELIQGYGLNATFGAAGFPNGEAQKSNFSYPHYITSRLYLRQTFGLGGEQETVQSDYGQMAGKRDVSRLTFQIGKFAVHDMFDNNTYAQDPRTQFLNWSIWAAGAFDYPGDMVGLTYGAAAELNQQAWAVRAGYFLVVVHPNTNDFDMELGKRGGYVGEFETRYEVLSRPGKLRVIGWMHDTLSGGYRDALNLAAATPGLDLTTAIDLTQQGRIKYGYVFNVEQAVTDDIGVFGRWSWNNGKNQISAFTDIDSSLSGGVSIKGTSWGRPEDTVGLAGAVNEISKDHRDFLAAGGMGILVGDGRLNYRPERILETYYTVKVAKDATFTFDYQFLQNPAYNADRGPVSVLSGRVHAQF

SEQ ID NO: 14467 - protein, 491 aa, Ralstonia eutropha
MKKQKTIGTASKMLLAWGLPALAGVSLTGVARADDAAPAPLTVAQAAPAAGASASVAQATTPNAVVNAEASQAVTPSDEQPSAQSKSKGFIADSHLDFLFRNYADVLDSKGGPHRHAWIQGVMANFESGYTTGLIGIGFDASLYAALKLDGGAGAGSMAHIAKGGGGSNQLAWAYPGIYDVKARISNTVIKYGLQAVDNPFMEQHDNRALPPTFLGATIVSNEFKNVMLEAGSFTKTDARGHTTLTNLTTQYGGTRVNRITYVGGTWDYSPNGEVALYANQADDVWHQYYASVKHSIGSPQTIKWTGFGNVYSTHDTGDALQGKINNNAYSLSLAAQHGPHELLLAYQQILGDQFFDYLNETNGIFLANSMDVDYNAPHEKSLQLRYTFYGKEAGLPGFKAMVWGVTGWGADGSAGAANDPSHSSIYWSNGAPVQGRHHEFGFIPSYTFQSGKLKDTKVTFIAMWHNGSAHYSDATNREYRLVVNLPLHAF

SEQ ID NO: 14468 - protein, 654 aa, Ralstonia eutropha
MKGIAMSLLAVGTVVAGGASPSEASVFELGEILVSAPGERGEAASDTVRGEEMRAHDAQTVSQAIDRVPGVTLSRGGARNEEMVSVRGFTLRQVPVLIDGIPVYVPYDGNVDLGRFTTFDLSKIEVAKDGGSVLTGPNALGGVINLVTRKPTKALEGELESGVRFGDGGYNGAYSAFSAGSRQDLGWVQGSGSWSKLEGFSLADGVSGRDENGGYRGNSAAEDVKLNLKAAITPRDDDEYALNLIYQHGEKGNPPYMGDDRSVTSRYWQWPKWDKRSLYWLSRTGLSESWSLKTRAYYDSFVNRLKAFDDKDYDTQARASSFTSYYDDYSVGGSSEVGGDLAEWSTLKLAAHFKQDVHREHNAGEPTRTDIDNTWSFGAEHTAHVTRDLDLITGLSYDWRDTQKAEDYQNKAITDFPLTSSDAVNWQIKGVYRYSDTGALHASMAYKSRFPTLKDRYSYRMGRGLPNASLEAERAATYELGVEQTLFGNTRIDASVFHSAISDAIESVALTRNVSQMQNVGDAIHQGLELGIQTTVLPRTELGVSYTLLNAQNEKSAIHVTDAPRHKGVIYGAYALTDALSVRPSVTLASERYSDTAGTKVDGYVISDLAVRYDVTEAISLEAGVNNILDTRYELSEGYPEEGRNYFLKGKVTF

SEQ ID NO: 14469 - protein, 146 aa, Ralstonia eutropha
NRHGIEKYGVDIDFDSGFHWGNPQGWFLNLDWEIALGQWRSTKGTNRQNLTEFGVTPLFRLEKRGGSWVPFIEAGIGPRLLSHTRTSDEHNFSTAFQFSDMIGVGVAFGSRQQFQVGYRFEHLSNASIKRPNPGTDLNELYLRYTF

SEQ ID NO: 14470 - protein, 848 aa, Ralstonia eutropha
MQKQQPYPIHLGIFLMLGLPTWAFSQANLEKSTINKLETILVNESEEKNKFDENLIKTYLSSGSYSYLSQSDISTFRGSSVGDFLSGVPGVIVGNKRNSGALSVNIRGIANENRVPVWIDKGLQSVPSYQGYAGSSTRTYLDPDLISQVEIEKGPSLQMDATGATGGVVRVETLRWQDIIPQGKNWGVRLKLGTMTNTVSPPPYYTRGGYQTKYISKCLSNHTGLCQTQTYAPNARYSSHGFDLNAYNYSLAFANKWQNADLVLAYAKRKQGNYFVGRHGQTPVIESIEFEEDSVEVKEPRVHEEVEIGSLTFKENRSTLYRPGEEALNTSQDNTSYLAKINVYNDVHRLGLAYRHYHSRFGEIMSSILNFRAYGALQGEGTEVKVDSYHANYSYNPTTPYVNLNVNAYFTDSDSSNFTPFIEEYGYSLSSRHAHFLVSKQKGLSIENTSIFQLNDKPFSLKYGLAHSYERIYQPRNAQARVRAKGYPEDAIGPLYIRDGKRKEWSAFVAANYPITSWLKADIGLRYLQSTIYDYIVRTERVNIGGAFVPNPNGPGNIWVEKYKDVVHKQAPVKNKGMSPIVMLTFEPINGVQIYTKYAEALRSPSLFQATKGWSMSATADNLEQLRPERAKNWEAGINLFYENLGGKDNILGFKLAYFNNRIKDYLTRSYSPKDKVTQTINIQSAQFKGIELSAYYDMGKFYAKLAGTYYTKTKFCLTAEQAGKGEQCNSGYIYRSNLNNAVPPRLNLHATLGTRLFEQKLDIGARYSYYSKRLVPVLSAERFVNTSSIEWAPYSLVDLYANYNVSNNLKLTMTMDNVFNRYYLDINNMGLNTAPGRTLHLGLEYRF

SEQ ID NO: 14471 - protein, 788 aa, Ralstonia eutropha
MDAFISEEVPIEENILPTSRPFNSVYGTERSILDTPRNVTIISREQLDAIAIKDVRDFSKLTSSSYTKTNFGSPSTPNLRGQEADLFVNGMRRGGSVNGNGLPVNFNAVESVNIVKGPAGVVYGTTNYLGGYADLITKKPFFDAERGSVGISFGSYDQYTWDFDYSKPVSDKLAYRVSYQGKEWDGYWEFWKMNSQAFYAAVTYRPNENYTLEAYAEYFQADYTENWGINRVTQDLVDKGEYLPNAQTDAEYLAYIAKLGNGDGFWAGTPGVDYASRFGGAGFSTIAVPDLANPVQVDRSWKLAAPGDDSFGRMFVAGADQSFTLENMEVLNKTFISWKDRNTFSSYHYSELLRDNISFENRTEFRFSNEFGDASKLDINTGLRFRYDDIWAVNHFFNEPVNFWDMTRDPDTRRILDQGFTGEDYPYIPDEEPHGTLDHWYYGNTGGDTKSHSFGPFAQADYTVNESFSVLAGFTTDFVNAKDVHPVLGSSGSADISGDGVAETGYEFEDSVQLDNYNVSLLFKPAEDVTTYLTYNVSDTYSADTGGRVDPTSFADTQESKLLELGAKFSLLDGKFFLGTAYVDREFTVRNITGTTDQVYLDLFEIEFNYQPNRNLFATLGFSYTDAERSAGFFASSYTIDRADETGGIYISPIFQSPSDLVAAPGVPEKLINGLFSYKWDNGFGVALGFLGWGDTYSGYSDFEITVPDLTGANGGEDYTLIANTAKLGFQYEADLTFSYKYEDWAYKLTIFNITDEENWDVNNSGYGNGSILARQPARMELSAKYSF

SEQ ID NO: 14472 - protein, 402 aa, Ralstonia eutropha
MKIGRRLAAAAATLGCMHAHAQTTGSVTLYGTVDTGIIYSTNQQFTRADGSTGGGHAWQMGGGNLVPSRFGFQGAEPLGGGLNAVFTLEQQFLSANGQALQGGTAFSRQAWVGLRQDGIGTLGLGRQYDSYTDMLGAYVSSNNWATPYGSHLGDVDNLNAAFNFNNAVKFTSADFNGLTFGGTFSFGGQAGDFSAKRGYAVAATYTRAPVAFSVGYLDLHQPLDAALGGASGYIGDFACSNPGAMYCLLQDAGSMRAFGAGGSVTFGDATIALTYTHTRLGDSRYFSTTAQPRTQAFTFDIGELNATYMFTPALQGGVAYIFNAAHTDGRGTTRFHQVNVGTNYSLSKRTALYAVAIGQIASGKGLGTDADGNAVNYAQIPVLANSNSSRQLAVMAGIRVNF

SEQ ID NO: 14473 - protein, 1571 aa, Ralstonia eutropha
MKNPKNAISTEIYSHGAVETAVPASAHRPAFHSTLHMLARSPSLAPIRRLRSGVSCAAVAAACIFPLPALGGSYFVSNETELRQAIADANADGDPDARITLTADVTLPTSISFPSLTKPVTIDTGEFVLRGDSGTVWGQQYTLYFPSGHLIIDGTVQAGNAPGGYSSGDGIAGVAVAMDKDGTIENNGTVIGGSGAIISGTGASGFYGGPGIFVWDDGVTVINNGEARGGKGEDIDVGGENDDTVDTRAGTGGAGLVFRKSSSSVNNGTLLGGEGGSIRNPGSNRQFGGNGGVGAAFLGGGVHVNNGTIQGGAGGRGINGAESGHGAGGTGVRLVGGSLTNSASGRIVGANGQAGGGAGDRGGSRGGTGLVLTNASFVNMGVVQAGDSGANAQAGTGIVASNATIINSGTISAGTNDVGTRGVAIEFTENTTNTLELRAGSNVAGLVSARGADMLVLGGEADATFDAGRIGGALNPAGQFQQFESFKKTGASTWTLTGTTPELTPWELDEGVLSVSSDGSLGAAGGTLTFNGGTLRVTGTEMAYTPRNLVWGEKGGSIDIAAAGHTFMLAQQLTGGGSLTKLGAGTLALTGAGQHTGGTTIASGTLQIGAGGASGSLSGDVVNNGTLAFNRSNNAIFAGIVSGSGGLRQIGSGSTSLTGANSYAGATSVEAGSLFVNGDQSAATGRTTVHSAATLGGTGILGGGATIADGGALDPGELGSAPGTLTVKGDLALAQGSILNYNFGQAGVVGGPLNDLVEISGDLVLDGTLNVATSSGGSFSPGVYRVINYGGTLTDNGLLLGTLPSAGVSLQLSVANQVNLINAGDMKLNFWDGSAGPKDDGAIDGGDGVWQNSAGNDNWTDAAGAVNAPFEDGAFATFMGTPGKVVVDESLGAVSAAGMQFATDGYRIEGDRLTLVGPTSTIRVGVGTAAGKGMTATIASELSGSPELVKEDAGILVLTGSNSYNGGTRITGGTLRIASDGNLGAAAGGVILDGGTLNTTADIATDRAFTLEGGGALSTDLGTRLTLGGSLTGAGNLFKTGAGTLLLAGDANYTGGTILEAGTLKAAAADMFSAGSAHTVLQAGTLHLSGFDQTVAWLDNAGDVVMGGAPGTTLSITGDYKGSGGTIRFNTALGEDASKTDRLVVGGATSGSTNLKVVNAGGRGAPTREGIKVVDVEGASEGTFSLVGDYLYKGEQAVVAGAYAYRLFKNGISTPTDGDWYLRSALAGDPTNPQYQPGVPLYEVYPQSLQSFNSLGTLRERVGNRSWADERGQASAGYGLSQSDALQSDDVDLSGNWARIEAAHGAFSPEITTAGADYTLSTWKIQGGADRLVHQDGNGKLVAGFSLHAGSISADITSVHGDGTINTIGYGFTGTLTWYGESGFYIDGQGRASWFNSDINSTTANRELGQDNTAFGYSVSIEGGKRMAIGDNWSLTPQVQLAYSSVDFNAFTDTFGSAVSLDRSDSLLGRLSLSADYENTWITGTGRKSRANVYGIASLYNEFLNGSTVAVSGEKFTSKNEPLWGGIGFGGSYNWADDSYAVYGEVLAKGSLENLGDNYSLNWTAGFRAIW

SEQ ID NO: 14474 - protein, 716 aa, Ralstonia eutropha
MSWNKKYLTTSILLALSMPAMAESNNNTADATTVVSATRSEQLLTDVAASVSVISADDIEENLVKNVGEIFDYTPGITVESDPRYGIQSINIRGMEGNRVKIVIDGVSQANRFDSGQSFIQSGRLDIDPDMIKSVEVVKGPASSLYGSDAIAGIVAFETKDPSDFLDAGDNSGGHLKLGYHSVDSSFSQSVALANRTGNLESLVAYTHRAGEEEQNFGEPDPQETEKNNILVKLQYQINENNRIEFTGEQVLSDIDSDLPLDSTWDENYDAEDQHERQRIGAKYILTADNALFDSVALQLDWKKSKQISQTMRGNTANKSELKDYLYGEEGYEGSAKFDKSFALAGMEHYLTYGLSYEYRDIENINVTYKTDSAGDTTNTLYYYMPAAEEIKWGAYLQDQIVLLDGDLVLTPSVRFDSFSTNPDNSVPTDKHNNVSGYIPTDYKDYSDSAVTGKFGALYSLTEDTKVFAQVSQGFRAPDFQELFYSYSSGTMPYKSEPNPDLKAETSISYETGLRGNFSAGNYEFALFYSDYDNFIDTVTRYDDPQYSWGITSYDNLEKATVKGAELGANLWLDSLIGAFDGTTLRLAAAYTEGEDQDGLALNSVAPWNMVVGLNYDSPSTNWGTSLKTVYTAKKGVSDINSTDTGNKDQIENPSSTVVDLTAYYKPMEDLTLRAGVYNLTDEQYWSWNDVRGLTTQDNDLSQAERNYGVTVKYDF

SEQ ID NO: 14475 - protein, 1176 aa, Ralstonia eutropha
MKVGLKSFGRFSLAVFVFLATMSLFAQKDAGTIAGVVRDPSGAVVAGAQVLVRDIDRGGESKLTTNANGEYVASPLRIGHYTVEVNHPGFRGVKAGPIELQVQQRAVLDLQLQVGDVTEKVEVVAAAPRLETETSELGQVVSQRQVSQLPLNGRNFAQLAQLSAGVAPSEPGSRDEGGYGFSSNGARSLQNNFLLDGVDNNSNLPDLLNETNFVIQPPIDALQEFKVQTSAYSAEFGRGNGAIINAVIKSGTNQFHGGAWEFFRNEALDARYYYDTDRQPYKQNQYGVMLGGPIIKDRTFFFADFEGLRLNQAQPQTALVPTQDMRNGDFSSFLDTSTQVYGTNAAGNLAPILDCNGMPTYSGEIFNTRLTQAYAGNPTGICGMPFGYSNGLPVNIMPGGVIDPLAQRLSALYPLPNSNNNAGFNYIADPVQTTHRANFDVRIDHKFSERNNIFGRFSYEDQPSFFPPTFSTGGDGGGFFSGIEDNAYKSVAISDIHTFSPTFINEFRLGYNRINSHRFQQNYNVDVSGAIGFPGVPFTPINGGLPQLTFSDVSTLGSPTFLPSVELQNTYVLDENVTWVKGRHTWKFGTEIRKEEFTINQPAESRGTLNFGNDFTSNPGAQDAQDLSGNALGSGSGYASFLLGATDGGGINNIHNVDYHRPIYSFFAQDDWKVNGRLTVNLGLRYELFTTVKSRHNEQGTFDLATATLILPKGQTAQLTPYLSTIIPVSATGSEGLIKPDLNNFAPRIGFAFLVDQNLVLRAGYGIFYGGQENGPYSNPSPGFNPPYFVTQSFNTPCGLASLNPNLAGSGQYCGIDGLEFLQNGFPASALTDPNTPILYSVDPALRTPYMQNWHIGFQQQIGANTVFELGYAGSRGLKLFTFLNGNQATPTADPNSPFADRRPIPQIDSSVQWFRSGGQSNYNSLQASLERHFANGFTYHINYTWGHSLDTASNANLGAQNGGDFRDMRFPNAEYGNSDFDVRHHAVFSALYDLPFGIGRKYATDISKPLDYVIGGWQVGGIASFSTGNWYTVTSNAGVSNADGGGNVGSSDRPDQIGNPNAAPCQPGTWFNTCAFTVATPGTFGDVGRNTIQGPGYEIVDFSLYKDFAVTERSHFEFRAEMFNSLNHYNPLFAKSGPQNGNNATVYDPSNPGLFGVITAARSPRQIQLALKFLF

SEQ ID NO: 14476 - protein, 390 aa, Ralstonia eutropha
MKRIALSTVSLALLSATGAVHAQSSVTLYGVIDEAFQFVHNANPDGKNLYQLAGGNLQGNRWGLKGTEDLGGGLKAIFQLENGFDINNGQLNQGGRMFGRQAYIGLAHEAYGTVTLGRQYDPLVDLVQPLTADNYFGSTFTTPGDVDNNDNSSRTNSAVKYTSPTWSGFQFEGMYAFGGVAGQTGSQQTWSGAATYATGPFSVAAGYIRMNNANSSVIRPNNSFTSTSDGTIDSIVNGAYATAKSIGIASVAVQFVTGPFTASARYSNAQYKPDGASTFASTERYNVAGGYLGYQVTPAALLGLGYTYTHGSGDTSASYNQVSLGGDYNLSKRTDLYLVGAWQRASGTQRNPRSSPPQQLQPAVASVADYGFTGDSRTQEIVSLGIRHKF

SEQ ID NO: 14477 - protein, 773 aa, Ralstonia eutropha
MPGRYARSNSLQEQSVMTTYRFRRRLPLVAAAVAMAFGAQGVHAESGSRLLDRITITGDPDRIQPVPGSAQALDREELERHSYTDPHRVLRAVPGVNVVEEEGHGQFPHISMRGTPPERNSRITVMEDGVLVAPAPYAAPAAYYFPPMGRMDRVEVQKGSSAIRHGPYTTGGAINMLSTPIPTETSGKADILFGTDNGRRIHSHVGGTRDIGEAGNQFGWLLEGFTNQSDGFKRLDNPASGPNQPDLDTGFDRRNLMTKLRWNTDPAAAVYQELEFKFARDDRTINDTYLGLTQEDFDANPFRRYVGSARDEINTENELFQLRHYITPTANTDLTTTIYRTDTVRNWYKLHEVDGQGDGDFVGITAILDDPDTYADELSWIKGDPNNAGARGALRANNREYFARGVDLKGGYWFDLGSWSHELEVGVRYHEDEEDRFQWHDIYAVSDQGDLFLDEREPFGSKTNRLTEADAIATYAQNTMRRGPWQIAAGLRHEDIEIRRRDWGTPQRDSASLSRDQSNTYRVWIPGLGATYDLDANWSVLAGVHRGFAPGGSSPDDKEERSTNYEAGFRYDSGVTRAEVIAFYNEYSNINIECTAVGGGCGAADIGDTVSAGEVDIYGLEALWMHDVGHSQQWGIGVPVSIGYTLTQSRFKQDIGGNAPNQWANARRGDSLPEVPEHMINASVGLAQEGWRLSLNANYVTSVKAKADPALSHQRIDSRLLLDLSGEYRVHRNARLFGAVENLTDKEYVAHYRPAGARPGKPREFWAGVKVDF

SEQ ID NO: 14478 - protein, 365 aa, Ralstonia eutropha
MKKSAIVLAAGSLLAGSAFAQSSVTLYGIVDQSIRFQTNANANNDNSWELTNGAVTNSRWGLKGSEALGNNLKAIFQLEGGFDPDTGRSNQASATNPNGRLFGRQAYVGLSGDFGTIKLGRQYTEGFNFFGDFDPLTIGNYTNNAWPFFLTNFRNDNVVSYGGKFGGLDVGASYGFGEQPGSMSQNQYWGTRAAYTFGPFGIGGVYQEVRNTTGEKQQMWGAAGKYSIGPAKIFLGYIGGKDRTGSVDASLNFTGGATLNPIPAGGNAAANPRKDTIGYIGVTYQATPALALTGVFYGDYVENVNGVNDNNGRRYTGVLLAEYSLSKRTQVYGTVDFNKVSGGTITEMPGRNNQTGAALGIRHIF

SEQ ID NO: 14479 - protein, 127 aa, Sphingomonas sp. KA1
MKGDWADSHRDEVDDFYRHQADIKYYSFLAGPAYRLNDYISFYGLVGISHTKAKGDYEWRNSVGADESDGYLSESVSKKSTDFAYAAGVIINPWGNMSVNVGYEGTKADIYGKHSVNGFTVGVGYRF

SEQ ID NO: 14480 - protein, 237 aa, Sphingomonas sp. KA1
MNAVLDEYWQAYLWTDGLQLTGLAMTLWLLILAVALGFLLAIPLAVARTCGNPLLRYPVWLYTYVFRGTPLYIQLLFFYTGVYSLNAIRAQDFLNAFFRDGFNCTVLAFVLNTCAYMTEIFAGAIRNTPHGEVEAARAYGMGGFTLYRRIVLPSALRRALPYFSNEVILMLHSTSVAFTATVPDLLKVARDVNSATYAPFLSFGIAGALYAGTAFLLIWLFRRGELRWLAYLRPQTH

SEQ ID NO: 14481 - protein, 479 aa, Uncultured bacterium
MEYMDMQHRINLSLISTAVLAALTSGTVFANDVDPNDIRNQSAAAVDLATEAKQAFYDGSTSRLHSFLYIRDREQKNMTTGEWSPNIENQTLQLAWDYKSGYFKDTIGLDIWANTNLQLGNTTGMSEILYFDHECQNNPAYDGKGCEKSYAALSVAALKAKFGNEDVGLALRGGYTQINIGTIRSSWGLNPHAYRGLEAKAHFGNLIVGYAIADQFKNDWRKEFLPMTTKWHQNQLKGADTTNTVIDHIQTLGAIYKFDQGQIDVGYGVGKDYRQNWQALGKYNFDLGSAKVGLSAFYHGSILEKSALTTNVVSNKEEAQSYLGLGANIKHGGFTWIAGVSSTDTGGQELSYNFRLTPWANSDNRNFQQTTSGLDDYNADGTKAVKLAVNYNFASWDLPELTAGIGGNYGTNVRSSLTEKEYDGSMHSFDWNIGYKFMDGALEGLNIRTFRSKFRGDDIVHKADRNDTKVLISYSVKLK

SEQ ID NO: 14482 - protein, 261 aa, Vibrio anguillarum
MKPMCKSLMLAASLLAGGQAVAGDLLQWQNNSLTYLYGKNFEVNPQIQQTVTFEHADAWKYGDNFFFLDRIFYNGKEDGNVGPDTYYGEFTPRLSFGKIFDQKLEFGPIKDVLLAFTYEFGEGDNESYLIGPGFDLAVPGFDYFQLNFYQRHTEGSRPGDNVWQITPVWSYTIPVGRSDILIDGYMDWVVDNDQNAKGTYHANLHFNPQIKYDLGKALNWGAKQLYVGFEYDYWKNKYGIEDSRNFETNQDTASLLVKYHF

SEQ ID NO: 14483 - protein, 629 aa, Pseudomonas putida
MRKAPLLRFTLASLALACSQALAGPSPYSTLIVFGDSLADAGQFPDLSGGTPGARFTNRDADGNFAPVSPMILGGRLGVAPGDLNPSTSIGIQPDGNNWAVGGYTTQQILDSITTTSETVIPPGNPNAGLVLRERPGYLANGLRADPNALYYLTGGGNDFLQGLVNSPADAVAAGARLAASAQALQQGGARYIMVWLLPDLGQTPNFSGTPQQNPLSLLSAAFNQSLISQLGQIDAQIIPLNIPVLLSEALSSPSQFGLASDQNLVGTCYSGDSCVENPVYGINGTTPNPTKLLFNDSVHPTIAGQQLIADYAYSILAAPWELTLLPEMAHASLRAHQDELRNQWQTPWQAVGQWQAFVASGAQDLDFDGQRSAASGDGRGYNLTVGGSYRLNDAWRLGLAGGAYRQKLEAGEQDSDYKLNSYMASAFAQYRQDRWWADAALTAGHLDYSDLKRTFALGVNDRSEKGDTDGEAWAMSGRLGYNLAADTSNWQLAPFISADYARVKVDGYEEKSGRSTALGFDDQERTSRRLGVGLLGSVQVQPNTRLFAEVAQEHEFEDDQQDVTMHLTSLPANDFTLTGYTPHSDLTRASLGVSHELVAGVHLRGNYNWRKSDELTQQGVSVGVSVDF

SEQ ID NO: 14484 - protein, 1145 aa, Campylobacter jejuni
MKNISIPKGMRGFILPLSFLGKLRLCTWQILFLLFFISLQAQAQQSDLLTLNMKNVTLKQFVEAVQTQSGYSFLYKDNQLKTNQRITVSVNKQSINVALEQAFKGKGISWKIQGKQILLFPAKEEQSVNTKKSRTIKGNVTTTTGESIPGASVKLANATTGVITDIDGFYMITVPDNQSELEFRFMGYEPRNIKVGNQTTINVSLEEATSSLEEVVVVAYGAQKKVTMTGSVASVNIGSLKTPVANLSNALQGKVAGIISVQSSGEPGYDNSTFTIRGIGTFTGNTSPLVIVDGVQRDDVNSTYGGAYNNIDPEDIVSISLLKDASATAVYGAKGANGVMIITTKRGSVGKPKISIKAETGFTNFTKVPEMLSGVDYMMLYNESRRNSGLSEVYSREQILKTESGLDPYLYPNVDWIDKIYKNVSSVSNVNLNISGGSDLVRYYLSASFYNQGGQYNVKKENGYDPNLNYKRYDFRSNVDVNITKTTLLQMNLSAIMTDSRYPGIASNKLWYEAFSTSPVAFPVRYPDGRWAGPPANAGSNPMNEVQNSGYTDTFRPALQSVFTVNQKLDFITKGLSAYARFSFDSYSEFNNKRTGGVDLWYTNQRDGNGELVFGKPIKEGSDELYYEHSDTGERVIYTEANISYDRTFGHHNVNGMVLYNMRNRMIATAGSAIASIPYRNQAIAARFGYGYKERYLAEVNGSYTGSENFAPGHRFGFFPAASVGWVISNEPFFKNMTRTVDLLKLRASYGIVGNDNIGGTGDRFAYFTQFGSGNSYGFGPNGNLVYGIRETLLGSDKLTWEKSYKTNIGLEMMLWGKLNLTLDYYWERRKDILIQRSSLPSMAGFDASIYANMGEMDNKGVDANLEYQTRIGNKVGLRLFGNLTYSKNKIVFRDEPAMQYAYQKSEGTRYGEFYGYIAEGYFQSEEEIKKSPRQMRELAPGDIKYKDLNDDGVIDANDQCYLGKSWFPSWSYGMGFNINYHNFDLALFFQGVSDVSIMANGGSIDTGNGDWGASGVGIVPFTGMGLNPSNVITKALDRWTADNPRADAWYPRMTANATTNDNNYVNSTHWLKDGSYLRLKQASLGYTLENKKLMDKGIEYLYFYLSGQNLLTFSKFKLWDPELGSNGAKYPLSRMVTLGMRVSF

SEQ ID NO: 14485 - protein, 695 aa, Campylobacter jejuni
MKKICLSVCAIGLLSSNAISQNVELDSSIVSASGFTQDIKEAPATINVITKKELQSKPYRDVAEAIADIPGVDLYASKGKTGSYNITMRGITGYTLVLIDGRRQGIGGEVGPNGFNEISNSFLPPISSIERIEVIKGPMSTLYGSEALGGVVNIITKKVSDKWETSVSLDALLNENKDWGNTYGTSIYSSGPLMNDKLGLTLRFREFYRQQSNVEFTNGSGQRVPGDQAQSPTKANNFNIGTRISYLANDYNTFIFDIDFSRNHYDNKKGQLGTITKPGDKGSLIGGYTDIMEVDKFVTYLSHEGVYENFSITSGLQYNRVSNNGREVVGQATQPFLGENRDIVAEDIILDTKSVIPLGQSHILSVGGEYRLEKMQDKIANPTNFDQYLLAIFAEDEYSIKDDLRFTFGARYNHHEIFGNNVSPRAYLVYNPTDELTLKGGVSTGFRTPYANRLINGAYNYSGQGRFPIYGNPDLKEETSLNYEIAAIYNNDLFYVSATGFLTNFKDKISTQRYNKDDMIPGIGTCDADRCFKAINHGKVEYKGIELGAGISPLDNLNVNFAYTYLDSEVKEAQDKSVIGKPEQDSLKHNIMLKTEYSFYNKITPWIKGEWQIDRYMGDTNINREYYKDIFLASMGVRYDINKQWSINAAIYNLFNKSFTDGWESYQNSGTTTWVNTYNRIEEGRRIYISINGSF

SEQ ID NO: 14486 - protein, 445 aa, Campylobacter jejuni
MNKSYLALAVVLGGAAQQAGAAGFFEDSKATLGLRNLYFNQDNRDGAADPSKQEEWGQGFILDYKSGYTQGPVGFGVDALGLLGIRLDSGKGTHYNPTSANNSGQLFPTESNGRAVHEYGSVGLTAKVRFSKTEARLGTFLPKLPVVTHNDGRLLPQTFEGAQLSSNEIDNLTLIGGKFERAKGRSSTDSGPLSIAGANNAQTGKFSNQFYFAGGDYKVGKNLLLQYYYGNLEDFYVQHFLGLQHDWKLPVGLLKTDLRYFNSDSDGKNASVSGRAEGYRSSGYWSAGDSERGEVDNRAWSAKFTYLLDAHELSFGVQRLSGNSDFPVLNQGDGYTAYLITDSQINKFLRAGERTWRASYAYDFAKLGVPGLKASAVYLYGDNIDTDGSDASEWERNLRLDYVLQGGLFKGVGFSYRHATLRSDVASQRSIDENRLYITYSLPLL

SEQ ID NO: 14487 - protein, 777 aa, Pasteurella multocida
MLTLVFSVIRRSFMKFKYCVIHQLVLSGSLIFPTLSFADSDSTKTTPNKASYLEEISVVATTVQHIFSSTQSTEQLRKNMVSNERDLFRYEVGIGVPESGRSGSNGFAIRGVDKDRVAVIVDGIPQAESTISTSARYSTERHNGNINNIEYENVSSLKVQKGAASVMYGSGALGGTVEFTTKDIEDFVEPGRHLGFLSKTGYTSKNREYRQVIGVGGKGEHFFGFVQLTKRWGHETINNGKGTDILGEHQGKPNPLNYYTTSWLTKVGYDINNTHRFTLFLEDRREKKLTEEKTLGLSDAVRFANDQTPYLRYGIEYRYNGLSWLETVKLFLAKQKIEQRSALQEFDINNRNKLDSTMSFVYLQRQNIARGEFSTSPLYWGPSRHRLSAKFEFRDKFLENMNKHFTFRPWQINTFRQQGRNNYTEVFPVKSREFSFSLMDDIKIGELLHLGLGGRWDHYNYKPLLNSQHNINRTQRLPYPKTSSKFSYQLSLEYQLHPSHQIAYRLSTGFRVPRVEDLYFEDRGKSSSQFLPNPDLQPETALNHEISYRFQNQYAHFSVGLFRTRYHNFIQEREMTCDKIPYEYNRTYGYCTHNTYVMFVNEPEAVIKGVEVSGALNGSAFGLSDGLTFRLKGSYSKGQNHDGDPLKSIQPWTVVTGIDYETEGWSVSLSGRYSAAKKAKDAIETEYTHDKKVVKQWPHLSPSYFVVDFTGQVNLSKNVILNMGVFNLFNRDYMTWDSAYNLFTRGYTSRSVRANSPGINRFTAPKRNFAASVEIRF

SEQ ID NO: 14488 - protein, 200 aa, Wolbachia endosymbiont
GPISDEETSYYVRLQYNGEFLPLFAKVDGITYKKDKSDYSPLKPSFIAGGGAFGYKMDDIRVDVEGVYSYLNKNDVTDAEFKPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFN

SEQ ID NO: 14489 - protein, 205 aa, Wolbachia endosymbiont
SYYVRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYDVTPEIKLYAGARYFGSYGANFDGTKQDPAHPDDLEKKVTDKGAHKVFYSTIGAEAGVAFNF

SEQ ID NO: 14490 - protein, 199 aa, Wolbachia endosymbiont
SYYVRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYNVTPEIKLYAGARYFGSYGANFDGTKQDPAHPDDPEKKVTDKGAHKVFYSTIGAEA

SEQ ID NO: 14491 - protein, 191 aa, Wolbachia endosymbiont
SYYVRLQYNGEISPFKTKIDGIEYKKDNKDAQDPLKASFMAGSGAFGYKMDDIRVDVEGLYSQLNKNDVSGAVFTPATVADNVTAFSGLVNVYYDVAIEDMPVTPYVGVGVGAAYFSNPSSADTVRDQKGFGFAYQAKAGVSYDVTPEIKLYAGARYFGSYGAKFDGEKKQGSGESEVTTDKGAYKVFYST

SEQ ID NO: 14492 - protein, 205 aa, Wolbachia endosymbiont
SYYVRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYDVTPEIKLYAGARYFGSYGANFDGTKQDPAHPDDLEKKVTDKGAHKVFYSTIGAEAGVVFNF

SEQ ID NO: 14493 - protein, 199 aa, Wolbachia endosymbiont
SYYVRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYDVTPEIKLYAGARYFGSYGANFDGTKQDPAHPDDLEKKVTDKGAHKVFYSTIGAEA

SEQ ID NO: 14494 - protein, 171 aa, Neisseria meningitidis
YAAERITHDYPQATGANNTSTVSDYFRNIRAHSIHPRVSVGYDFGDWRIAADYASYRKWSNNKYSVNTKVLKENQGNRIKLKTENQGNGSFHASSSLGLSAIYDFKLNDKFKPYIGARVAYGHVKHQVHSVETKTTIYTTAPTGDATVGGTIPERPSSKPAYHESNSISSL

SEQ ID NO: 14495 - protein, 172 aa, Neisseria meningitidis
YAAERITHDYPKPTGTDKDKISTVSDYFRNIRAHSIHPRVSVGYDFGDWRIAADYASYRKWKESNSSTKKVTEEINNNYKETQTKHQGNGSFHASSSLGLSAIYDFKLNDKFKPYIGARVAYGHVKHQVHSVETKTTIVTSKPTQGAAQGGPIIQTDPSKPPYHESHSISSV

SEQ ID NO: 14496 - protein, 178 aa, Neisseria meningitidis
YAAERITHDYPKATGANNTSTVSDYFRNIRAHSIHPRVSVGYDFGGWRIAADYARYRKWNNNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 14497 - protein, 170 aa, Neisseria meningitidis
YAAERITHDYPKATGANNTSTVSDYFRNIRAHSIHPRVSVGYDFGGWRIAADYASYRKWKESNSSTKKVTEDIKDNYKETKTEHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 14498 - protein, 170 aa, Neisseria meningitidis
YAAERITHDYPKATGANNTSTVSDYFRNIRAHSIHPRVSVGYDFGDWRIAADYASYRKWNNNKYSVNTKELENKLNNKKDLKTENQENGTFHAASSLGLSAIYDFKLNDKFKPYIGARVAYGHVRHSIDSTKKTTEVVTSTHGGADTKPTIYNGESTQNAYHESHSIRRL

SEQ ID NO: 14499 - protein, 176 aa, Neisseria meningitidis
YAAERITHDYPQATGANNTSTVSDYFRNIRAHSIHPRVSVGYDFGDWRIAADYASYRKWNNNKYSVNTKEILRNNNSGNWQELKTENQENGTFHAVSSLGLSAIYDFKLNDKFDKFKPYIGARVAYGHVKHQVHSVESKTTIVTTAPTGGAQKGGVISEATISKPPYHQSHSISSL

SEQ ID NO: 14500 - protein, 165 aa, Neisseria meningitidis
YAAERITHDYPKATGANNTSTVSDYFRNIRAHSIHPRVSVGYDFGDWRIAADYASYRKWKESNSSTNTENSETQQNRIKIETGHQGNGSFHAASSLGLSAIYDFKLNDKFKPYIGARVAYGYVKHQVHSVESKTKTVTSKPNGGPVKGGPTPKPAYHESNSISSL

SEQ ID NO: 14501 - protein, 175 aa, Neisseria meningitidis
YAAERITHDYPKATGANNTSTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVKKETTTTFLAPTQGATVPGKIVEGPFSKPAYHESHSTSSL

SEQ ID NO: 14502 - protein, 175 aa, Neisseria meningitidis
YAAERITHDYPKATGANNTSTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVKKETTTVFTAPTQGAQKGGVIPEATISKPAYHESHSISSL

SEQ ID NO: 14503 - protein, 175 aa, Neisseria meningitidis
YAAERITHDYPQATGANNTSTVSDYFRNIRAHSIHPRVSVGYDFGGWRIAADYASYRKWNNNKYSVNTKELERNDSNGNWKELKTENQGNGSFHAASSLGLSAIYDFKLNDKFDKFKPYIGARVAYGHVKHQVHSVETETTTVFSKPQGTTVPSKIVSKDPSKPAYHESNSISSL

SEQ ID NO: 14504 - protein, 176 aa, Neisseria meningitidis
YAAERITHDYPKATGANNTSTVSDYFRNIRAHSIHPRVSVGYDFGDWRIAADYASYRKWNNNKYSVNTKELLRNNSSGIWQELKTENQENGSFHAASSLGLSAIYDFKLNDKFDKFKPYIGARVAYGHVKHQVHSVESKTTIVTTAPTQGAPKGGTILQGPTPKPPYHESNSISSL

SEQ ID NO: 14505 - protein, 180 aa, Neisseria meningitidis
YAAERITHNYPEPTGADKDKISTVSDYFRNIRAHSIHPRVSVGYDFGDWRIAADYASYRKWNNNKYSVNTKELQRNNSTGTENWQELKTENQENGSFHAASSLGLSAIYDFKLNDKFDKFKPYIGARVAYGHVKHQVHSVRKETKTTFSKPRVGATEPGKIVEGPTPKPPYHESNSISSL

SEQ ID NO: 14506 - protein, 176 aa, Neisseria meningitidis
YAAERITHDYPQATGANNTSTVSDYFRNIRAHSIHPRVSVGYDFGGWRIAADYASYRKWSNNKYSVNTKEVQRNNNAGNWQELKTENQENGSFHAVSSLGLSAIYDFKLNDKFDKFKPYIGARVAYGHVKHQVHSVRKETTTTFSKAGAGATKPGKIISGPISKPAYHESHSISSL

SEQ ID NO: 14507 - protein, 167 aa, Neisseria meningitidis
YAAERITHDYPKPTGTDKDKISTVSDYFRNIRTHSIHPRVSVGYDFGGWRIAADYASYRKWNNNKYSVNTKKVREKNGNREDLKTENQENGTFHAVSSLGLSAIYDFKLNDKFKPYIGARVAYGHVKHQVHSVESKTTTVTSKGGGPIPQGPTPKPPYHESHSTSSL

SEQ ID NO: 14508 - protein, 174 aa, Neisseria meningitidis
YAAERITHDYPQATGANNTSTVSDYFRNIRAHSIHPRVSVGYDFGGWRIAADYASYRKWNNNKYSVNTKEVQRNNNGNWQELKTENQENGSFHAASSLGLSAIYDFKLNNKFDKFKPYIGARVAYGHVKHQVHSVETETTTVFSKPQGTTVPSKIVSRDPSKPPYHESHSISSV

SEQ ID NO: 14509 - protein, 170 aa, Neisseria meningitidis
YAAERITHDYPQATGANNTSTVSDYFRNIRTHSIHPRVSVGYDFGDWRIAADYASYRKWKESNYSKKVTEFKHQNGNKQEDKTEHQGNGSFHATSSLGLSAIYDFNTGSRFKPYAGVRVAYGHVRHSIDSTKKTTNVLTVPTNIPGGTPTIYNQGSTQDAYHESHSIRRL

SEQ ID NO: 14510 - protein, 174 aa, Neisseria meningitidis
YAAERITHDYPKATGANNTSTVSDYFRNIRAHSIHPRVSVGYDFGGWRIAADYASYRKWNNNKYSVNTKELENKHNNKKDLKTENQENGTFHAASSLGLSAIYDFKLNDKFDKFKPYIGVRVAYGHVKHQVHSVESKTTIVTSKPTKGATQPGKLVSGPTPKPAYHESNSISSL

SEQ ID NO: 14511 - protein, 174 aa, Neisseria meningitidis
YAAERITHDYPKATGANNTSTVSDYFRNIRAHSIHPRVSVGYDFGDWRIAADYASYRKWNNNKYSVNTKEVRRNGGNSENLKTENQENGSFHAVSSLGLSAIYDFKLNDKFDKFKPYIGARVAYGHVKHQVHSVESKTTIVTTAPTGGAQKGGVISEATISKPPYHQSHSISSL

SEQ ID NO: 14512 - protein, 169 aa, Neisseria meningitidis
YAAERITHDYPQATGANNTSTVSDYFRNIRAHSIHPRVSVGYDFGDWRIAADYASYRKWNNNKYSVNTKELENKNNNKRDLKTENQENGSFHAASSLGLSAIYDFKLNDKFKPYIGARVAYGHVRHSIDSTKKTTEVLTSSHAPGTAPTIYNQGSTQNAYHERNSISSL

SEQ ID NO: 14513 - protein, 177 aa, Neisseria meningitidis
YAAERITHDYPKPTGTDKDKISTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVKKETTTTFLAPTQGATVPGKIVEGPTPKPPYHESHSTSSL

SEQ ID NO: 14514 - protein, 173 aa, Neisseria meningitidis
YAAERITHDYPKATGANNTSTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRL

SEQ ID NO: 14515 - protein, 179 aa, Neisseria meningitidis
YAAERITHDYPKPTGTDKDKISTVSDYFRNIRAHSIHPRVSVGYDFGGWRIAADYASYRKWNNNKYSVNTKEISRNNSNGNDTWQELKTENQENGSFHAVSSLGLSAIYDFKLNDKFDKFKPYIGARVAYGHVKHQVHSVRKETTTVFSKPSGSTTKPGQIPSLVTKPAYHESHSISSL

SEQ ID NO: 14516 - protein, 170 aa, Neisseria meningitidis
YAAERITHDYPKATGANNTSTVSDYFRNIRAHSIHPRVSVGYDFGGWRIAADYASYRKWKESNFSTKKVTREIKDNYKETKTEHQGNGSFHATSSLGLSAIYDFKLNDKFKPYIGARVAYGHVKHQVHSVETKTTTVTSKPTATSPQGGPIIQTDPSKPPYHESHSISSL

SEQ ID NO: 14517 - protein, 176 aa, Neisseria meningitidis
YAAERITHDYPKPTGTDKDKISTVSDYFRNIRAHSIHPRVSVGYDFGGWRIAADYASYRKWNNNKYSVNTKVLQEKNGNRKELKTENQENGTFHAASSLGLSAIYDFKLNDKFDKFKPYIGARVAYGHVKHQVHSVKKETTTVFTAPTQGAQKGGVIPEATISKPAYHESHSISSL

SEQ ID NO: 14518 - protein, 174 aa, Neisseria meningitidis
YAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLNDKFDKFKPYIGVRVAYGHVKHQVHSVESKTTIVTSKPTKGATQPGKLVSGPTPKPAYHESNSISSL

SEQ ID NO: 14519 - protein, 176 aa, Neisseria meningitidis
YAAERITHDYPKPTGTDKDKISTVSDYFRNIRAHSIHPRVSVGYDFGDWRIAADYASYRKWNNNKYSVNTKEVRRNGGNSENLKTENQENGTFHAASSLGLSAIYDFKLNDKFDKFKPYIGVRVAYGHVKHQVHSVESKTTIVTTAPTGGAQKGGVISEATISKPPYHQSHSISSL

SEQ ID NO: 14520 - protein, 174 aa, Neisseria meningitidis
YAAERITHDYPKATGANNTSTVSDYFRNIRAHSIHPRVSVGYDFGDWRIAADYASYRKWNNNKYSVNTKEVLRNQGNWQELKTENQENGSFHASSSLGLSAIYDFKLNDKFDKFKPYIGARVAYGHVKHQVHSVRKETTTVFSKPSGSVTKPGEIVQGPTSKPPYHESNSISSL

SEQ ID NO: 14521 - protein, 171 aa, Neisseria meningitidis
YAAERITHDYPQATGANNTSTVSDYFRNIRTHSIHPRVSVGYDFGDWRIAADYASYRKWKESNFSTKKVTENIKDNYKETKTEHQGNGSFHAASSLGLSAIYDFKLNDKFKPYIGARVAYGHVKHQVHSVETKTTTVTSKPTATSPQGGGPVSEAPISKPAYHESNSISSL

SEQ ID NO: 14522 - protein, 170 aa, Neisseria meningitidis
YAAERITHDYPQATGANNTSTVSDYFRNIRAHSIHPRVSVGYDFGDWRIAADYASYRKWKESNSSTNTENSEHPQNHVKIETKHQGNGSFHAASSLGLSAIYDFKLNDKFKPYIGARVAYGHVKHQVYSVESKNTIVTSKPTQGAAQGGPVPTGFVPKSAYHESNSISSL

SEQ ID NO: 14523 - protein, 176 aa, Neisseria meningitidis
YAAERITHDYPKPTGANNTSTVSDYFRNIRAHSIHPRVSVGYDFGDWRIAADYASYRKWNNNKYSVNTKEVQRNKEYGNWIELKTENQGNGSFHAVSSLGLSAIYDFKLNDKFDKFKPYIGARIAYGHVKHQVHTVETETKIIFTTPTKGAKVGGTIPNKSMSKPPYHESNSISSL

SEQ ID NO: 14524 - protein, 177 aa, Neisseria meningitidis
YAAERITHNYPEPTGADKDKISTVSDYFRNIRAHSIHPRVSVGYDFGDWRIAADYASYRKWNNNKYSVNTKELERNDSNGNWKELKTENQGNGSFHAASSLGLSAIYDFKLNDKFDKFKPYIGARVAYGHVKHQVHSVETETTTVFSKPQGTTVPSKIVSKDPSKPAYHESNSISSL

SEQ ID NO: 14525 - protein, 176 aa, Neisseria meningitidis
YAAERITHDYPQATGANNTSTVSDYFRNIRAHSIHPRVSVGYDFGGWRIAADYASYRKWNNNKYSVNTKELERNNTSGNWKELKTENQENGTFHASSSLGLSAIYDFKLNDKFDKFKPYIGARVAYGHVKHQVHSVEKETTTTFSKAGLGATEPGKIISGPTPKPPYHESNSISSL

SEQ ID NO: 14526 - protein, 177 aa, Neisseria meningitidis
YAAERITHDYPKPTGANNTSTVSDYFRNIRAHSIHPRVSVGYDFGGWRIAADYAGYRKWNDNKYSVNTKEVLRNNSTGTENWQELKTENQENGSFHAASSLGLSAIYDFKLNDKFDKFKPYIGARVAYGHVKHQVHSVETETTTVFSKPKGTTVPGIISEKPISKPPYHESNSISSL

SEQ ID NO: 14527 - protein, 172 aa, Neisseria meningitidis
YAAERITHNYPEPTGADKDKISTVSDYFRNIRAHSIHPRVSVGYDFGGWRIAADYASYRKWKESNSSTKKVTEEINNNYKETQTKHQGNGSFHASSSLGLSAIYDFKLNDKFKPYIGARVAYGHVKHQVHSVETKTTIVTSKPTQGAAQGGPIIQTDPSKPPYHESHSISSV

SEQ ID NO: 14528 - protein, 176 aa, Neisseria meningitidis
YAAERITHDYPKATGANNTSTVSDYFRNIRAHSIHPRVSVGYDFGDWRIAADYASYRKWNNNKYSVNTKELQRNNSSGIWQELKTENQENGTFHAVSSLGLSAIYDFKLNDKFDKFKPYIGARVAYGHVKHQVHSVRKETTTVFSKPGVGATEPGKIVEGPTPKPPYHESNSISSL

SEQ ID NO: 14529 - protein, 165 aa, Neisseria meningitidis
YAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSV

SEQ ID NO: 14530 - protein, 177 aa, Neisseria meningitidis
YAAERITHDYPKPTGTDKDKISTVSDYFRNIRAHSIHPRVSVGYDFGGWRIAADYASYRKWNNNKYSVNTKEVERNNTSGNWKELKTENQENGTFHASSSLGLSAIYDFKLNDKFDKFKPYIGVRVAYGHVKHQVHSVRKETTTAFLKPSKGATEPGKIPSLVTKPAYHESHSTSSL

SEQ ID NO: 14531 - protein, 177 aa, Neisseria meningitidis
YAAERITHDYPKATGANNTSTVSDYFRNIRAHSIHPRVSVGYDFGGWRIAADYASYRKWNNNKYSVNTKEISRNNSNGNDTWQELKTENQENGSFHAVSSLGLSAIYDFKLNDKFDKFKPYIGARVAYGHVKHQVHSVRKETTTVFSKPSGSTTKPGQIPSLVTKPAYHESHSISSL

SEQ ID NO: 14532 - protein, 171 aa, Neisseria meningitidis
YAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLNDKFKPYIGVRVAYGHVKHQVHSVESKTTIVTSKPTKGATQPGKLVSGPTPKPAYHESNSISSL

SEQ ID NO: 14533 - protein, 176 aa, Neisseria meningitidis
YAAERITHNYPEPTGADKDKISTVSDYFRNIRAHSIHPRVSVGYDFGDWRIAADYASYRKWNNNKYSVNTKVLKENKGNRENLKTENQENGSFHASSSLGLSAIYDFKLNDKFDKFKPYIGARVAYGHVKHQVHSVETETTIYTTAPTKGAKVGGTIPNKAISKPPYHESHSTSSL

SEQ ID NO: 14534 - protein, 175 aa, Neisseria meningitidis
YAAERITHDYPKATGANNTSTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVKKETTTTFLAPTQGATVPGKIVEGPTPKPPYHESHSISSL

SEQ ID NO: 14535 - protein, 176 aa, Neisseria meningitidis
YAAERITHDYPQATGANNTSTVSDYFRNIRAHSIHPRVSVGYDFGGWRIAADYASYRKWSNNKYSVNTKELQRNKEYGNWQELKTENQENGSFHAASSLGLSAIYDFKLNDKFDKFKPYIGARVAYGHVKHQVHSVRKETTTTFSKAGAGATEPGKIILGPISKPAYHESHSTSSL

SEQ ID NO: 14536 - protein, 177 aa, Neisseria meningitidis
YAAERITHDYPQATGANNTSTVSDYFRNIRAHSIHPRVSVGYDFGGWRIAADYASYRKWNDNKYSVNTKEVLRNNSTGTENWQELKTENQENGSFHAASSLGLSAIYDFKLNDKFDKFKPYIGARVAYGHVKHQVHSVETETTTVFSKPKGTTVPGIISEKPISKPPYHESNSISSL

SEQ ID NO: 14537 - protein, 172 aa, Neisseria meningitidis
YAAERITHDYPKATGTDKDKISTVSDYFRNIRAHSIHPRVSVGYDFGGWRIAADYASYRKWKESNSSTKKVTEEINNNYKETQTKHQGNGSFHASSSLGLSAIYDFKLNDKFKPYIGARVAYGHVKHQVHSVETKTTIVTSKPTQGAAQGGPIIQTDPSKPPYHESHSISSV

SEQ ID NO: 14538 - protein, 167 aa, Neisseria meningitidis
YAAERITHDYPQATGANNTSTVSDYFRNIRAHSIHPRVSVGYDFGDWRIAADYASYRKWKESNSSTKKVTEDIADNYKETKTEHQGNGSFHASSSLGLSAIYDFKLNDKFDKFKPYIGARVAYGHVKHQVHSVESKTTTVTSKGGGPIPQGPTPKPPYHESNSISSL

SEQ ID NO: 14539 - protein, 176 aa, Neisseria meningitidis
YAAERITHDYPQATGANNTSTVSDYFRNIRAHSIHPRVSVGYDFGDWRIAADYASYRKWNNNKYSVNTKEVLRNNNAGNWQELKTENQENGSFHAVSSLGLSAIYDFKLNDKFDKFKPYIGARVAYGHVKHQVHSVRKETTTTFLAPTGDAKVPGKIVEGPFSKPAYHESHSISSL

SEQ ID NO: 14540 - protein, 176 aa, Neisseria meningitidis
YAAERITHDYPKATGANNTSTVSDYFRNIRAHSIHPRVSVGYDFGDWRIAADYASYRKWNNNKYSVNTKELQRNNSSGIWQELKTENQENGTFHAVSSLGLSAIYDFKLNDKFDKFKPYIGARVAYGHVKHQVHSVRKETKTTFNKPGVGATEPGKIVEGPTPKPPYHESNSISSL

SEQ ID NO: 14541 - protein, 176 aa, Neisseria meningitidis
YAAERITHDYPQATGANNTSTVSDYFRNIRTHSIHPRVSVGYDFGDWRIAADYASYRKWNDNKYSVNTKNVQVNKSNGNRQDLKTENQENGSFHASSSLGLSAIYDFKLNDKFDKFKPYIGVRVAYGHVKHQVHSVKKETTTTFLAPTGDAKVPGKIVEGPFSKPAYHESHSISSL

SEQ ID NO: 14542 - protein, 174 aa, Neisseria meningitidis
YAAERITHDYPKATGANNTSTVSDYFRNIRAHSIHPRVSVGYDFGGWRIAADYASYRKWNNNKYSVNTKVLQEKNGNRKELKTENQENGTFHAASSLGLSAIYDFKLNDKFDKFKPYIGARVAYGHVKHQVHSVKKETTTVFTAPTKGAQKGGVIPEATISKPAYHESHSISSL

SEQ ID NO: 14543 - protein, 174 aa, Neisseria meningitidis
YAAERITHDYPQATGANNTSTVSDYFRNIRAHSIHPRVSVGYDFGGWRIAADYASYRKWNNNKYSVNIKKGRETQDNREELKTENQENGSFHAASSLGLSAIYDFKLNDKFDKFKPYIGARVAYGHVKHQVHSVETKTTIVTSKPKGKHLKGGPVPLQHSSQPPYHESNSISSL

SEQ ID NO: 14544 - protein, 168 aa, Neisseria meningitidis
YAAERITHDYPKATGANNTSTVSDYFRNIRAHSIHPRVSVGYDFGGWRIAADYASYRKWNNNKYSVNIKKEKETPHNRQDLKTENQENGTFHAVSSLGLSAIYDFKLNDKFDKFKPYIGARVAYGHVKHQVHSVETKTTIVTSKPNGGPVPSSVTKPPYHQSHSISSL

SEQ ID NO: 14545 - protein, 176 aa, Neisseria meningitidis
YAAERITHDYPQATGANNTSTVSDYFRNIRAHSIHPRVSVGYDFGDWRIAADYASYRKWNNNKYSVNTKEVQRNNSNGTTWKELKTENQENGSFHAVSSLGLSAIYDFKLNDKFDKFKPYIGVRVAYGHVKHQVHSVRKETTTVFSKPSGSTTKPGEIPSLVTKPAYHESNSISSL

SEQ ID NO: 14546 - protein, 170 aa, Neisseria meningitidis
YAAERITHDYPKATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFKPYIGARVAYGHVKHQVHSVETKTTIVTSKPTQGAAQGGPIIQTDPSKPPYHESHSISSV

SEQ ID NO: 14547 - protein, 175 aa, Neisseria meningitidis
YAAERITHDYPKATGANNTSTVSDYFRNIRAHSIHPRVSVGYDFGGWRIAADYASYRKWNNNKYSVNTKEVERNNTSGNWKELKTENQENGTFHAVSSLGLSAIYDFKLNDKFDKFKPYIGARVAYGHVKHQVHSVETETTTVFSKPKGTTVPGIISEKPISKPPYHESNSISSL

SEQ ID NO: 14548 - protein, 165 aa, Neisseria meningitidis
YAAERITHDYPKATGANNTSTVSDYFRNIRAHSIHPRVSVGYDFGGWRIAADYASYRKWKESNYSKKVTEFKHQNGTKKEDKTEHQGNGSFHAASSLGLSAIYDFKLNDKFKPYIGARIAYGHVKHQIHSVESKTTTVTSNNGGPIPQGPTPKPPYHESNSISSL

SEQ ID NO: 14549 - protein, 166 aa, Neisseria meningitidis
YAAERITHNYPEPTGADKDKISTVSDYFRNIRAHSIHPRVSVGYDFGGWRIAADYASYRKWKESNFSTKKVTEEIKDNYKETKTEHQGNGSFHATSSLGLSAIYDFKLNDKFKPYIGARVAYGHVKHQVHSVETKTTIVTSKPNGGPVPSSVTKPPYHQSHSISSL

SEQ ID NO: 14550 - protein, 173 aa, Neisseria meningitidis
YAAERITHDYPKPTGTDKDKISTVSDYFRNIRAHSIHPRVSVGYDFGGWRIAADYASYRKWNNNKYSVNTKVLKETQDNWQELKTENQENGSFHAASSLGLSAIYDFKLNDKFKPYIGARVAYGHVKHQVHSVETKTTTVTSKPNGKNLKGGPVSSRKPSKPPYHESHSTSSL

SEQ ID NO: 14551 - protein, 178 aa, Neisseria meningitidis
YAAERITHDYPKPTGANKDKISTVSDYFRNIRAHSIHPRVSVGYDFGDWRIAADYASYRKWNNNKYSVNTKEVQRNNSNGTTWKELKTENQENGSFHAVSSLGLSAIYDFKLNDKFDKFKPYIGVRVAYGHVKHQVHSVRKETTTVFSKPSGSTTKPGEIPSLVTKPAYHESNSISSL

SEQ ID NO: 14552 - protein, 165 aa, Neisseria meningitidis
YAAERITHDYPQATGANNTSTVSDYFRNIRTHSIHPRVSVGYDFGDWRIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSV

SEQ ID NO: 14553 - protein, 176 aa, Neisseria meningitidis
YAAERITHDYPKASGANNTSTVSDYFRNIRAHSIHPRVSVGYDFGDWRIAADYASYRKWNNNKYSVNTKEVLRNNNAGNWQELKTENQENGSFHAVSSLGLSAIYDFKLNDKFDKFKPYIGARVAYGHVKHQVHSVRKETKTTFSKPGAGATKPGKIVEGPTSKPAYHESHSISSV

SEQ ID NO: 14554 - protein, 171 aa, Neisseria meningitidis
YAAERITHDYPKPTGTDKDKISTVSDYFRNIRTHSIHPRVSVGYDFGDWRIAADYASYRKWNNNKYSVNIKKERETQDNREELKTENQENGTFHAVSSLGLSAIYDFKLNDKFDKFKPYIGARVAYGHVKHQVHSVESKTTIVTSKPSGGPVIQGPTHKPAYHESHSISSL

SEQ ID NO: 14555 - protein, 175 aa, Neisseria meningitidis
YAAERITHDYPQATGANNTSTVSDYFRNIRAHSIHPRVSVGYDFGGWRIAADYASYRKWNNNKYSVNTKELERNDSNGNWKELKTENQGNGSFHAASSLGLSAIYDFKLNDKFDKFKPYIGARVAYGHVKHQVHSVETETTTVFSKPQGTTVPSKIVSKDSSKPAYHESNSIGSL

SEQ ID NO: 14556 - protein, 178 aa, Neisseria meningitidis
YAAERITHDYPKPTGTDKDKISTVSDYFRNIRAHSIHPRVSVGYDFGGWRIAADYASYRKWNNNKYSVNTKEVERNNISGNWKELKTENQENGSFHAASSLGLSAIYDFKLNDKFDKFKPYIGVRVAYGHVKHQVHSVKKETTTTFLAPTGDAKVPGKIVEGPFSKPAYHESHSTSSL

SEQ ID NO: 14557 - protein, 176 aa, Neisseria meningitidis
YAAERITHNYPEPTGADKDKISTVSDYFRNIRAHSIHPRVSVGYDFGGWRIAADYASYRKWNNNKYSVNTKEVRRNGGNSENLKTENQENGTFHAASSLGLSAIYDFKLNDKFDKFKPYIGVRVAYGHVKHQVHSVETETKIIFTTPTGGAKVGGTIPDKSMSKPPYHESRSISSL

SEQ ID NO: 14558 - protein, 178 aa, Neisseria meningitidis
YAAERITHDYPQATGANNTSTVSDYFRNIRAHSIHPRVSVGYDFGGWRIAADYASYRKWSNNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 14559 - protein, 176 aa, Neisseria meningitidis
YAAERITHDYPQATGANNTSTVSDYFRNIRAHSIHPRVSVGYDFGGWRIAADYASYRKWNNNKYSVNTKEVERNNTSGNWKELKTENQENGSFHAASSLGLSAIYDFKLNDKFDKFKPYIGVRVAYGHVKHQVHSVKKETTTTFLAPTGDAKVPGKIVEGPFSKPAYHESHSTSSL

SEQ ID NO: 14560 - protein, 176 aa, Neisseria meningitidis
YAAERITHDYPQATGANNTSTVSDYFRNIRTHSIHPRVSVGYDFGDWRIAADYASYRKWNDNKYSVNTKNVQVNKSNGNRQDLKTENQENGTFHAVSSLGLSAIYDFKLNDKFDKFKPYIGVRVAYGHVKHQVHSVESKTTIVTSKPTKGATQPGKLVSGPTPKPAYHESNSISSL

SEQ ID NO: 14561 - protein, 173 aa, Neisseria meningitidis
YAAERITHDYPQATGANNTSTVSDYFRNIRAHSIHPRVSVGYDFGGWRIAADYASYRKWKESNSSTKKVTEEINNNYKETQTKHQGNGSFHAASSLGLSAIYDFKLNDKFDKFKPYIGARVAYGHVKHQVHSVESKNTIVTSKPTQGAAQGGPVPTGFVPKSAYHESHSISSL

SEQ ID NO: 14562 - protein, 175 aa, Neisseria meningitidis
YAAERITHDYPQATGANNTSTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVKHQVHSVESKTTIVTTAPTQGALKGGTMPTRSDPQTSLHESNSISSL

SEQ ID NO: 14563 - protein, 175 aa, Neisseria meningitidis
YAAERITHDYPKATGANNTSTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVKKETTTTFLAPTQGATVPGKIVEGPFSKPAYHESHSISSL

SEQ ID NO: 14564 - protein, 178 aa, Neisseria meningitidis
YAAERITHDYPKATGANNTSTVSDYFRNIRAHSIHPRVSVGYDFGDWRIAADYASYRKWNNNKYSVNTKELQRNNSSGTENWQELKTENQENGSFHAASSLGLSAIYDFKLNDKFDKFKPYIGARVAYGHVKHQVHSVRKETKTTFSKPRVGATEPGKIVEGPTPKPPYHESNSISSL

SEQ ID NO: 14565 - protein, 176 aa, Neisseria meningitidis
YAAERITHDYPKATGTDKDKISTVSDYFRNIRAHSIHPRVSVGYDFGGWRIAADYASYRKWSNNKYSVNTKVLKENQGNRIKLKTENQGNGTFHASSSLGLSAIYDFKLNDKFDKFKPYIGARVAYGHVKHQVHSVETKTTIYTTAPTGDATVGGTIPERPSIKPAYHESNSISSL

SEQ ID NO: 14566 - protein, 176 aa, Neisseria meningitidis
YAAERITHDYPKATGANNTSTVSDYFRNIRAHSIHPRVSVGYDFGGWRIAADYASYRKWNNNKYSVNTKELLRNNSSGIWQELKTENQENGTFHAASSLGLSAIYDFKLNDKFDKFKPYIGARVAYGHVKHQVHSVRKETKTTFSPPKQGATVPGKIVEGPFSKPPYHESNSISSL

SEQ ID NO: 14567 - protein, 173 aa, Neisseria meningitidis
YAAERITHDYPKPTGTDKDKISTVSDYFRNIRAYSIHPRVSVGYDFGGWRIAADYASYRKWNNNKYSVNTKEVLRNNNGNRKELKTENQENGTFHAVSSLGLSAIYDFKLNDKFKPYIGARVAYGHVRYSIDSTKKTTDVVTVATNTPDGAPTIYNEPKTQNAYHESHSIRRL

SEQ ID NO: 14568 - protein, 173 aa, Neisseria meningitidis
YAAERITHNYPKATGANNTSTVSDYFRNIRAHSIHPRVSVGYDFGGWRIAADYASYRKWKESNSSTKKVTEEINNNYKETQTKHQGNGSFHAASSLGLSAIYDFKLNDKFDKFKPYIGARVAYGHVKHQVHSVESKNTIVTSKPTQGAAQGGPVPTGFVPKSAYHESHSISSL

SEQ ID NO: 14569 - protein, 176 aa, Neisseria meningitidis
YAAERITHDYPKATGANNTSTVSDYFRNIRAHSIHPRVSVGYDFGDWRIAADYASYRKWNNNKYSVNTKEILRNNNSGNWQELKTENQENGTFHAVSSLGLSAIYDFKLNDKFDKFKPYIGARVAYGHVKHQVHSVRKETKTTFSKPGAGATKPGKIVEGPTSKPAYHESHSISSV

SEQ ID NO: 14570 - protein, 180 aa, Neisseria meningitidis
YAAERITHNYPEPTGADKDKISTVSDYFRNIRAHSIHPRVSVGYDFGGWRIAADYARYRKWNNNKYSVNTKEVGRNNNNNIDIWKELKTENQENGSFHAASSLGLSAIYDFKLNDKFDKFKPYIGVRVAYGHVKHQVHSVRKETTTVFSKPSGSVTKPGEIVETPTSKPAYHESHSISSL

SEQ ID NO: 14571 - protein, 170 aa, Neisseria meningitidis
YAAERITHDYPQATGANNTSTVSDYFRNIRAHSIHPRVSVGYDFGGWRIAADYASYRKWKESNSSTKKVTEEINNNYKETQTKHQGNGSFHASSSLGLSAIYDFKLNDKFKPYIGARVAYGHVKHQVHSVETKTTIVTSKPTQGAAQGGPIIQTDPSKPPYYESHSISSV

SEQ ID NO: 14572 - protein, 174 aa, Neisseria meningitidis
YAAERITHDYPKATGANNTSTVSDYFRNIRAHSIHPRVSVGYDFGGWRIAADYASYRKWNNNKYSVNTKELENKHNNKKDLKTENQENGTFPAASSLGLSAIYDFKLNDKFDKFKPYIGVRVAYGHVKHQVHSVESKTTIVTSKPTKGATQPGKLVSGPTPKPAYHESNSISSL

SEQ ID NO: 14573 - protein, 172 aa, Neisseria meningitidis
YAAERITHDYPKPTGTDKDKISTVSDYFRNIRAHSIHPRVSVGYDFGDWRIAADYASYRKWKESNFSTKKVTEEINDNYQETKTEHQGNGSFHASSSLGLSAIYDFKLNDKFKPYIGARVAYGHVKHQVHSVETKTTTVTSKPKNGSPQGGAVPSREPSKPPYHESNSISSL

SEQ ID NO: 14574 - protein, 175 aa, Neisseria meningitidis
YAAERITHNYPEPTGADKDKISTVSDYFRNIRAHSIHPRVSVGYDFGDWRIAADYASYRKWKESNSSTNAENRDNAKNYVKIETKHQGNGSFHAASSLGLSAIYDFKLNDKFDKFKPYIGARVAYGHVKHQVHSVETKTTTVTSKPTATSPQGGPIIQTDPSKPPYHESHSISSL

SEQ ID NO: 14575 - protein, 175 aa, Neisseria meningitidis
YAAERITHNYPEPTGADKDKISTVSDYFRNIRAHSIHPRVSVGYDFGGWRIAADYASYRKWKESNSSTKKVTEEINNNYKETQTKHQENGSFHAASSLGLSAIYDFKLNDKFDKFKPYIGARVAYGHVKHQVHSVETKTTIVTSKPKGKHLKGGPVPLQHSSQPPYHESNSISSL

SEQ ID NO: 14576 - protein, 170 aa, Neisseria meningitidis
YAAERITHDYPKATGANNTSTVSDYFRNIRAHSIHPRVSVGYDFGDWRIAADYASYRKWKESNSSTNAENRDNAQNYVKIETKHQGNGSFHASSSLGLSAIYDFKLNDKFKPYIGARIAYGHVRHQVHSVESKNTIITSKPKNGAAQGGPVPTGFVGKPAYHESNSISSL

SEQ ID NO: 14577 - protein, 1561 aa, Neisseria meningitidis
MKTKRFKINAISLSIFLAYALTPYSEAALVRDDVDYQIFRDFAENKGKFFVGATDLSVKNKQGQNIGNALSNVPMIDFSVADVNKRIATVVDPQYAVSVKHAKAEVHTFYYGQYNGHNDVADKENEYRVVEQNNYEPHKAWSASNLGRLEDYNMARFNKFVTEVAPIAPTDAGGGLDTYKDKNRFSSFVRVGAGRQLVYEKGAYHQEGNEKGYDLRDLSQAYRYAIAGTPYKDINIDQTMNTEGLIGFGNHNTHYSAEELKQALSQDALTNYGVLGDSGSPLFAFDKQKNQWVFLGTYDYWAGYGKKSWQEWNIYKKEFADKIKQRDNAGTIKGYGEHHWKTTGTNSHIGSTAVRLANNERDANNGQNVTFENNGTLVLDQNINQGAGGLFFKGDYTVKGANNDITWLGAGIDVADGKKVVWQVKNPNGDRLAKIGKGTLEINGTGVNQGELKVGDGTVILNQKADSNQKVSAFSQVGIVSGRGTLVLNSSNQINPDNLYFGFRGGRLDANGNDLTFEHIRNVDEGARIVNHNTSHASTITLTGKSLITNPNSLSVHSIQNDYDEDDYSYYYRPRRPIPQGKDLYYKNYRYYALKSGGSVNAPMPENGQTENNDWILMGSTQEEAKKNAMNHKNNQRISGFSGFFGEENGKGHNGALNLNFNGKSAQNRFLLTGGTNLNGKISVTQGNVLLSGRPTPHARDFVNKSSARKDARFSKNNEVVFEDDWINRTFKAAEIAVNQSASFSSGRNVSNITANITATDNAKVNLGYKNGDEVCVRSDYTGYVTCNTDNLSDKALNSFDATQINGNVNLNQNAALVLGKAALWGQIQGQGNSSVSLNQHSKWHLTSDSQVHNLSLADSHIHLNNASDAQSANKYHTLKINHLSGNGHFHYLTHLAKNLGDKVLVKESASGHYQLHVQDKTGEPNQEGLNLFDASSVQDRSRLSVSLANNHVDLGALRYTIKTENGITRLYNPYAENRRRVKPAPSPATNTASQAQTDSAQIAKPQNIVVAPPSPQANQAEEAKRQQAKAEQVKRQQAEAEKVAHQKAEEAKRQQDALARQQAEQERQRLEAERQAAEIAKQKAEAEEAKRRAAEIAEQKAAAEEAKRQAAELARQQEEARKAAELAAKQKAETERKAAEIAEQKAEAEREAAELAKQKAEEEGRQAAQSQPKRRNRRAIPPELSSDATTRALPRIARNSNPDASDYEEIPLDALEDEDVSESVDTSDKQPQDNTELHEKVETVSLQPRAAQPRAQAAAQPQAQAVAQADAVSTNTNSALSDAMASTQSILLDTGASLTRHIAQKSRADAEKNSVWMSNIGYGRDYASAQYRRFSSKRTQTQIGIDRSLSENMQIGGVLTYSDSQHTFDQASGKNTFVQANLYGKYYLNDAWYVAGDIGAGSLRSRLQTQQKANFNRTSIQTGLTLGNTLKINQFEIVPSAGIRYSRLSSADYKLGNDSVKVSSMSVKTLTAGLDFAYRFKVGNLTVKPLLSAAYFANYGKGGVNVGGNSFAYKADNQQQYSAGAALLYRNVTLNVNGSITKGKQLEKQKSGQIKIQIRF

SEQ ID NO: 14578 - protein, 1702 aa, Haemophilus influenzae
MLNKKFKLNFIALTVAYALTPYTEAALVRDDVDYQIFRDFAENKGRFSVGATNVEVRDKNNHSLGNVLPNGIPMIDFSVVDVDKRIATLINPQYVVGVKHVSNGVSELHFGNLNGNMNNGNDKSHRDVSSEENRYFSVEKNEYPTKLNGKAVTTEDQTQKRREDYYMPRLDKFVTEVAPIEASTASSDAGTYNDQNKYPAFVRLGSGSQFIYKKGDNYSLILNNHEVGGNNLKLVGDAYTYGIAGTPYKVNHENNGLIGFGNSKEEHSDPKGILSQDPLTNYAVLGDSGSPLFVYDREKGKWLFLGSYDFWAGYNKKSWQEWNIYKPEFAKTVLDKDTAGSLTGSNTQYNWNPTGKTSVISNGSESLNVDLFDSSQDTDSKKNNHGKSVTLRGSGTLTLNNNIDQGAGGLFFEGDYEVKGTSDSTTWKGAGVSVADGKTVTWKVHNPKSDRLAKIGKGTLIVEGKGENKGSLKVGDGTVILKQQADANNKVKAFSQVGIVSGRSTVVLNDDKQVDPNSIYFGFRGGRLDANGNNLTFEHIRNIDDGARLVNHNTSKTSTVTITGESLITDPNTITPYNIDAPDEDNPYAFRRIKDGGQLYLNLENYTYYALRKGASTRSELPKNSGESNENWLYMGKTSDEAKRNVMNHINNERMNGFNGYFGEEEGKNNGNLNVTFKGKSEQNRFLLTGGTNLNGDLKVEKGTLFLSGRPTPHARDIAGISSTKKDQHFAENNEVVVEDDWINRNFKATNINVTNNATLYSGRNVANITSNITASDNAKVHIGYKAGDTVCVRSDYTGYVTCTTDKLSDKALNSFNATNVSGNVNLSGNANFVLGKANLFGTISGTGNSQVRLTENSHWHLTGDSNVNQLNLDKGHIHLNAQNDANKVTTYNTLTVNSLSGNGSFYYLTDLSNKQGDKVVVTKSATGNFTLQVADKTGEPTKNELTLFDASNATRNNLNVSLVGNTVDLGAWKYKLRNVNGRYDLYNPEVEKRNQTVDTTNITTPNNIQADVPSVPSNNEEIARVETPVPPPAPATPSETTETVAENSKQESKTVEKNEQDATETTAQNGEVAEEAKPSVKANTQTNEVAQSGSETEETQTTEIKETAKVEKEEKAKVEKEEKAKVEKDEIQEAPQMASETSPKQAKPAPKEVSTDTKVEETQVQAQPQTQSTTVAAAEATSPNSKPAEETQPSEKTNAEPVTPVVSKNQTENTTDQPTEREKTAKVETEKTQEPPQVASQASPKQEQSETVQPQAVLESENVPTVNNAEEVQAQLQTQTSATVSTKQPAPENSINTGSATAITETAEKSDKPQTETAASTEDASQHKANTVADNSVANNSESSEPKSRRRRSISQPQETSAEETTAASTDETTIADNSKRSKPNRRSRRSVRSEPTVTNGSDRSTVALRDLTSTNTNAVISDAMAKAQFVALNVGKAVSQHISQLEMNNEGQYNVWVSNTSMNENYSSSQYRRFSSKSTQTQLGWDQTISNNVQLGGVFTYVRNSNNFDKASSKNTLAQVNFYSKYYADNHWYLGIDLGYGKFQSNLKTNHNAKFARHTAQFGLTAGKAFNLGNFGITPIVGVRYSYLSNANFALAKDRIKVNPISVKTAFAQVDLSYTYHLGEFSVTPILSARYDTNQGSGKINVNQYDFAYNVENQQQYNAGLKLKYHNVKLSLIGGLTKAKQAEKQKTAELKLSFSF

SEQ ID NO: 14579 - protein, 815 aa, Haemophilus influenzae
MLNKDLGRLEYMGQVRAPRSLREGAAVRLMDGRGEGPLVTKVSAVAGLMAVASLSSAEAQPVADLPPVNVDAPVARAKPTSSKPSAEQVRARNALRRAARQQGAQQAAVAFPNAGGLTAPDANPYADAAEPYKVNRVQASGKFPEPLLNTPKTITVMSKEVLQDKHVTALKEIGRSTAGVTLGSGEGGNAFGDRFFIRGFDARNDVFIDGIRDPAVSIRENFFTEQIEILRGPASSYAGRGTAGGAINIVTKQAGDTNFKRMDTEFGTDQQKRVTLDVNQVVSPTFSVRTGGLFQDSNVAGRNYVTDDRWGAFLSTKWTPTEDLKFTTNYVHTDLSGYPDFGVPYYKQGNVPVTSAGIPRGTWYGFLNRDFQAARQDFGTGTMEYKVNEAITLTSKFRGEHSELNYIGTLPQNPNTTNPNPLLWTTTASAQSRFQTVDVWANQNDATFKLDTWGVKHTAVLGTEFSNENISIDRYTGLSSELFGGGSTSSGAVTGVNIYSPQYTNIPFGITPSLVGNPTRYGVNTNSVYAMDTAYWRDTIIVNGGVRYDGYNMGSSNNTSYLKMNADLVNYNVGLVYKPMPIGSIYAAYATSANPFGSELDATGTDYGGVPANSLILLGPERNKAAELGTKWELVDRHLLVSGALFQTTKDNARETVNSILTSGAAYRIQGIDIEAEGRLTDRWSIFGGLVLMQSKVTQSGIASNIGLQLANIAHQSFSMLSKYKFDNGWEVGGTAVYRSKVYGGTFAANTGNELPSYWRFDAFVEKQIDKNWTMKLYAQNLTNKLYYDTLYRSAVPFVAVAPGRAFYIITTAKF

SEQ ID NO: 14580 - protein, 722 aa, Pseudomonas syringae
MPGQQSQHRIRFTPALLTMGIWIATTQAAYAADTQGAEAPPATTMELGATEISSDQLGATTEGSGSYTTGAMQTATKLPLTMRETPQAVTVVTRQRMDDQAMTSINDVVRYTPGLFLDQSSGPGRQTYTSRGFDIDNIMYDGLPASYSGYTAGVQPNLAMFDHVEVIRGATGLTTGSGNPSAAINMVRKRPTADPQVSLTGAAGSWDDYRGVFDASGPLNDSRTVRGRIVGSYQDAHSFRDQEKSDHGVFYGVIEADLTDATTATFGLSRQEDQTNFFWGSLPLGADGHHLNLSRSTYPGTDWENKKIQIDTVFGELEHRFDNDWKLRVAGSSSTLDGVFSGTYLSRYNGPLETTAYQSRPDEKQAAFDTYASGPVQAFGRTHEVVVGTSRRVYDKTSKEYSPYDTGLPIGAPKPDFVRNGKTHNIATQDAIYLTTRLSLADPLTLILGGRLDWYDYDDRSGDEDFKVTRNLTRYAGLIYKLDDQYSLYASYTDIFNPQNYQDLSGKVLDPVVGKNYEVGIKGEYFNGALNASLAVFQIDQENLKTEAPTQAGCAVLTCYDAAGLVRSQGIDMELQGALTENWQVGAGYTYARTHYLKDFDPAKENQRFDTDTPEHLFKFSTVYRLQGALEKMRVGGNVYWQSRLYNDIALTDASYRLEQGSYAVADLMAGYQVNKHLDLQLNANNIFDRTYYTAIGASSVWGSTDVYGNPRSYALTAKYSF

SEQ ID NO: 14581 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDNQFYSIPSLLVEKLQVHRLVGGYDNNALYASVAAQQQDAKLYGTWRANSHNSQTEVAATAAYRFG

SEQ ID NO: 14582 - protein, 179 aa, Neisseria gonorrhoeae
GLKGGFGTIRAGSLNSPLKNTGSKVNAWESGKYTGELLEISKMAEREHRYLSARYDSPEFAGFSGSVQYAPKDNSGSNGESYHVGLNYRNNGFFAQYAGLFQRYGEGTKKMEGHSYNIPSLFVEKLQVHRLVGGYDNNALYASVAAQQQDAKLYQNQLVRDNSHNSQTEVAATVAYRFG

SEQ ID NO: 14583 - protein, 179 aa, Neisseria gonorrhoeae
GLKGGFGTIRAGSLNSPLKNTGANVNAWESGKFTGNVLEISRMAQREHRYLSVRYDSPEFAGFSGSVQYAPKDNSGSNGESYHVGLNYRNSGFFAQYAGLFQRYGEGTKKIEYEYQTHSIPSLFVEKLQVHRLVAGYDNNALYASVAAQQQDAKLYGARRANSHNSQTEVAATAAYRFG

SEQ ID NO: 14584 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSIPTLFVEKLQVHRLVGGYDNNALYVSVAAQQQDAKLYGAMSGNSHNSQTEVAATAAYRFG

SEQ ID NO: 14585 - protein, 179 aa, Neisseria gonorrhoeae
GLKGGFGTIRAGSLNSPLKNTGSKVNAWESGKYTGEFLEISKMAEREHRYLSARYDSPEFAGFSGSVQYAPKDNSGSNGESYHVGLNYRNNGFFAQYAGLFQRYGEGTKKMEGYSYNIPSLFVEKLQVHRLVGGYDNNALYASVAAQQQDAKLYQNQLVRDNSHNSQTEVAATVAYRFG

SEQ ID NO: 14586 - protein, 179 aa, Neisseria gonorrhoeae
GLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTWRANSHNSQTEVAATAAYRFG

SEQ ID NO: 14587 - protein, 179 aa, Neisseria gonorrhoeae
GLKGGFGTIRAGSLNSPLKNTGSKVNAWESGKHTGELLEISKMAEREHRYLSARYDSPEFAGFSGSVQYAPKDNSGSNGESYHVGLNYRNNGFFAQYAGLFQRYGEGTKKMEGYSYNIPSLFVEKLQVHRLVGGYDNNALYASVAAQQQDAKLYQNQLVRDNSHNSQTEVAATVAYRFG

SEQ ID NO: 14588 - protein, 179 aa, Neisseria gonorrhoeae
GLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQLYSVPSLSVEKLQVHRLVGGYDNNALYASVAAQQQDAKLYGTWRANSHNSQTEVAATAAYRFG

SEQ ID NO: 14589 - protein, 177 aa, Neisseria gonorrhoeae
GLKGGFGTIRVGSLNSPLKNTGANVNAWESGKYTGEFLEISKMAGREHRYLSVRYDSPEFAGFSGSVQYAPKDNSGSNGESYHVGLNYRNNGFFAQYAGLFQRYGEGTKKMEEYTYNIPSLFVEKLQVHRLVGGYDNNALYASVAAQQQDAKLYGTWRANSHNSQTEVAATVAYRFG

SEQ ID NO: 14590 - protein, 180 aa, Neisseria gonorrhoeae
GLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYSQYYSIPSLFVEKLQVHRLVGGYDNNALYASVAAQQQDAKLYQNQIVRDNSHNSQTEVAATVAYRFG

SEQ ID NO: 14591 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGLNGESYHVGLNYRNGGFFAQYAGLFQRYGEGTKKIEYDSQYYSILSLFVEKLQVHRLVGGYDNNALYASVAAQQQDAKLYGTWRANSHNSQTEVAATAAYRFG

SEQ ID NO: 14592 - protein, 179 aa, Neisseria gonorrhoeae
GLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYDGQTYSIPSLFVEKLQVHRLVGGYDNNALYASVAAQQQDAKLYGTWGANSHNSQTEVAATAAYRFG

SEQ ID NO: 14593 - protein, 1093 aa, Campylobacter jejuni
MKKSIFLSFIIVFNGYALSDQELIGSKEAYKLTITGDGINVGVIDSAINGEHPSLKDKVLEQTFSTVNGKTYAPDYSVDTHGSHVAGIIGAKYIDENNPHGVAYDTKFYGVQIFGNNKSSGAKFDTPNVYNYFKDKDVKIINNSWNSTLYPVVSMVEPGRYSLTLKNSSSTQLLQQIHSNQTAKELNNLAKEKKTLVVFAAGNEGIISPGIMALSPLYNEELRSFLAVGSVDSSQITKNQDGKLVVSPKGLSGFSNGLLGAENFSLVAPGSNIRNVNAAYMQPVVFGRPDNKLYRTQSGTSMAAPMVSGGAALVAQRFPFLNGKQIADVLLSTANKDYVAPKLTVKETTLKVIEGNKLVTKKLYTIFYIDNEVPTDKKQIEKDLIQAKYWDYYTIMNNLITNYHLLKESEYASIQKVSKESLFGQGILDVAKAMKGLATLDANRLNDSDVSSAYAGQNEAYYTLDTQNHNATFSNDINQKKWDESLHKKDATNLPTNLQNLNVGFIKEGSGKLILMGNNSYEGATIIKNGSLALNNKSENEKARIAGDVKILEGGLFSGNGEVGKNLENKGIVRAGNEDLSDLIVKGKYTQEGQNSKLQLDFGNDKNSKLIANSYEIKGGKLEYIPLPKFFTSGHYVSIDLGGLNTHLDQFSGVSVMGNNAVNFVAVLDQDKTSINKDQMPTPPTTKPTITPPTNPTTPPSNIIVKPVIKENAYETTNSTMGRSLRSIRSMHNLQDRYKDYFAFLDNTDTKTMEKTLESLEANSYMQSASGLYYQQHILAQRNMMNALNPSFTSGNLMASLEKDPLLTASIESDVFMDLGLLDKMDKRYIWNLSPNYKKINGDNFDGRSTGLNLTIGGAVNENSLLSFGLDVSDTRLDFENANLKNKYFNFSFNHILDLQNFKILSGASLARASNDMTRAIIGQNGSLSSNYDNLLSSLQLGLAKDFQVFNNLTLTPLAYFNYNFIKQDAFSENGNLVFAKSYDAINHHTTSLAGGLNLSYLLTQEAMQTKLGSFFIYEYKLSGKTIENNVRFKDFPNQDFVQYHRLNSNLITWGLTSYFIYPNSFFYGFNVVNEFASDQYNINVLGQFGFYF

SEQ ID NO: 14594 - protein, 696 aa, Pseudoalteromonas sp. BB1
SLSLSLSFLLHAEDDGFYMSAGYQIGEASQVVKNTKGIQQLSENYEKLNNFLTKYSTLNNLIQLSSSPSTINEVRDNLGSSGRNLLDVKTNSPAYQAVLLALNAAVGLWQVTSYAFTACGPGHNQNENGGIQTFNNVPGQNTTTITCNSYYQPGHGGPISTENYAKINQAYQIIQKALTANGSSGDGVPVLSNTTTKLDFTIRGDKRTDATPNEKLIYPWSHGEAISTSWTGGTRTSTSESINTENNAQELLKQASVIITTLNEACPNFQNGGSRYWAGISGNGTMCGMFANEISAIQGMIANAQEAVAQAKIVSENAQNQSNLDTTKPFNPYTDVSFAQGMLANAQAQAEILNRVEQVVKNFEKIPTAFVNDSLGVCYEVQGGERRGTNPGQTTSNTWGAGCAYVEETITNLSNSIAHFGTQEQQIQQAENIADTLVHFKSRYSELGNTYNSITTALSSIPNAQSLQNVVSKKNNPYSPQGIETNYYLNQNSYNQVQTINQELGRNPFRKMGIVSSQTNNGAMNGIGIQVGYKQFFGQKRRWGARYYGFFDYNHAFIKSNFFNSASDVWTYGFGADALYNFINDKATNFLGKNNKLSVGLFGGIALAGTSWLNSEYVNLATVNNVYNAKINTANFQFLFNLGLRMNLARAKKKGSDHAAQHGIELGVKIPTINTNYYSFMGAELKYRRLYSVYLN

SEQ ID NO: 14595 - protein, 364 aa, Wolbachia endosymbiont
LIVGAFAASAANTAVAYNNEGTKVELGGRLSVIAEQSSNTLDDQKQQHGALRNQGSRFHIKATHNFGDGFYAQGYLETRFVTDITKNHSDHFGDITTEYAYVTLGNKAFGEVKLGRAKTIADDITSAEDKEYGVLNNSKYIRTNGNTVGYTFKGIDGLVLGANYLLAQERHPTNHTDPVGELVPQTISNGVQVGAKYDANNIIAGIAFGRANYKENMRASVLQPDRKEQVEGVLSTLGYHFSDLGLLVSLDSGYAKTKNHKQVKSTATAATNKPACDEKRYFVSPGFQYELMEDTNVYGNFKYERTSSDEGKKTHEQAVLFGVDHKLHKQVLTYIEGAYARTKTNNTGNPEKTEKGKSVGVGLR

SEQ ID NO: 14596 - protein, 422 aa, Wolbachia endosymbiont
VTAGSTQFAVADAFVSDQAEAKGFIEDSSLDLLLRNYYFNRDGKSGSGDRVDWTQGFLTTYESGFTQGTVGFGVDAFGYLGLKLDGPSDKSGTGNLPVMNDGTPRDDYSRAGGAVKVRISKTMLKGGEMQPTAPVFAAGGSRLFPQTATGFQLQSSELEGLDLEAGHFTEGKQGTTTKSRGELYASYAGETAKSADFIGGRYAITDNLSASLYGAELEDTYRQYYLNSNYTIPLASDQSLGFDFNIYRTNDEGKAKAGDISNTTWSLAAAYTLDAHTFTLAYQKVHGDQPFDYIGFGENGSGGGGDSISLATSVQYSDFNGPGEKSWQARYDLNLTSYGVPGLTFMVRYINGKDIDGTKMSDNNVGYKNYGYGEDGKHHETNLEAKYVVQSGPAKDLSFRIRQAWHRANADQAEGDQNEFRL

SEQ ID NO: 14597 - protein, 730 aa, Onchocerca volvulus endobacterium
MTRVLSGSAALALVIGLAAPAFAQSTPMPTSTPTPASDQEIEEIIVIGSGSQVGLTGAYAGGQVARGGRAGLLGNLDMMDAPFATTAYTSALIGQQQAKSVADVLQNDPVVRVARGFGNFQELYVIRGFPVYSDDMTYNGVYGILPRQYVAAELLERVEVFRGANSFLNGAAPGGSAAGGSVNLVPKRAPKDPLNRVTLGFENDGQGYAAVDVARRFGQGDAAGIRLNAVRRDGETSVEGQDRELSVLAFGADYQGERLRLSADIGYQDHHIDAPRPSVTPLGAIPSAPDAARNFAQPWTYSDEEQRFGAVRAEYDLTDRITAWAAFGARDGKEDNVLANPDALADGTTSAYRFDNVREDTVYSADTGIRGDFATGPVGHRVILSGSAVSLKSRNAYAFSSFAGFAGNLYRPVAVTAPAADFFVGGDLSDPHVTERSDNTSLALADMLSFLDGTVLLTVGARYQSIETKTYDYNTGARLSGYDDDAVTPTVALVYKPTDQISLYGNYAESLRPGEVAPATSGSSPVLNAGEAFSPYTAEQYEIGAKYDAGSFGATLSAFTITLPSSIVEDNVFSVSGEQRNRGLELSVFGEPVEGVRLLGGLTWIDAELTRTASGVNEGNTAIGVPDLQLNVNVAWDVPVLPGLTVDARMVHTASQYADAANTTSIPSWTRFDLGASYEVDLAGRAVALRGRVENVTGKDYWASAGGYPGANYLVLGTPRTFILSAAVDF

SEQ ID NO: 14598 - protein, 732 aa, Shigella flexneri serotype 5b
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQALFNFSQGVALPDPGKYYGRGIYGAAVNGHLPLTKSVNVSDSKLEGVKVDSYELGWRFIGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 14599 - protein, 242 aa, Shigella flexneri serotype 5b
MAASLHLKNGFIMKYLNTLVILTSVVSTSVFAGAYVENREAYNLASDQMEFMLRVGYNSDMGAGIMLTNTYTLQRDDELKHGYNEIEGWYPLFKPTDRLTIQPGGLINDKSIGSGGAVYLDVNYKFTPWFNLTVRNRYNHNSYSSTDLNGELDNNDSYEIGNYWNFTITDKFSYTFEPHYFYNVNDFNSSNGTKHHWEITNTFRYRINEHWLPYFELRWLDRNVGPYHREQNQIRIGAKYFF

SEQ ID NO: 14600 - protein, 199 aa, Shigella flexneri serotype 5b
MRKLYAAILSAAICLAVSGAPAWASEHQSTLSAGYLHARTSAPGSDNLNGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 14601 - protein, 451 aa, Shigella flexneri serotype 5b
MVMSQKTLFTKSALAVAVAIVSTQAWSAGFQLNEFSSSGLGRAYSGEGAIADDAGNVSRNPALIMMFDRPTFSAGAVYIDPDVNVTGRSNLTGQNANANNIAPTAWVPNLHFVAPINDQFGWGASITSNYGLATEFNKDYSAGIYGGKTDLQTVNLNLSGAYRLNNSWSFGVGFDAVYAKAKIERYAGSLGPVLSQQLVGQGVPSQWTDGINSPDSQIAHLKGDEWGFGWNAGILYELDKDNRWGLTYRSEVKIDFEGDYKSSINPNLNNIFASMGLSSLPYGTGGATQNGSLTLNLPEMWEISGYNRVAPQWAIHYSLTYTSWSQFQELKAKGDDGQTLFYKDESFKDAYRIALGTTYYYDKNWTFRTGIAYDDSPVPANKRSISIPDQDRLWLSAGATYAFNEDASIDVGASYMHGQNVKFTEGEGPAAYSFKSDGKAWLFGTNFNYAF

SEQ ID NO: 14602 - protein, 363 aa, Shigella flexneri serotype 5b
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 14603 - protein, 746 aa, Shigella flexneri serotype 5b
MHQRHPLARQISLALLLGSTASHTFAAADNKPEPALETVTVTAQHREQTLQEVPVAVSAIKGTQLVADGVRAMGDITTFVPNASAKNPDGDGRPRWYIRGLGTGDTGAATVYPVGIYADDVYLNAPVAGGGPLFDLERIEILRGPQGTLYGKNTTAGAVNVISKKPTFDTDGYGTVGFGSKNERILNGAIGGTLVDEKLAGRVSLYSEERDGFQNNDYDGNTYGDVNKKAVRVQFLAQLNPDLDALLKLHSRQFKGDGSNGSLPVGRYYNVGYERPNGRDISLNVNEDYRLDHDGASLTFNWYLGDYTLTSISAYDYIRNRSTTDADYTPYEVNGAAITDNSYRQWSQELRLASPEDRPLHWLLGAHYFHEDLDSAAQRIVAPGPTPNGTGSNQVGTTAYRDLGFDHCTDSYALFGNVTYEFTDAFSVTGGLRWTQEKKDIDLDLVQLTRATANGPLIPIAGAGSNGNRQEDKTWEAWTYDLTPEYRINDNLRVFFRYAHGFRSGGFNTGLSTSLAQLTTVDPEELDAYELGLKSEWFDRRLTVNANVFYYDYSDIQVNLLTVNDGVLTTALTNGAKGKVKGAELELEGQPTERLHLRAALSFLDTEYTDFKNTNPTTGVVTGDYSGNSFVRSPRNVVSLGADYTLPLDVPGRVVAGGDVSFRDKEYFLADRQGSADATLSQPHYTLANARLSWFSADDKLSVTGFVNNLTDRRYQVHGRPNGGAGQYVITYGDPRTVGLSVTSRF

SEQ ID NO: 14604 - protein, 663 aa, Shigella flexneri serotype 5b
MFRLNPFVRVGLCLSAISCAWHVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 14605 - protein, 922 aa, Shigella flexneri serotype 5b
MSGDSGGQSSNYVNYSGFVYYNNTNGDFDQSFNGDTVNGTISTYYLNHDYADSTANQLDISNSVIHGSITSMLPGGYYDRFDADGNNLGGYDFYTDAVVDTHWRDGDVFTLNIANTTIDDDYEALYFTDSYKDGDVTKHTNETFDTSEGVAVNLDVESNINISNNSRVAGIALSQGNTYNETYTTESHTWDNNISVKDSTVTSGSNYILDSNTYGKTGHFGNSDEPSDYAGPGDVAMSFTASGSDYAMKNNVFLSNSTLMGDVAFTSTWNSNFDPNGHDSNGDGVKDTNGGWTDDSLNVDELNLTLDNGSKWVGQAIYNVAETSAMYDVATNSLTPDATYENNDWKRVVDDKVFQSGVFNVALNNGSEWDTTGRSIVDTLTVNNGSQVNVSESKLTSDTIDLTNGSSLNIGEDGYVDTDHLTINSYSTVALTESTGWGADYNLYANTITVTNGGVLDVNVDQFDTEAFRTDKLELTSGNIADHNGNVVSGVFDIHSSDYVLNADLVNDRTWDTSKSNYGYGIVAMNSDGHLTINGNGDVDNGTELDNSSVDNVVAATGNYKVRIDNATGAGAIADYKDKEIIYVNDVNTNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 14606 - protein, 978 aa, Shigella flexneri serotype 5b
MTLRAMVLATSAILAWPQMALAQDPTTDEAEPQGSVIIVTAQRQSQSLQEVPIAVSAFDATALESQQIENAADLQLTLPNVSFSKGNFTGSSFTIRGIGDLCVGVTCDAATAIHINGSPLFGTRLFETEYFDLERIEVLRGPQGTLFGRNATSGVVNLVTAKPDLGSFGAAGEFEYGNYNSIKAEGMVNVPIGDSIGVRVAGFFLNRDGYTTNLFDNSDVDDRDMYAVRGSLRFEPGADTTLDFMAYYFREDDTRLRNQKQACQRDPLGVLGCLNNRRDFDITNANSTVGATLSSQEFFAIQGIPSVLGLGSLYGPDAFAGFDKPDDVRTVNTAYTPFYFADEVQLQARLEQRIGAMTLTATGLYQDTEVDSRQDYFLGIQDRTGFATALNVLSGFAANGLPTGLPAPAPAFVPGSSAYFTPIVEALIPNGPGGVLCTSDNDDGNRGAFEGNVLCGETPLSFDRSSEQRESWSGEILLSSDFDGAFNFLLGGIYAKSKTTDNSYYVNSFALDYASAILGSFGTLAGGAPPSYFATSMYRNNSLEANLESFGVFGEIYVDLTERLTFTGGLRYNDDKKDVTARTTLISFLNPYANDGEPFDSPITPLTGPSGLFDADPGTPGEQLTQFREVGFDEITGRAVLDYEVTPDNSIYASYARGYKSGGINPPLSPVFDVAESFGSETIDAFEIGSKNTFANGALQLNATAFYYKYSGLQLSRIVARTSVNDTIDADIWGVELESVIRPDPDWLVNLTFSYLNAEVAGDQFFSNPRDPGGGDPDAVIIKDISNGANCAVTGPAPGAADAFVAGVNAALGLRGPEEFPNDGNLASSGAFSICDVLAGAVPAGSGLAVLSPGVEVNIKGNKLPQAPEMKVSMGVQYTATFDNGMTLVPRVDVALTGEQYGNIFNGRVNRIEPFVQANAIVQLNSADERWFVRGFVQNIFDSSSVTGLYLTDASSGNFTNIYTLDPRRYGVALGFSF

SEQ ID NO: 14607 - protein, 360 aa, Shigella flexneri serotype 5b
MKKLTVAISAVAASVLMAMSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 14608 - protein, 96 aa, Shigella flexneri serotype 5b
MKLKIVAVVVTGLLAANVAHAAEVYNKDGNKLDLYGKVTALRYFTDDKRDDGDKTYARLGFKGETQINDQMIGFGHWEYDFKGYNDEANGSRGNNL

SEQ ID NO: 14609 - protein, 790 aa, Shigella flexneri serotype 5b
MKRVLIPGVILCGADVAQAVDDKNMYMHVFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSSVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGNVSHQPYFGAEYIYSDAWTERHNQSESYVINAAGKKTNHTIYHKGKGSLGIDNYTLYMADRISWRNVSLMPGVRYDYDNYLSNHNISPRFMTEWDIFANQTSMITAGYNRYYGGNILDMGLRDIRNSWTESVSGNKTLTCYQDLKTPYNDELAMGLQQKIGKNVIARANYVYREAHDQISKSSRTDSATKTTITEYNNDGKTKTHSFSLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 14610 - protein, 961 aa, Shigella flexneri serotype 5b
MGIKQHNGNTKADRLAELKIRSPSIQLIKFGAIGLNAIIFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSGSDATINFSGTAAQRNSIFSGGSYGASAQTATAVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPDPTPNPTPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAHNGFYSDLVVKASRQKNSFHVLDSQNNGVNANGTANGLSISLEAGQRFNLTPTGYGFYIEPQTQLTYSHQNEMAMKASNGLNIHLNHYESLLGRASMILGYDITAGNSQLNIYVKTGAIREFSGDTEYLLNNSREKYSFKGNGWNNGVGVSAQYNKQHTFYLEADYTQGNLFDQKQVNGGYRFSF

SEQ ID NO: 14611 - protein, 136 aa, Shigella flexneri serotype 5b
MNPLVWCLRADVAAELRSLRRYYHLSNGMESKSVDTRSIYRELGATLSYNMRLGNGMEIEPCLKAAVRKEFVDDNRVKVNSDGNFVNDLSGRRGIYQAGIKASFSSTLSGHFGVGYSHGAGVESPWNAVAGVNWSF

SEQ ID NO: 14612 - protein, 424 aa, Shigella flexneri serotype 5b
MLSQSLPRQWVRHSPLLCASILAIPVKAELLEDSSARLELRNYYFNRDYREGTAPTREEWAQGFLLHLGSGFTEGRLGVGADAIGMLGIKLDSAPGRTGTGLLKVARNGRAEDDYSKLALAGKLKTSKTLFKFGTLVPPVLPTLRPNDGRLFAQMFEGGLLTSNEIEDLEFTAGRLSRVLQRNATQYTPLTLSPLNRRFEKLGATAEHFDMAGLDYRFRKQWLARVHVAQLQDIYRQQVFTLVNKSPWGAGTFSSDLRLSLMNDYGNAKGGKIDNRALQGLLGYAYKGHSLGLTYQRMLGDTGYANILGTDANLINLSVLGDFANAKERSWALRYGYDFANLGLPGLTINSRYISGSHAEITGSQRIGKSWELDNELRYVVQQGPLKNLSVRLRSALYRSNYAKNFIRDTDDTRLMFNYTWNIK

SEQ ID NO: 14613 - protein, 729 aa, Shigella flexneri serotype 5b
MLSTQFNRDNQYQASTKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 14614 - protein, 348 aa, Shigella flexneri serotype 5b
MKKTAIAIAVALAGFATVAQAAPKDNTWYTGAKLGWSQYHDTGFIPNNGPTHENQLGAGAFGGYQVNPYVGFEMGYDWLGRMPYKGDNINGAYKAQGVQLTAKLGYPITDDLDIYTRLGGMVWRADTKANVPGGASFKDHDTGVSPVFAGGVEYAITPEIATRLEYQWTNNIGDANTIGTRPDNGLLSLGVSYRFGQGEAAPVVAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 14615 - protein, 2008 aa, Shigella flexneri serotype 5b
MINVLKNRTRLCALTTSVFFFLQGMDVSMGASAGVGDSLISNPFVVSAGEGFPSYRCEVGTFGQIDRGPIYCDDGEFHKMKRGSITVPVYGSAAVTAIGKIESLPASADLQDDDIDNTFHKIKETTVELDAVLLKSKGLSYSDELVTFENGIFTHKFSDSDELVGFGSAVYSVLDAKVDLKRSNIRGFIVGLNAESEGIIVMRGGEVRRSFLGAEASDASFVVLDKVAINVDGIGLYSDGSGINMVSGSLVFPEEGIGGISTNYGSITLKNVNIQIKKAGNVEVDSVQDSDNDGPKSVGFLLHEGFVSFDDVTFNDSDAAVLYILGGLDNVVRQSVEYASVLSVEDVSSVEVADVSLEDLLRPEYVVRNNNFITPYRKGQPADNNAFASAVSTMSAVLNEIYDDKGAFQATRAFKVSASIKSSNITLNGKESYGIYFKGRERDEEKLLSSSGANEAARVVLLEDTKLNVPDGLAIYGDEGSKSYIILGKKSRLSGNLSLKAEPNSIMSVFAHDSTILGGVVTDEHANTELFLSGNSSWHLIKSKDKGWKCSEADNYIDSCISAISLVDSSIKFVSSQSDQAHAGGYQTLRIGDESTLSYGVYNSLGGSAIYLNAHVISDDSGHTQMVSDKLLIYGFVSGETTVHVNDVVRRGGNSNTVRLEETQNKSHSVSMIQVYGLAREDSFQLSSPYVTMQGSPYQYTLRAYKMENSEKTFEGDLESDDTAEWWDFRLESKVQDGDTSTYLLYIPGSPINGVEEVAYTVVDGDDDLSKPSVLGRSEIAEDLIGDLSLVVVPSTLPERSASVASAELERSETEDEVSVILNPSSVETSIPPTVSGNSAGPVRGGQSAPVARSESDGGVTVVLSPSSVETSTPPAVSDNSAGPVGGEQSASVARSESDGGVTVVLSPSSVETSTPPAVSDNSAGPVGGEQSASVARSESDGGVTVVLSPSSVETSTPPAVSDNSAGPVGGEQSASVARSEESAATPYTVFTALQGTTESRPVGRILLSTPVKSTVVSTESRDPAPIISAAASPQPSVMQSIVTSKPSASVDSAGKESVSSQCNDRGRNGAETLQNSYLCNDGQTHTVTDLTLKASGALQHPMHAKSQNTIIKLEGATIMGAADSENNVDLTKLQLVSTVLAEDGAEVVLDKKSTVKNSSIGLEAQKGGKVKMTDGTVNARYVGVLAGSGSSVNLSNTKINVTGDLAIAGLASNAGEATMNTGVITLTSGVAVRSESGGNVKLDNVKITAKKGQQDQPDSAETFGRAAFLVSDRGSVEFTNGYVSTDANGLWMRDSNDSVENSTSDTGTSRRKRSSDVRPSLNRAHIELSDVKVEGDKSYGIYFDGTGRKEGSQQNRNRVLEEAVTELSGTGSTIEKVSVVKRSTVSQKEKTPIDITGAVSLKKTRFEVINGIAIYGNNSGGQISLEENTILSGDLLLSAENNSHISVSVDDSIIEGWARIDKSSYAKLDLINKSEWILKRSVKRNFATPDSGCIDSCVSSIRLVNSTIDFVPSESEDLYQTLHIGTGNAKVYEAHGDVAIFLNARLNPRDPSDQQVTDRLVIHGDVEGKTRLHIRGVSDIVGEGKDNNQIAHSVSIIQVYGQAEKDSFQLDGNYVALANSPYKYVLRSYGPQLTAKQEHIEQKFIKDGGAFWNFRLENQYVKPSVPTDGLVLDERADGFVLPERVVRSVVPQVPTYLLLPNNLFHVGLMDIGDQNKQLETLRMSAGGMLEVHENPALFLRGYGGHYRYASDLSALEYGYGGHLRYNAVKAGILLKTIESADNVVSFGVMGSYGKLSLQPKNVEHSEESTFDKWSITAYSTLQHDAGFYVDGLLSYGLFKGDVVTLARGKTATLKSKPLSVSLTGGQSFATGYEGFVVDPQVQVVYQNLQFDKARDIDNFDVEMGKLDQWVARVGGRLSKSPTGSEGISATSFYGKLYLVHGFRKKQSVHFKDAFQLGAFGSSLEAGLGFNTWLSPKFALHGDVVYQQKLTKAGFSGASFSGGLRYQF

SEQ ID NO: 14616 - protein, 468 aa, Shigella flexneri serotype 5b
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSFGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 14617 - protein, 746 aa, Shigella flexneri serotype 5b
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYVTTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSKNKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 14618 - protein, 351 aa, Shigella flexneri serotype 5b
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 14619 - protein, 761 aa, Shigella flexneri serotype 5b
MSVVVSLVGVMGCLSPAGAADTENGERAEDSRMDEILVTPQGRVADEVTNAPAVVETRTAEELKRINLVDSSDVFRNMPDVYVRKLYPGTTNRPLAIRSNPASMTARSLVLVDGIRISDFTNSSNSNGPKWQMVAPDEIERIDLIYGPFSAAQSGNSLGGTALISTRMPEKREASVEAGYTYQHAKEYKTSEDMHGYNAHASFGDKAGPLSFMLWYDRLETRVQPITYMTSPVSAGKAASGSAAGGFLSDTDPKGQQRYIFGSTGTTYVINDTAKLKLAYELPDESQLRFNFVFWDATQDTDSPDSYLRDANGNTIYSGTFDVNGRSYTLSPSAFYYQKSHKQDMLYALSYTRNPDKGVKLTASLSYYDIYKDQTRKSSTAPPLAEHGGAGTVGDNGGGWYTADLKVSHDLNWLGTHTVAGGYHYDQYMVDSETWNASNWKSDIRTTLSKGEKGKTSTHALFLEDSWNITPQWTLYLGGRYEWWDGFDGSKSTDTGSGRVTTRLPDQGYHDFSPKFAITYKPTPDWSLRYSLGIANRYPTVGELFYGGINSSGIITNPNPDLKPEQVLAHDFTIIRDLWGHGEARLSFFQNEVKDAIYSQTNYYTNVTNYQNVDEVRTRGVEVSVDLRRLPLEGLGFSANAAWADARILKNDTVPDSVGKQFPRVPKWRTKFTLDYAPTERWFVAFSGNYASKPYNSLDNSDTRGGYGGLDDYLIFDTRASYKVNENLTASFGVDNLTDVLYHESHPYARRTFYASMKYTF

SEQ ID NO: 14620 - protein, 273 aa, Escherichia coli O6:K15:H31
MAKFTKTLIAAGLLAAAATPAFAADYSGDIHKNDYKWMQFNVMHTIDQRPTFTEDGNYNDTYLEMEFGGRSGMFDLYGYVDVFDIFNSRHSDKHDKGNIFMKFAPRLSLDALTGKDLSFGPVQELYIATLNNVDDSMMENMIGLGTDVQVPWFGKVGMNLYARHATESGFAAEDGDWNGYQFSMNWFKPFYTFSNGSFVSYQGYLDYLFDRDTHGDDFYSSNGLGTFHGIYWHSDRYAVGYGLKYFNEIYGLNNSDLTKSTGFGHYFSVTYKF

SEQ ID NO: 14621 - protein, 446 aa, Escherichia coli O6:K15:H31
MSQKTLFTKSALAVAVALISTQAWSAGFQLNEFSSSGLGRAYSGEGAIADDAGNVSRNPALITMFDRPTFSVGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTPQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 14622 - protein, 1246 aa, Escherichia coli O6:K15:H31
MNMRIIFLRKEYLSLLPSMIASLFSANGFAAAIDLCQGYDIKASCHASRQSLSGITQDWSVADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSDSKHPSGYTIINNTAFTNNTAEGYGGAIYTNSATAPYLIDISVDDSYSQNGGVLVDENNSAAGYGDGPSTAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFVHSLTGFQNGTLNIDAGGNVTVNQGSFAGTIEGAGQLTIAQNGSYVLSGAQSMALTGDLVVDDGAVLSLEGDAADLAALQDDPQSIVLNGGVLDLSDFSTWQSGTSYNDGLEVSGSSGTVIGSQDVVDLAGGDNLHIGGDGKDGVYVVVDASDGQVSLANNNSYLGTTQIASGTLMVSDNSQLGDTHYNRQVIFTDKQQESVMEITANVDTRSTTTEHGRDIEMRADGEVAVDAGVDTQWGALMADSSGQHQDEGSTFTKTGAGTLELTASGTTQSAVRVEEGTLKGDVADIFPYASSLWVGDGATFVTGADQDIQSIDATSSGTIDISDGTVLRLTGQDTSVALNASLFNGDGTLVNATDGVTLTGELNTNLETDSLTYLSDVTVNGNLTNTSGAVSLQNGVAGDTLTVNGDYTGGGTLLLDSELNGDDSVSDQLVLNGNTAGNTTVVVNSITGIGEPTSTGIKVVDFAADPTQFQNNAKFSLAGSGYVNMGAYDYTLVEDNNDWYLRSQEVTPPLPPDPDPDPTPDPDPTPDPIPAYQPVLNAKVGGYLNNLRAANQAFMMERRDHAGGNGQTLNLRVIGGRYHYTAAGQLAQHEDTSTVQLSGDLFSGRWGDDGEWMLGAVGGYSDNQGESRSNMTGTRADNQNHGYAVGLTSSWYQHGNQKQGAWLDSWLQYAWFNNDVSEQDDGTDHYHSSGIIASLEAGYQWLPGRGVVIEPQAQVIYQGVQQDDFTAANHARVSQSQGDDIQTRLGLHSEWRTAVGVTPTLDLNYYHDPHATEIEEDGSTISDDAVKRRGEIKVGVTGNISQRVSLRGSVAWQKGSDDFAQTAGFLSMTVKW

SEQ ID NO: 14623 - protein, 375 aa, Escherichia coli O6:K15:H31
MKVKVLSLLVPALLVAGAANAAEVYNKDGNKLDLFGKVDGLHYFSDDDGNDGDQTYMRLGFKGETQVNDQITGYGQWEYQIQGNDAETTNNSWTRVAFAGVKFGDAGSFDYGRNYGVIYDVTAWTDVLPEFGGDTYGADNFMQQRANGLATYRNTDFFGLVEGLNFALQYQGKNGSASGENDVADGRSLLKQNGDGFGGSLTYDIGEGFSVGGAITSSKRTADQNSAGVYGSGDRATVYTGGLKYDANNVYLAAQYSQTYNATRFGSSQNSRSDSYGFADKAQNFEVVAQYQFDFGLRPSVAYLQSKGKDISNGTTNYGDQDILKYVDVGATYYFNKNMSTYVDYKINLLDDNTFTRNAGISTDDIVALGLVYQF

SEQ ID NO: 14624 - protein, 659 aa, Escherichia coli O6:K15:H31
  misc_feature (421)..(421): Xaa can be any naturally occurring amino acid
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAXSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 14625 - protein, 1836 aa, Escherichia coli O6:K15:H31
MQRKLKLSFCALMTSSFFVKIANADGVATLKEKLLTPVVINEQLEETKKLLSKVRGLKEKKEGAKMIVHEKTLERRKSSEEEKKGLENLLFEVLTNSIINDGATIYITNRVSEGSEINSFSYEDAAYSINNTVQEGGKLYIDAASVSRDTIIEHGGIEFVQSLSTSEYAVVKKGGQQIVESGANAEGTKIHGGEQIIFGKGILGEGSSRKDKESSAYGTEIYAADGMPGIQSIYSGGMAVDTRVMKGGVQNLDGKENFNNISSEDADTADIEEEDFTINEGAFALNTELFKNGMQNIFAGGNASEVTLYHRATQKIYDSGYTDDLTINHQARSWAFAGAILDKDTNVHDFGSLYLYAGNDEAVTEVENLNLNGEDTKLYIIASEDNSKKPHVNIQNLKGNGRVIFTSLGIGKHYSELNIDNLSGSLHFDFNIDFVKHLKDYLVIKESGSGSHTISVADSGGEMTNSSHKKFKLISDHSGNAHFTLTNTFGEKIETIDAGTYRYRLKHRKDKGTGKIWYLDANYAVDEANTSLFSDFSLQPSVMAPLSNDLTEFVIEKGMIVTIADPSFDGNSEKVDSNGETSISNTVKDGGKLSVYNGGFSLYTTIERGGTELIGRQGLSQDSTVKRRGKQKVEDGGKIEGAKIYGGEQFVSGKSDIKGAMVKSSAYDSVISGDNGALGYQNVYDDGEVFNTKIMEGGVQSLYVEQDLDDYSSFAFDTKVFSGGQQHVLAGGIAIGVLLQGNAFQKIDLGGYVKDLTIKDQAQSWLHSGATLEGSTMIHDSGRIYLYAGADQSRTEVETIVLNGKDTKLYAIASKMDGESSLIENLSGDGSVIFTSTVFNPHYSKLEVGNLSGSLHFRLNTNFEEQRGDYLLIEKGEGHHTISVIDSGIEIANSSLETQNLVLELDLINEKSGNAHFALSDFSGEEISAIDGGVYMYDLKKKDHNGGKIWYLAPLGTPSTPVIPAPHAEYPVNKLPEKEENITPSKDFSISDVINFSIREGGGILQNFWLGDDRVVYISYDGEQGALRQSINTTVAGSGTLYVEAGGFVKNTTIENGGAEIVGEQGISESTIIYEGGKQKVEGGGSALRAEIYGGEQLVFGDGYVDGGIVGSSVYDTTIHGQGDIPGQQNVYDDGMAVGTKVMSGGIQTLAKWFPGDDNFAEKNGGLAINTEVFSEGMQHVLAGGEANTVILHTGGVQEVYAGGIVKNLKIEDNANSWVSAGAVLGGEIKVQDFGGLHLDAGNDTQQTIVENIALNGEEAQLYAIASEFDDKSTHIQQLSGVGKVIFTSSEDSLYYSKLYVDELSGNLHFDFNVSLAEGKGDYLFVKNGSGFHTISVLDSGIEIVEPSSAELDLILDQSGGASFTLQSFSGAKIPIVDGGTYMYGLKQRIAEGGGQKVWYLSAISIDNSSFLNSLPRSRSRSARHLSQNQPISSLSTLTATKERAIKLSGQRENRQNLSQKSPASVSLAISTQEKQVTEVSDSSALPPLSEEKQQGAVSTSSHSLADQMILCPSAQEQPSPQLSEKLSVSDFLTTPSTDAVLSMFVAPAMVFHNEMQSVRAGRGILDKSKKNTVLWTYAIKSKESITTEHIDFKLDQTGIVLGINGLSEWENGDFYIGGFGSYDHARVAHARGGTSGINSYGIGAYVTYLDHSGWYLDSILKYNHYQNTLKAVSTNGLGIEGTYTQWAVGSSFEVGYRLQTSQSSWLQPYGQFTWLKVEGKEIKLSNDMTGDMRPFTSLRSEVGLSLGYEFGSRMNSSSLAYITAAWMREHKDDNQTLINQRHPFTTDVSGNAGKLGIGLSSLVSEKLKFYGEAHYIKGRKTKQSLQGIIGVRYSF

SEQ ID NO: 14626 - protein, 945 aa, Escherichia coli O6:K15:H31
MWVQPRDSRAQQGRWSLLTGGSWRRLCGVWLVLQAWGAFAQEGPPDAGPPVPTEVGLHRTDAGFALEAAPPGDAGTEPVFLPPSLREDSPAQYPPQLAAEQVTGSVRLELLVDEAGEVESATLVEGVHPLLNEAALHAAPGLRFVPATLNGQPVPVRLGFEYRFEAPRLEAVPAGDGGTEPVLAPVTLKGLVRAKGNRRPLPGAVLVSEAAPDAPVETDAAGRFEARWPPGSQWVRVTSPGHKPLSFKENVRPGETLEVVYGLEPLVLNPYETVVRGDRERTEVSRVTLHDAELREVPGTLGDPFRVVMLLPGVGSMLSGVAYPVVRGSQPSSTGYFLDGVRVPILFHLFLGPAVLHPDFIDTIDFYPGTPPPQYGRLMGGAINGRLSRPRDDRVHGSVYADLINAGFFIEYPFQSTGTNVSLAGRYSYTPWVVAIAANSLQEPPPPGRKNDKLVLDFWDYQARVEQKVGRGQTRLFAFGSSDTFGEKAQDALGSTALQTILFHRVDLRHQHPLGPGQLEAGVTWGLDRLGVVSRDPDERTEFHVDNLTFSARARYDMKVSERLSLRTGADLDHTRATVQAFYPETDDDGVTRDRVINAPVSLGLFTGAYGELLWQPAERWTVVPGLRLDNYHLSPRVNRFAVEPRLSVRHALREDLTLKAGAGLFHQAPTTLISLPVVDVAGLEYGLQQGLQFSLGAEWRGWEAFEVGLDAYINPMLRTVELTPFSGDSFDEDDIGDPVDDDNDVGRPELPDLTRHGLAYGLEVLIRRPLGGAWFGWLSYTLQRSTRFTRFTRHDAQGTELGKVEKNLPFVFDQTHILNLVVSRKFGSNWTLGGVVHFNTGRPEAGQLGSQTQREGVVDGRPGWVEVDRDQVDRLPSFFRFDVRLSRSWAYETFTLEAYLDMLNVTIHKEVVGFDYLGGFGRPLVKEAIGVPVVLPILGVKGRY

SEQ ID NO: 14627 - protein, 108 aa, Escherichia coli O6:K15:H31
MESKSVDTRSIYRELGATLSYNMRLGNGMEIEPWLKAAVRKEFVDDNRVKVNSDGNFINDLSGRRGIYQAGIKASFSSTLSGHLGVGYSRGAGVESPWNAVVGVNWSF

SEQ ID NO: 14628 - protein, 85 aa, Escherichia coli O6:K15:H31
MQMRITIKRWGNSAGMVIPNIVMKELNLQPGQSVEAQVSNNQLILTPISRRYSLDELLAQCDMNAAELSEQDVWGKSTPAGDEIW

SEQ ID NO: 14629 - protein, 346 aa, Escherichia coli O6:K15:H31
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPVDKISARGMGESNPVTGNTCDNVKQRAALIDCLAPDRRVEIEVKGIKDVVTQPQA

SEQ ID NO: 14630 - protein, 760 aa, Escherichia coli O6:K15:H31
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEDYWVADAKLGYRVNRNLDFQLNVYNLFDTDYVASINKSGYRYHPGEPRTFLLTANMHF

SEQ ID NO: 14631 - protein, 465 aa, Escherichia coli O6:K15:H31
MRTFSGKRSALALAIAGVTAMSGLVIAPEAKAEGFIDDSTLTGGIYYWQRERDRKDVTEDKYKTNLSHSTWNANLDFQSGYAADMFGLDIAAFTAIEMAENGDSGHPNEIAFSSSNKAYDEDWSGDKSGISLYKAAAKFKYGPVWARAGYIQPTGQTLLAPHWSFMPGTYQGAEAGANFDYGDAGALSFSYMWTNEYKAPWHIEMDKFYQNDKTTKVDYLHSLGAKYDFKNDLVLEAAFGQAEGYIDQYFAKASYKFDVVGSPLSTSYQFYGTRDKASNGTVNDIYDGTAWLQALTFGYKVGQVDLRLEGTWVKAEGQQGYFLQRMTPTYASSNGRLDIWWDNRSDFNADGEKAVFFGAMYDLKNWNLPGWAVGASYAYAWDAKPADMATPDAYYDPNYRLKESSYSLDASYTLQDGRAKGTMFKLHFTQYDNHSDIPSYAGGYGNIFQDERDVKFMVIAPFTIF

SEQ ID NO: 14632 - protein, 750 aa, Escherichia coli O6:K15:H31
MNKKIHSLALLVNLGIYGVALPAMADDATASGASHEDTMVITAAEQNLQAPGVSKITADEIRKNPPARDLAEIIRTMPGVNLTGNSTSGQRGNNRQIDIRGMGPENTLILIDGKPVTSRNSIRLGWRGERDTRGDTGWVPPEMVESIEVIRGPAAARYGNGAAGGVVNIITKKFDDQWHGSWNTYLNAPEHKEEGSTKRTNFNLSGPLGGDFSFRLYGNLDKTQADAWDINQGHQSERTGMYADTLPAGREGVENKDVNGVVRWDFAPMQSLEFEAGYSRQNNLYAGDTQNTNNDNSSNGLVKKNYGKETNRIYRQNFAVTWNGGWDNGVTTSNWAQYEHTRNSRLGEGLAGGLEGLFNSNKFTDTDLSDVMLHSEVNLPIDFLVNQNLTLGTEWNQQRMKDMSSNGQAQQGGTIPGMSDNRSPYSQAEIFSLFAENNMELTDSTMLTPALRFDHHTIVGNNWSPSLNLSQGLGDDFTLKMGIARAYKAPSLYQTNPNYLLYSKGQGCYASGDGVGCYMMGNDDLKAETSINKEIGLEFKRDGWMAGVTWFRNDYRDKIEAGYAPIDQTSLGKTKTDIYQWENVPKAVVEGLEGTLNVPVTETVNWTNNITYMLQSKNKETGDRLSIIPEYTLNSTLSWQVHQDVSVQSTFTWYGKQQPKKYNYKGQPVTGSESDEVSPYSIVGLSASWDVTKNVSLTGGVDNVFDKRQWRVGNAQTTGNDKTGAYMYGAGAYTYNEPGRTWYMSVNTHF

SEQ ID NO: 14633 - protein, 995 aa, Escherichia coli O6:K15:H31
MHSWKKKLVVSQLALACTLAITSQANAANYDTWGYHDNTTTDLVWPYDTDNDGIADAGGMDPMGSDGNYVTYNGFVYYNNANGDFDTVFKGDTVNGTISTYYLNHDYASGSVNQVDISNSVIHGAITSELPFGYYSITPAEVNAKGEVVTPQTYNGYNFYNGITTDLDYNWYDGDVFTLNVSNSTIDDDYEALYFTDTYLDGDKSKSTNETFYTALGVAVNLDVESNINITNNSRVAGIALSEGNTSNTTYTSEYHQWDNNINVSNSTVTSGSQTPLEESNGFFGKSAEPSDYAGNGGENDVALSFSDNAGSNYSMKNNVNFDHSTLLGDVEFTSHWNNDGVFFYSTGHDSNGDGVLDTNGGWVDDAQNVDELNITLNNGSKWVGSANMSAEVIAPADMYDVAPNSLTPGATIEANDWGRIIDNKVFQSGVFNVALNNGSEWNTVNSSVIDTLAVNNGSQVNVTDSSLVSDTIGLTNGSSLNIGEDGLVATDHLTVDSYSTVNLTESTGWNNYSNLYANTITVTNGGVLDVNVDQFDTEAFRTDKLELTSGNIADHNGNVVSGVFDINSSDYVLNADLVNDRTWDTAQANYGYGVVAMNSDGHLTINGNGDVDNGTELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 14634 - protein, 1376 aa, Escherichia coli O6:K15:H31
MNKIYALKYCYITNTVKVVSELARRVCKGSTRRGKRLSVLTSLALSALLPTVAGASTVGGNNPYQTYRDFAENKGQFQAGATNIPIFNNKGELVGHLDKAPMVDFSSVNVSSNPGVATLINPQYIASVKHNKGYQSVSFGDGQNSYHIVDRNEHSSSDLHTPRLDKLVTEVAPATVTSSSTADILNPSKYSAFYRAGSGSQYIQDSQGKRHWVTGGYGYLTGGILPTSFFYHGSDGIQLYMGGNIHDHSILPSFGEAGDSGSPLFGWNTAKGQWELVGVYSGVGGGTNLIYSLIPQSFLSQIYSEDNDAPVFFNASSGAPLQWKFDSSTGTGSLKQGSDEYAMHGQKGSDLNAGKNLTFLGHNGQIDLENSVTQGAGSLTFTDDYTVTTSNGSTWTGAGIIVDKDASVNWQVNGVKGDNLHKIGEGTLVVQGTGVNEGGLKVGDGTVVLNQQADSSGHVQAFSSVNIASGRPTVVLADNQQVNPDNISWGYRGGVLDVNGNDLTFHKLNAADYGATLGNSSDKTANITLDYQTRPANVKVNEWSSSNRGTVGSLYIYNNPYTHTVDYFILKTSSYGWFPTGQVSNEHWEYVGHDQNSAQALLANRINNKGYLYHGKLLGNINFSNKATPGTTGALVMDGSANMSGTFTQENGRLTIQGHPVIHASTSQSIANTVSSLGDNSVLTQPTSFTQDDWENRTFSFGSLVLKDTDFGLGRNATLNTTIQADNSSVTLGDSRVFIDKKDGQGTAFTLEEGTSVATKDADKSVFNGTVNLDNQSVLNINEIFNGGIQANNSTVNISSDSAVLENSTLTSTALNLNKGANVLASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNTWSGSLNAPDATVSMTDTQWSMNGNSTAGNMKLNRTIVGFNGGTSSFTTLTTDNLDAVQSAFVMRTDLNKADKLVINKSATGHDNSIWVNFLKKPSDKDTLDIPLVSAPEATADNLFRASTRVVGFSDVTPTLSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASAGLYSGKTKSWGGGFYASGLFRSGAYFDLIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDGRMLYGVGLNARFGDNTRLGLEVERSAFGKYNTDDAINANIRYSF

SEQ ID NO: 14635 - protein, 1042 aa, Escherichia coli O6:K15:H31
MLMKRHLNTCYRLVWNHITGAFVVASELARARGKRGGVAVALSLAAVTSLPVLAADIVVHPCETVNGGTLVNHDNQFVSGTADGVTVSTGLELGPDSDENTGGQWIKAGGTGRNTTVTANGRQIVQAGGTASDTVIRDGGGQSLNGLAVNTTLDNRGEQWVHGGGKAAGTIINQDGYQTIKHGGLATGTIVNTGAEGGPESENVSSGQMVGGTAESTTINKNGRQVIWSSGMARDTLIYAGGDQTVHGEAHNTRLEGGNQYVHNGGTATETLINRDGWQVIKEGGTAAHTTINQKGKLQVNAGGKASDVTQNTGGALVTSTAATVTGTNRLGAFSVVAGKADNVVLENGGRLDVLSGHTATNTRVDDGGTLDIRNGGAATTVSMGNGGVLLADSGAAVSGTRSDGKAFSIGGGQADALMLEKGSSFTLNAGDTATDTTVNGGLFTARGGTLAGTTTLNNGATLTLSGKTVNNDTLTIREGDALLQGGALTGNGSVEKSGSGTLTVSNTTLTQKAVNLNEGTLTLNDSTVTTDVIAQRGTALKLTGSTVLNGAIDPTNVTLTSGATWNIPDNATVQSVVDDLSHAGQIHFTSARTGKFVPTTLQVKNLNGQNGTISLRVRPDMAQNNADRLVIDGGRATGKTILNLVNAGNSGTGLATTGKGIQVVEAINGATTEEGAFVQGNMLQAGAFNYTLNRDSDESWYLRSENAYRAEVPLYASMLTQAMDYDRILAGSRSHQTGVNGENNSVRLSIQGGHLGHDNNGGIVRGATPESSGSYGFVRLEGDLLRTEVAGMSLTTGVYGAAGHSSVDVKDDDGSRAGTVRDDAGSLGGYLNLVHTSSGLWADIVAQGTRHSMKASSDNNDFRARGRGWQGSLETGLPFSITDNLMLEPQLQYTWQGLSLDDGQDNAGYVKFGHGSAQHVRAGFRLGSHNDMTFGEGTSSRDTLRDSTKHGVSELPVNWWVQPSVIRTFSSRGDMSMGTAAAGSNMTFSPSRNGTSLDLQAGLEARVRENITLGVQAGYAHSVSGNSAEGYNGQATLNVTF

SEQ ID NO: 14636 - protein, 1055 aa, Escherichia coli O6:K15:H31
MNVINQILIKRKTMKSDLSRNKWKAYAALLLCAGLIAGHPLVMRAESNGQSVQTVQQQQIRVKGTVNDTMGPIIGASVVEKGNISNGTITDIDGNFVLSVKPDAILVISYIGYQSQEIQAVPGKVISIVLKEDSEMLDEVVVVGYGTAKKSDLTGSVVRADIKALENSPSVNIFQGLKGVVPGLNIGTSTTAGGNPEISIRGRNSISGTTGPLIVLDGIIYRGEITDINPSDIESIDVLKDASSAAIYGSQAANGVLMITTKNAKGMSKPIIEYSGSFSFQSLINHDLKRLDKDGFLNQLADLKIGESRMGDDLLQRNPNFDPTLSFRDENIAGGYLNGTNVDWEGLLTESVPYIQNHSLSVRGKGDLSSYFLSFGFTDQKNLVVNDTYKRYNIRVNLDTEITKWLKVGTQSFFTLSDFSGVAPSFSNVIGMPVFVSPYKEDGKTLKEQNYMGNVNPLLAIQNPNTDKRYLLNGTFYADVKLPVKGLSYRVNYSNAMTFYRNYKFEPYANSQLGQGYKKNSHQSEWTLDHILTYKNDFGKHSVNATFVYGVEKRSYETTTATGYNFTNKSLGYDYMEAAQSDLNKITSEAWEEASLYNMLRLGYTFDGKYMFTGTIRRDGFSGFGKNNKFGYFPTAAIAWRINEESFLKDKQNWIDNLKLRLSYGMSGNRTTGRYSTMAHMSTKLPFSTSGSESPGGYVFGDGATGQLTQVVSKMSNLDLSWETTTAFNVGVDFSVLNARLFGNFEFYVSNTKDLLYDINIPNMNGMFSSTVPTNIGKLKNVGYEFSITGVPVRTKDFEWSVTGNFSLNKNKVVSILGIDADGDGREDDLVSSKIFMNKPYGVVYDYNIIGMWQVEDYNKGIIPSGFTYGTYKIEDIDKDGKYTADMDRKILGYTDPLYRFSIQNDFKYKNFNLKVFINAVQGGSDHYLGQPASGIPTPDNLSTWSFYKFDYWTPENPDAKYRQLGTYTEALGAGFSPYVSRSFIRLQELSLSYNLPQDWLKKIFISRAKVYISATNLFTITSWDGWDPEIGMGLTYNTNYPTQKNYTIGVNFEF

SEQ ID NO: 14637 - protein, 351 aa, Escherichia coli O6:K15:H31
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAKAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 14638 - protein, 253 aa, Escherichia coli O6:K15:H31
MSAKRRLLIACALTTIFYHLPAYSSLEYKGSFGSINAGYADWNSGFVNTHRGEVWKVTADFGVNFKEAEFYSFYESNVLNHAVAGRNHTVSAMTHVRLFDSNMTFFGKIYGQWDNSWGDDLDMFYGLGYLGWNGSWGFFKPYIGLHNQSGDYVSAKYGQTNGWNGYVVGWTAVLPFTLFDEKFVLSNWNEIELDRNDAYAEQQFGRNGLNGGLTVAWKFYPRWKASVTWRYFDNKLGYDGFGDQMIYMLGYDF

SEQ ID NO: 14639 - protein, 227 aa, Pseudomonas fluorescens
PMSAWYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHA

SEQ ID NO: 14640 - protein, 149 aa, Pseudomonas fluorescens
ANVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADAVKDQKGFGFAYQAKAGVSYDVTPEIKLFAGARYFRSYGASFNKETVSHY

SEQ ID NO: 14641 - protein, 290 aa, Pseudomonas fluorescens
VAAMADVTLYGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVS

SEQ ID NO: 14642 - protein, 164 aa, Pseudomonas fluorescens
  misc_feature (4)..(4): Xaa can be any naturally occurring amino acid
YVYXYNNGQILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFD

SEQ ID NO: 14643 - protein, 120 aa, Pseudomonas fluorescens
CPISDEETSYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAA

SEQ ID NO: 14644 - protein, 691 aa, Pseudomonas aeruginosa
VSSYASGDNRYGVYANTGGDIRLNGGVDVQTNGVNGYGFYAESDSSEIFATGAKISTSGDSAFGVYSFNGGDIRMENSQIITSGRGAHAVRIDDPANAGESRVSMKKSTLSTSADATHGVSFGTDGSFDLYDSAITTRGADSAAIHIAAGASATVISDSKLVSERGSAFLSEGGSMAALIVKSHIAGAKALWELNAPTSELEIEANSVVLVGRTTQVNGARSELSMYGESTWWVTGDSQVTELTTSSSAIRFTPVNGANPALYRTLTVEQYYSDEGELTLNTHLAGDNSPSDRFVIDGGRARGSTLVQIRNSGGTGAQTKNGILVIDAINGATTTTDAFALEGRAVAGPYEYRLLRGATDGSNAEAWYLRSEKINNQPDEPLYRPEVGAYLANQFFAQQFLTHTLDDRRGDQPASPAQATQRLPHASWLRMTGAHAKGNTGDGNHSAKTDVFTLHGGADLYEQASADGQGKTYAGLMASYGVGSSRARADGNPYRANGRSQAWSLGAYGTWYGNDLTRLGPYVDTWAQIGTFRNRVEGQLLEKEKYQAHGWALSAETGYAAALSGRWVIEPQAQLIYLGYRQSGFTENTGVRIGSANADGLLTRLGARLYHQADTFQPYLAANWWRSSIEPTVRMDGKRIDNMYPQSRYELKTGLNARLAKGWTGWTSLSGNWGKQDYREYALRAGVQYQF

SEQ ID NO: 14645 - protein, 164 aa, Pseudomonas fluorescens
RSICYTMAQILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFD

SEQ ID NO: 14646 - protein, 152 aa, Pseudomonas fluorescens
AASFDMRHEYKSHTDQHATRVKLGDSIDNFLVDIEAKFKGEDGKFMEDLKNNGWELGLNYRHVLNDNWTMTYGMPIEGRESGVTYKPQVRATYKVDSVDGLSLSARYRYDMRQNTSTTEYELDGNGDIVGVEKNIENQRRHRLTANVNYSME

SEQ ID NO: 14647 - protein, 427 aa, Pseudomonas fluorescens
AASPQLATAAPFVSDQAEAKGIVEDSSLNLLVRNYFFNRDNKDGARDQKDWTQGIWGNFSSGYTQGLIGVGVDAFGYLAVKLDGGDGTSGSGNMSRSDTVNANGSRDVNDSQGKAGGAVKVRISKTELKFGEMQPSTAPVFAVGGSRILPQTATGFQLQSSEVKDLDLEAGHFYSASSQDKNARDGGLFATYGGVEANSIDYFGGKYGITENLSASLYGAKLEDIWNQYYANLNYTIPFGGDESLNTDGNIYNTQDNGDAKAGEISNTAYCLAAAISFMQAHTISPAFQRVNGDIPFDYIGVGKNNRGRDSIFLANSNQYSDFYAPGEKSAQVRYDLKMAEYGVPGLSFMTRYVKGRDIDGTKTPVGSPYAALYGEDGKHTDPNFVAKYVVHFGPAKDLFFRIRQACHFANADEGEGHTTEFRLIVA

SEQ ID NO: 14648 - protein, 146 aa, Pseudomonas fluorescens
ARRQTDAITIGATLPWGTWRRPLWGGELRGHWDVSLSRWSFDGIGGHNSAVVVGVAPTLRLRPDEGRSPWFWEAGIGATVASHRYRVQDHEFSTRFNFASHLGLGRNFGAQRQHELMLSVQHVSNAGIKSPNPGENFLQLRYALHF

SEQ ID NO: 14649 - protein, 137 aa, Pseudomonas fluorescens
SDHDFDRTRMLWLWGFDDSIKEWGWLTLEGHLELGFGQTTPTPPDVSIGLTPILEWTVERGPWRGFVETGLGAHYLTRTTHEDRDLSTHFQFGETLGAGARYKNLQLSLRFQHLSNGDIVKPNNGYNFYGIALKFWY

SEQ ID NO: 14650 - protein, 184 aa, Pseudomonas fluorescens
GYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTV

SEQ ID NO: 14651 - protein, 952 aa, Pseudomonas fluorescens
SSAKTLQISYIGMQTAEVAIRPVVKIILKPDTEVLDEVVVTGYGTFKKSTFTGAASTMATEKLQDIPTMAIEDKLAGSIPGVQISSFSGAPGATTSVRIRGMGSMNAGNDPLYVIDGTPVQSGNISAFNTPNTGEGYNSTGTNVLATLNSNDIESITVIKDAAAASLYGSRAANGVIVITTKRGATGKTQFNFRSDWGFSNIAVNYRPTLNGDDRRELIKFGLKNYYMDEEGMTAAQAEIALEDDIDAFAAKPVNGWTNWKEILFKNGSHQNYEISAQGGTEKTKFYTSLAYAKQEGITARSGLERMTGNANLSHETGRVKVEASTLFSRILQNMTNEGTSFASPIMNAFWTASPSTVPYNEDGTFSSNFPLTNGANPVQTRTYNYDRNAITRSFNTLAATVTLWDELKLREKIAFDYTSSIESVWWDPRSNDGRSSNGVFQRYNRTLETLTTQTQLTYIKTFAQKHNLDALLGFETEDFTDSWVYTHGSQYPGYKNEIANAGETSSNSNRDKSRLTSFLGRVNYNFDNTYYAGVSYRRDGSSRLSRDNRWGNFWSISGSWRFMQESFLESIKNVITDGKLRLSYGVNGTQPSTFYSYMINMYRAGQIYNGQSGMGVIGIGSPDLKWEKNKAFNLGLDLTFWDRLSLTLDYYTRKTNDLLMNKRISYVPGYYDPISFAPTTLQNVGSLENKGVEISLSSTNMQTQDLIWTTTFNIGHNKNKLVKLDGIQTDEIDGALIHRVGEPYYSYYMFEYAGVDPKTGNEMYYKNDGTNETTTLTSEAQKVIVGHHDPKVEGGLTNFVKWKFIDLNLTLTYSLGGKAVDYATWLHDNGGTYTSYGAVPSYYKLEDMWKQEGDNAKLPKFKYGNSRVLSSRWLMPTDYLRLKNLSLGFSAPKGLLSKMGISKARVYFSANNLLTWKSKDLLVDPEMPVDGLCTFEMPALRTYTFGLEIGF

SEQ ID NO: 14652 - protein, 126 aa, Pseudomonas fluorescens
NDNNDMATEVGIEYRFSPLKSVYNLIPAVGFTVNADQAYWFYGGVRYDFPLNKKWVLTPNWAISYYNEGDSTDLGADIEFRTGLELAYKLSANSRLGVGGYHLSNAGLASRNPGSNSIILSYNFSF

SEQ ID NO: 14653 - protein, 70 aa, Pseudomonas fluorescens
GTNIDDGTNRGDGSEREIWNQFKYVVQSGPAKDLSLRARASWLRVSNNADQYNVGGNEIRLFADYPINVF

SEQ ID NO: 14654 - protein, 329 aa, Pseudomonas fluorescens
ATVYNQDGTTVDVNGSVRLLLKKEKDMRGDLIDNGSRVSFKASHDLGEGLSALGYAELRFSDDVKDKDGNVVNQPIGNKVHAKRLYAGFAYEGLGTLTFGNQLTIGDDVGVSDYTYFNSGINGVLITSGQKAINFKSAEFNGFTFGGAYVFSGDANKDALRDGRGFVVAGLYNRQIGDVGFAFEAAYSQKYVKQKVEQPQPLPPGQVERFKDEKEKAFLVGAELSYAGLALGVDYAQSKVTNVDGKKRALEVGLKYDLNDKAKVYTDFIWEKEGPKGDVERTRTVAVGFGYKLHKQVETFVEGAWGRTKDADGTTTKDNVVGTGLRVHF

SEQ ID NO: 14655 - protein, 433 aa, Pseudomonas putida
VAGAASTQMATAAPFVSDQSEAKGFAEDAYLTETLMNYYFNRDNKYGGRDQNDWTQGFQGNFTSGYTQGMVGVGIDAYGYLALKLDGGDGTSGSGNMSRSDSVMPNNGARDVNDSQGKAGASVKFRVSKTELKFGDMQPSTARVFAVGGSRILPQTATGFQLQSSEVKDLDLEAGHFYSASSQDKIARNGGLYANYAGVEADSIDYFGGIYSITENLSASLYGAKLEGIWNQYYANVNLTTGFSGDTSLNTDFNIYRTTDTGDKLAGDISNTAFSLATALSFLKAHTFTLAFQKVNGDSPFDYIGVGKNNRGGDSIFLANSIQYSDFNGPGEKSVQARYDLKMAEYGVPGLSFMVRYVKGWDIDGTSTPAGSPYTGLYGEDGRPHETIFEAKYVVQSGPAKDLSFRIRQACHFANADEGEGDTNEFRQIVDYA

SEQ ID NO: 14656 - protein, 388 aa, Alcanivorax borkumensis
MMVNFMTKKKNRMQDCKMVCKNFNRKESVLIAQSLDISKKGSVILGALLSSLWLTNPLNAHEKNGAFVGISLEVGRADQKTNAYRNGELFQVPFGDVSANDDGKVPDGQTGGCQPASGTPGTPGYTKANCVVNWTSRTMLSTNKDIPGRNQPMYGLGVMTGYKHFVGKKRWFGLRYYGFFDYGHTNFSNSRAANAISPFYLSDQKADMYTYGFGTDMLFNVIDKPKATAGFFVGVNFAGNTWTNNRVGYFKDGYVYGVNTDADAYMTNADGTITCGDTTPASCNVGINPNSVYTTGKLNAKVNHTIFQFLVNVGIRTNIFEHHGIEFGIKIPTLPNYFFKGSTTIRAKKQGPLENGNPTTITGAETNFSLTQTLRRQYSMYLRYVYTF

SEQ ID NO: 14657 - protein, 793 aa, Alcanivorax borkumensis
MKMKRILYYSLVLLTAGNGMLQAQNWIHGKVVDKEERPVDGVAVVLQTLDSTYIDAVVTDSLGAFMLNKEAGPNYRLLFQHLLYEPVCKKISTADAGTISLTEKDYELEGVVVKAERPQVKVENGALRYDVPQLMKDKAVSNAFEVVKQIPGVISTDDAVQLLGAGSPSIVINGQLTTMSVDQLVGLLKTIPASRVCNVEIMYNAPAKYNIKGAMINVVLDKETVERNTLQGETGVDYLQRHYAEGKVHGNLLYSTSRFNIDFLANGAKGRNYMGEEIQALHTLKDQVTEVNQSGRGTRSGIDGTMRLGMDYTFKNDDRLSAAYYLTAGKSDLERTAVTTFQALKSGQPVEERLSRTYIEGNSALHNVRIQYDGNSGLMAGADFTRYHSPGFQTFVDQSHETTVTDMQNNSKQDISQGALFINHSHTFETGWALNYGVHGGFTSSKTYIDYLYNKGNGYESALDELENNRQKEYSGNAFLEVSKDFGSHFSATASLKVEYFKSDYTSNGMKSTLWNDWTLFPNATLSYTVNPMHIIQLDISSDKTYPSYWDVTPQESPINSYSVILGNPSLKPYRSYSGQLIYILKQKYTILAFCDYVPDYFAQLPYQNTSELKNVFRYENMDYQLQFGVGVIVPFRVGEFWNSQVTLSGQRMQEKLDHFHDLSFHNEKYTGQFKMDNTFTLSKSRPNLKLDLNGYFVTGAVQGIYDLGHLYDVSSALKWQFADDRATLILKCNNIFRSNMPHTMEINQSGQYSRLWKLDDQRCVTVSFVWKFGGYKKKQHEAVDASRFGKSM

SEQ ID NO: 14658 - protein, 391 aa, Alcanivorax borkumensis
MKKYLAIPAAVACLLASAAHAQSSVTLYGTIDAGLDYISNQKSAAGAGPVYGVQSGNVSTSRWGLRGNEDLGGGLAAVFTLENGFNVANGKLGNGGDEFGRQAWVGLASRQWGTVTLGRQYDFLVDFVAPLSATGSGFGGNLADHPYDNDNLANDTRMNNAVKFRSANYGGFTFGGAYGFSNQGGGFSNDNAYSVGAQYVNGPVDLAVAYLQSNQPGGVDAPQNTGGSLSSADGDAMLTGGRWRTFGAGAHYAFDHAAIGFVYTRTILNDPRELSQGGAYGRVNGQLLTFSNYELNGRYFLTPAFSLGGAYTFTQGRFDDADHGIAPKWNQFMLQADYALSRRTDLYLEGVYQRVTGADGVAVLGHAGIFNLAASGNDRQAVVAAGIRHKF

SEQ ID NO: 14659 - protein, 708 aa, Alcanivorax borkumensis
MGRSTVGRSALLSSVAIVAMTVGAEAQDPQDRGGVYQLGEISVSGAGQGGGGVGGSTVTREETWTFEKNTLEQAVNLVPGVVSTQSTAGQRNETDIFVRGFGRWQVPLMIDGVRVYLPADNRLDFSRFLTNDIAEIQIQKGYASVLDGPGGMGGAINLVSRKPVKPYEGEFMSGATFDNRGSFQGWNSYAMVGSRQQDFYVQGSANNLNQDFWSLSRDYRPYRAQGPYAGSLEDGGRRNGSDNRDWRINFKAGYTPNATDEYSINYIKQVGEKGAPLNVYNNPPSSQNSYWRWPAWDIQNLSFASNTQIGDASYLKTKLYYNTFYNVLSAFDDITYTTQSNNGRFDSYYDDNARGGSVEAGTELIPMNTLKAAFHYRQDFHTEWNDNRPTSPTFHFTEPKQNQSQATWSAALEDTFHVTSNFDLVGGISYDKYRIDKAEEYNNAGFIYEYPKGGADAFNWQTAAIWRYSEAGQLHFSVSDRTRFPTIFELYSQRFGTAIPNPNLGPERATNYELGWKGRVAPDLRGSAAIFYSDVRDLIQAVRLNPSQSQTQNINKGDFYGFEMSLEAQLSPQLVLGGNYTFIERNVSDVSVPGFQPTGVPTHKAFLYASWRPIERLTITPSLEITSDRWSDVVVGTQAQNAPILAAFPDPYIRTGAYTLANINLNYKVIENFEVAGGVKNLLDQNYELAWGLPQPGRTFYVKARATF

SEQ ID NO: 14660 - protein, 152 aa, Alcanivorax borkumensis
MFDFSDNTLFIKPFAGVNYYFSYTPSHTENGAIAKDIDSMKNNSVSIEVGAEFRKYMNENSYIFVTPKIEQFVINSGDDYTANLAVNNAFFTSVEANNKKKTYGQIIVGGNVDFTNQLSMNLGFGAKQILAGKVDNKNETYLSGQVGLKYKF

SEQ ID NO: 14661 - protein, 544 aa, Alcanivorax borkumensis
MKRSLFNCAHPFRQRWSIGCLAVALSCASLADEAPPAAAGAEPQRLVDINEYVVRGNTVLDNRAIEAAVYPFLGPQRSLGDIEGARDALQAAYQEKGYQSVYVELPEQQVSGGVVYLQVTETTIGRVRVVGAKHYSPVELREEVPALEEGKVPDFAQVQRELAQVNRTPGRQVLPMVREGQRPGTMDVDLQVEDKNPWHASIGLNNDYSADTRHLRSVVSLGYDNLWQLGHAISLTYFTAPQDQDNAKVWSGSYTAPLSQRWSVQLSGYQSDSDVATVGSMNVVGQGHSYGVAAIYSLPVTGLWSHSFSFGVDFKDFEEQTRIGGNNDRVPIKYAPLTLGYNGFRYTERSQLALGLSLVAGTGSLLGYGDDDEEFDRKRYRAKSGFGVLKGDLNHTLTFGGDWQVATKAAFQLASGPLISNEQFAAGGATSVRGYLAAENTADDGYLLSQEWRTPSLGRFLGKRAGGYVNDWRFYVFAEGAQLRLQDALPEQDDDFSLASVGIGTRAQLADWLSGSLDWAFPLLEGTNTDKHDSRLHFSVQASF

SEQ ID NO: 14662 - protein, 227 aa, Alcanivorax borkumensis
MVFQVRYLTSVLLLAMTSGLAAAASVDIRHEYVPDRDGDEHRDRIYVSHRFDNQIGFSVEAKWNYKDGHMGNAGHETGVSYRWKATDNFSLTPGINIDASPSGASVFKYNLTGAYKINDEWDVAARIRHGYKNTDDSRYNQLNLYANRKFEWGKLGVEAEYKDIHGGEGGWKDKGHDQLIDFKGEYTKLESGVIPFFAIAAITHKGDGSEFKDEYVPRFRVGLKYNF

SEQ ID NO: 14663 - protein, 353 aa, Alcanivorax borkumensis
MKQQRILPLSTALLAGFAALPAQADLEVTPYGSLRIQTEAVSVDQAQPGEDDSYTGLRDAYSRLGVTAKYDDFEHFNITGTVEFPINSARLQAEDPTFFQESYKGNNKPRVADITVAHDRFGSVRVGTQWLAYYNNVAYPLDFFSSFYSGYATQATFRRDALTYTTPSMGGFTATVSGVDLTDQQGTSYLDTMQYALSYAVTDSLAFGIGYQDSEQDSAKHADQAGISAAWSPGNWRFAAKVEQLLTNDDTVQDDDPVTYNLLGSYSWNKYTLRAMVAHGEETDEGDAFFQGDSAQVGLDYRHTENLKFFAEYFYEELGYAIYTPNSESFNPLAGYQVESDGQVFTVGMRFDF

SEQ ID NO: 14664 - protein, 695 aa, Alcanivorax borkumensis
MTFRNRMLAGLLGTACLFAASAAVAQEAAAGADPAEGNDIVVTARQRSESLQQVPDSVTAFSARTIEEAGIRSIDDVTALMPNISLVDSQDAGTVAINIRGIGQVRNGEAPVALVIDGVQMTSTDMIKQALLDLDQIEVLKGPQGALYGRNAIGGAINITTKRPTNDLQGRVSVDYANGDDRRLSGTLSGALVPDRLLFRIAGDYRKFDGVFRNVTLDRKVDFVEDLNLRGRLIFTPTERLTIDLRGAYGDLKAGASWYIPLPDGQPNDSSVPIQNDFLGRSPRTVKDGSLKVDYEFDPFTLSSISAFNTTRIDLSEDLDWFPQSILGATQLRRYESFTQEFRLASPSTQRLRWTAGAYLLDARRRVDTVVLISPDPTASKLPPSAYIPLPAARATEDILTKAAYAQLNYSVTDTVELTGALRYDHDRREQTNRLVPGPKRKANFDEWQPKVSIKYSPTPDTMIYATAARGFRSGGFNPPNAVFPAIYKPEVADTLEIGSKNSLLDRRLTLNAAAFYMRYKDQQVFILNVADQGIVNVGKTDIYGFELEAQARPVRNLQLGASLGFIDTKIKDFDGTARFRGNRVPLTYRWSYTAFGQYRVPVGGDRGIVARVDYSGRSGNYWHIDNADRQDAVHLVNARLTFDAKRYSIALYATNLFKERYTEEFFAKEFSAGAADIRYPGQPRRYGVSATLNF

SEQ ID NO: 14665 - protein, 464 aa, Alcanivorax borkumensis
MGNRDTRRRRARPGTVRPLSRWLGATLVACATAAHAAPQPDGDTASRWQAGADGIGFWPGGDADGFDAHAWTTDAEPARGARNPSSSDGRQPDTVPLTARKITLGQRTGAAARACAAAGDDGADGIGFDDTGAGGGCDPAATHDAPADDAAARGVVHADRMPYELHPVDPSRLPDLPAAQAPPLLEQLMGDDRNMVGLGWHFVGTTGRSTPVTTHTDALGLNSFQNAGSSLSLSNTNTLAFTFTHFVSEHWAAELGAGIPPVLTLRGHGSIALPLDRIFAGVHGRFPLIDLANTQSNPLATTRAWLGSVVFKYYLGERDDRFRPFAGLGISYTRFTNTNLNPVFQRKLASLGGLLAAGADIGSLQSLLLDPALFQRIWDAGGDLLLSGRTNVSAKVKSVWEPVFTVGASYQITRRFWITGMVTYIPLRTRITLDISQPNRTLASNTFDISANPVLATVLLNFRF

SEQ ID NO: 14666 - protein, 919 aa, Alcanivorax borkumensis
MKLRFLLLSLFFATAMFAQNGTVTGTILDKEFNNEPLAFANIVIKGTKQGTSTDENGKYSISLKPGNYTIVIGYLGYETKEIAFTIKANEKKVINHTLVASGVQLQDIEIVHIVSKEKESALLQEQQKAVEIKQSIGAEEISKKGIGDVAAAVAKTSGISKQEGSSDIYVRGLGDRYNSTTMNGLPLPSNNPSTKNMSLDVFSTDIVEYIGIDKTFNYKNYGDFAGANVDIVSKTYRGSGMVEVGTGTGFNSNAISQNKFYLQDGPNFHGFSNQAIPSNPLAGYNFTTSWDKQAVTPVNGSFYLRGGDSYGIGSNGKLSFFVNASFDNGYTYKEGARRGSVNTQAIAGKDFFRQSYEYSTGSNAMANINYKINSNHNIKFNSMYINSTSQKHEEFRGIIDIFDAAPDGGGFVRRSTFERTSLLINQLLGNHTLGNRTNFDWGVSYNMMSNVIPDRMQNTFVPLDNDNPNVSPLIVSNLNKSDNHRYFQDMTDDELAGNFTLTYKFGKREDDTFKGKLIAGYSGRYKEINFDATQFNFKINSQEIIDINNIDGYFNQNSFNLGYFDIQTFRGGLSVPNALSPQNYNGQQIISAGFGAIEYQFTPKLFVIAGFRSEYIIQDIFYSTSLKTGKKLTDTVEYLPSLTAKYEVSEKQNIKFAASKTYTLPQFKERAPFLFEEVGQSYFGNENLYNSTDYNFDLKWEMFPKNGEVLSFTGFGKYIQNPINQVTVASATNDISWVNSGEKAIGLGIEGEWRKSIISKENITTGEKTNLGFGLNVSYLYTNQDLDTQKVIVENPGISVAFTNQESRLSGASDLLINSDLSFNKEFKNDKSLTATLAGGYFSDRIYALGVTGKGDLVDSEVITVDFILKFNLSKNIGIGFSAKNLTDPTIERKQDIQDIVVDSYKKGRNFSLSMKYSF

SEQ ID NO: 14667 - protein, 1677 aa, Alcanivorax borkumensis
MQGLIKNDKVTSTIDGKLEDKSKTLTIKGNKETQKSPVYLYSTTIGANENTEVNLYGLKGQHFLIGGKGIIKKDDKGDKFLDFMASDKNAVVNVSFLEAKHNPASPSWTDYYKNQKAGVFNIDILNGTLNLNIGNKSRSKDNTTAEKINVIGKNSILNASKTSVRPAMSFLIDEGGKANFADTYVYSPEILVKNGKLNAENGGLLQTQKFNVGKDGEVNINNVRIKGTNTGVNNTITIDGGKLNVTDPKIQAKNFIITNNGIVNLTSEKPADEKLLNEDKAKDEAVFIEYGGGINVDSGKFIAKNLPLYNKGSIIIKNGEFDIKDSKISTSQYFYVKEGGKATLDNTKYTGQEGINVEKGGEFKAKNKSNINFTNQSSHINGKAIFDDSTINSDTIFIKDGGEFIVKDSTAKIKQVTAQKGGKAEFLNSTIEKHKKGNYFWSADGGDISFINSNINNISSLGAENDGAINLVNAKINDISGIFVHDGKFNAIDSVINLKNHFVIRDDKGKAILDNSSLKASSLGGHIDLKNKVTLDIEKDKYTYRRKGADHSIDIYANVENATDIIKKGKSNLTFKDYKDNFKGNLNVEDGSLTLDGDFTLAKDKTLSMKYQGQNGGILKANKMDLKNGNLFVNLQKDASGVETTIAKTKDGLSFDKSKAKLEDNSLNSAYSLIQKDNELILTKKALDGRLILSKLDHVIKKDSKVYVDSSEPDYIDDAHNNSQNGKNEKGQIVKVKTEGAKLVIADVNVKSKGEGENKDNESFDITKDSYLLINNSKSEVDGLNILENSTLKLQEKSDITATNLYVDKTSKMSMEKRDSAGRDDKVNMRVINAKLDGIANIGKDSTFIADNLNLGQNSKIDSKGTLETKNLNLTGSNIEALNLKIDKKATMNGGNLNIENAEFNGEITIDKNTNLKANIFKAKNGNLNINDANIDLKDATINSKVDVKNSAMKIENAEFNGEITIDKNTNLKANIFKAKNGNLNINDANIDLKDATINSKVDVKNSAMKTEKLSLAGNSTFDNVKYTTKHFEFKGDSSLLIKNSVFNTTGDSSFIVSGDTNIDNSQTSHINMTLGKDKKTTAAIDNKTTLTVKNTLTFGPNDATLNLNNDAVLKVSKIAKDTSGSHNINVTNSTVELLDGGKLFSGFKDNDLNFKIKNAIFKTDGEKTINHSISGENFTKIGKGTIKIPFKNWRNTKVKEGVLNFTDGVVFKNEKLAISNGAIVKGDKDVTLDKSSTLEIGAKGDGIENIQTGKLIANTLKIDGATLSVKDEAVKNLKNGDIIKQNKFLEYQKLIGWFNPTILEDLTFYDLSFTKEKDILIGVVPRAKDMLLNAGMHRLWGLGDIIDAGLIDNTLGDIMLKDNITANDLKTIQPLISGAGIQVISDAGKISRDAILSSSTYKSDKNFWAKTIGSFSHKSSTNDGILGYDADHYGTIIGFDGEIADNARLGFAVSYTKSDIDGDINQNIKSDTYQALIYSDIYAINDLRINLLAGVGFSENEGDKTVSIIDKTIKSKYDSKFYQAGFGIYKDVSLSNSFSLTPYFRADYIHVKNDAYTENGDEFLALSVDKQDFDSLELQAGLESKYLINDKFSLFGKAGLIVETMDDETKIDFSLISNPSKKAQIKSDAKNDLLGVVGGGFDYMPTDSLKLEFKYNGKFGDDYNNQIIGLGLNYRF

SEQ ID NO: 14668 - protein, 762 aa, Alcanivorax borkumensis
MIVTATKRAESVMDVGLAVQALSGDFLRTVNTDDVKDLVTFTPGVTGNSKDSFLDTIAVRGITTNDFGNGADPSLGVYKNGFYQGRNGAAVTSVFDLERSEILRGPQGFLFGRNSIAGAMNIISRRPVQDDADAYIDVRAGERGIFRVEGATNFDVSDAISVRVAGLHSREDGYVNNEITGEDFIQHEKSALRLTGVYDDGGALTATLFLEYEDRDQSGTIYRATGRGASYEFLEGIYGDIALPSDPRDVRIDGPRNGLFDGGEVFQLGLELNYDLGWATLTSLTGYKTHEYGYTEDFDATSLTIFNYEQDQEGEYFEQELRLTSDNEGMFNWYAGVSYYREDIDTEFLGQQDEDVYCNVYWGDNCQGVFDYYNAYGLSDYLEYYFGTSTWTPSSNNGLIDDWNRTEGVFQGWAAYVDLQFRFSDQLDASLGVRYNDDEKEFSQRVLSERNGSLLGQVVQTGFTTPEGAVSDTLSWSEPTWRGVVNWRPVDDMLVYFSVTTGYKQGGFNSFSVAGVPFGGEALPGVNLPTSFDSETVTSYEIGYKATQWDGRSQLSVNAFTYAYEGLQTTCSEPGSPIVEVCNAELDGIGAEGVWNVALTDILSFGLGISWLDTEGSNIQSQCTGGLALLGDDTICEGSPAPGIPEWTAYGTIDAVLPFGSGELYGNLSASWEDDAVTDWEPFIPATVAAGLQETGSYTEVQALGGYRSDAGWALALYVENLLDDEYYDAEGGISIGGQPYVQSSISPSRPRTVGMRFTWNL

SEQ ID NO: 14669 - protein, 1055 aa, Alcanivorax borkumensis
MKKNLILFLILLCNCTFLYAQQFNITGVVTDKKLKEPIIGASVIVKGTTYGTVTDLDGNFTLQVSKGNVLVISFIGYTTQEIKVNENQFSYNIQMSEDTQTLDEVVVVGFGTQRKANLTEAVATVDTKVLDSRPVTNLGQSLQGTIPGLNLSVGGLGGQLGQTMDVNIRGTGTISTGSKAATLVLIDGIEGNMNNLNPDDVESISVLKDAAASSIYGSRAAFGVILITTKKGKAGKASVSYSGNARYAGPNHLPDLMNSYQFANYFNEGSINGGGKAIFDEDTMERIQQYMNGQITTSTIANANGNWQFHEKANDNVNWYKTHYKWAWSQEHNLNINGGSDKSQYYVSANYLDQDGNLRYGKDSYERISTNAKFNAQPFKWLDIEVNTKYVYTKLDNPLYSDMNGLFYHDVVRMWPTMPFKDPNGYYMRNGKLGQLTNGSRSITSNNNVYLQGQLVFHPLKNWNIYANVGLRLIDQVQRQNLNKVYEHNVAGEALELAYGGEYAVGQTGAMQYWTKANHLTTSLYSDYSFSFDEHQFKVMAGVNTEKYNNRYLSVKRMDLITESIPEIGAATGEDKINEASAYTWATAGFFGRINYDYSNKYFIAGNLRYDGSSRFLRKDRWGLFGSFSLGWNIAAEDFFSVNENIINQLKPRVSWGTLGNQNTKSYYPMYLLQTVKTNGGSWLMGDSKPTVAGMPGTLSSSLTWETVQSLNIGFDLGMLRNRLNINFDYFIRKTLDMVGPASEVASIYGIGMPASNNTDLRTKGWEIAASWRDKIGQINYNIGFNMADSRSFVDKYPNESKSLSTYYKDQELGAIWGYVTHGIAKSQSEMDEWIKDNNPSWGSGWGEGDIMFKDLNGDKVINEGANTVDDPGDRKIIGNSTPRFRFGLDLGCEWKGIDFSMFWQGVAKRDLWLDGPMFWGISGGEWQSTGLKEHLDYYRPENTTSVFGPNTNAYFPKMYMSKDMNQKVQTRYLQNGAYARLKNIQLGYTFPTQIINKLHMQKLRVYVSAENVLTITSLPSGFDPETTYSSYSDGNSGKTYPLQTTISFGLNATF

SEQ ID NO: 14670 - protein, 863 aa, Alcanivorax borkumensis
MFTASVFILTTQSVLAETDGGNSVDIGDKSKSVSSIPQLSEVKPPQTNAALLLTQNPDAEEIVEVTGVRINQTEKGVEVILETAKGDALKPVQKNEGNKLIIDIPNSQLRYEGGDTFRQEKPFAGIAEVLVVNQDNNTIQVTVTGETGLPIVELFDGDEGLIFGVTPATTTAQQPQTPQAQEKPAIEIPQEEPAAQQDEPIELVVTGQQNGYRVQDATTATKTDTPLRDIPQSIQVVPREVLEDRNVRSLAEAVETVSGVVDGADYNGSPAQDFIIRGFEQGGSFRNGYRDVNSYGLTGVGTIERVEVLKGPASVLFGAVEPGGIINVVTKQPLSEPYYQLGFEVGNRAFYQPSIDFSGPLNADKTLLYRFNASYQSSDGFQDFVNTNLTTIAPTIAWKLGDRTDLTLYYEYINFKGTFEQYTSILSDNTFLPRSFYQAYPNNAYVDNTTQKLGYTLSHKFSDNWQIRNNFSVVTSKNAEEYTLATGVVNDQSLRQFAQDREFTQDNYFGQIDLLGKFNTGSISHQILIGFDFNHNIDTFARVVQRNVPNLDIFNPNYNIPSFDYGPRSSSTERFQTYGIYLQDQITFLDNLKLLIGGRFDWISGENTDNVTGDTTQNPDSSAFSPRIGLVYQPSKSVSLYTSYSQSFVPETGVNPDGEIFEPTRGTQYEAGIKADFLEGRLSATLAAYQITKSNILTPDPDPERAALDYLIQVGEQRSRGIELDVAGEILPGWKAIASYAYTNAEVTEDNDIPVGNRLVSVPKNQASLWTTYEFQNSDLKGLGFGLGLFYVGTRSGDSANSFEIPDYLRTDAAIYYRRDGFKAGINIRNLFDTDYIRTSDDGRTFLRRGAPFTIIGSISWEF

SEQ ID NO: 14671 - protein, 479 aa, Alcanivorax borkumensis
MRKPAFGVSALLIALTLGACSMAPTYERPAAPVADSWSGAAAQRQGAAIDTLDWKSFIVDAELRRLVDMALDNNRSLRQTLLDIEAARAQYRIQRADRVPGLNAAATGNRQRQPADLSAGNRSEVASSYQVGLALPEYELDLFGRVKSLTDAALQQYLASEEAARAARIALVAEVSQAYLSYDGALRRLALTRQTLVSREYSFALIDQRRAAGAATALDYQEALGLVEQARAEQERNLRQKQQAFNALVLLLGSDDAAQAIPRSPGQRPKLLQDIAPGTPSELIERRPDILAAEHRLRARNADIGAARAAFFPRISLTGSFGTSSAEMSGLFDGGSRSWSFLPTLTLPIFDGGRNRANLSLAEARKDSAVAAYEGTIQTAFREVADALAASDTLRREEKALRALANSSNEALKLAKARYESGVDNHLRYLDAQRSSFLNEIAFIDGSTQRQIALVDLFRALGGGWDEGRSLVVHRGGRS

SEQ ID NO: 14672 - protein, 910 aa, Alcanivorax borkumensis
MYLNKLKYVGALKNKRSFIFVFVALFHPLESYAQETVEQTQNQAKPDKVVRVAVTGSRISKAQKDGPTSVTVITAADIEKQGFSNAFDALNNLTQNTGFVQGADYGNTFTPAANAISLRGLGPNHTLTLINGHRVADYPVPYDGSVNFVNLANIPTAIIDRIEILNGGASAIYGSDAIAGVVNIILKKKTDGTQFNIKAGGTKEGGENLRLQLSGSKTLDKLSLVYGIELSGREPIWAADRDFMKSRTRLGEKPDTIVGRKNADTGKYLSIGGCQAFNGLFNGSVNNIGQAEADNCASGLARPTYWTVQTQNRSQNGYLGLDYELNDKTQLFADFLIGANQIENNTRSPIWTSLAATSGYFLNQDSGNYEIWNRRFAPEELGGVERINKKWKEISSNLNFGIRGDIGETSWSYEAVYNGSIYTSQLNRQGLLRSNVDEYFLGQQLGTDADGIPIYSPHLDRLSRPLTASEFESISGTTKEKDKSWAQSLTLSANGDVFKLPAGTAKLATVAEIGRQGFSIKPDEAIENGEFYNTSSSGEYSGTRTRQALGAELFLPLAKPLNLTLSGRYDRYALSDNSIDKLTFGSGLEFRPHPTLLVRGNYATSFRAPDMNYLFLNKQKGYFASTTDYLRCSQTGQPLDKCSFKDYAPGANYTLTGNKELKPEEGKSYGAGFVWSPTNKFDISVDYWDIKIDNLVTNLSADKILRLEADCRLGNQDINSAACIDALARVERNPANAVVDPNVIKNINIVPINAASDHTRGIDFTSRWRWKTDSFGNFLWTINYSRVLEHEYQQSKDHEKDDYLKDLSSLDWRDRFNTSLSWSFGDWASTVLVNRYGKIPNGNQTAYLSPTYLVNWSGTYQISPKASASIIINNLFDKVKRDDTGGWPYYPIGSYSPFGRQGWLEFNYKF

SEQ ID NO: 14673 - protein, 711 aa, Alcanivorax borkumensis
MFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNIPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 14674 - protein, 397 aa, Alcanivorax borkumensis
MKKTFVALAVTSLATSASAVTLYEAEGTKIDLDGSIRLVIEQSKNTNGAYYGAIKKSNHTDKKDKEHAIRNAGSRIGLSAQHEFNDGFYALGRLELHADKNTGKDQFGDIYVKRGFVGFGKKEFGQITFGRQTTLADDQGQTTDYEYGFVPSYIKTEGNRVIRYDYKAIEGLVLSANIIWVTRILTAVITKPRKLNNIELSSEFRNAFAVGLTYETKIADNTLNIDAGFGRSNYQSAMGEKQMNHHQDGYEAAVGYQIDKLKLVSDFGYARDGADTLKAYYFAPGIQYQITPVSKVYGNYLYERVKFNKEDVKNTSLFSMSSKSTSLNQKSHGFLLGADYQLHKHVLVFLEGKVVNKKYDDVVMQSEHRNTLFEKESYSFNAKNVDKVIGVGMRVFW

SEQ ID NO: 14675 - protein, 183 aa, Alcanivorax borkumensis
MKVIMRNALVLSCSLIAAPGAFAAGPYIGGNYSQIQYDNEEFDTDTLKIDSATVNAGFEFTDFLALEARGGLGFDEDSQGIADFEMDHLYGGYVKLGAPIGETIRPYVIGGYTKVKGKVSANGTVAGVDYSYSDTETFEDESYGAGLDFNITDTVGANLEYMRYVDTDEEEISGISVGLRSAF

SEQ ID NO: 14676 - protein, 920 aa, Alcanivorax borkumensis
MMPRQTRVITFLVMTLLLLTTMAQTVLAANGRVAGQVQDSVNDINLMGVLVSADNGQTKTVTDRAGNYSINLATGEHSLTFSYLGYSNVTRQVTVAEGSTSSLDVDFGSEGMQMDEMVVSGQAVGQARALNQQKNAPNLQNIVASDAIGRFPDQNAAEALNRIPGVSIERDMGEGRFVIVRGIDPHLNSASIDGITLASAEDGTRAVLLDVIPTNVAGSLIVTKALTADMPADSIGGHIEIVSPSAYDRNERTIRGSVGGNYSDISDELTETGELTFGDVFGANDQFGALFSVSYDKREFGSDDVEADPWELNDDNEWVTEELQYREYDLTRERLGFTTNLEYKPNDNNSYFLRGLYSEFTDHEYRRRSIIKDMMMLPDTSSTGLIVGEDYEDDATELYPTTELQLKNREETQMNWALSVGGENEVDTWTIDYKAAYSYAEQDTPFDKQYLYETSDLNYTYSDADGDTPNITVNSGDMNDLSIYELDAIEDSEQLVEEEAWIFAANVKKELNTSFQSYLKTGIHVTLRNKTNDLEMTVYEDAPAALATLEGLTTGGRHENTDLPLIDDDVDDLFDSLKDDFGTIEYALEDSVAEDYETDENVYAGYIMGEADFGRFTLLPGVRVEYTDLECRGNAFDEDTETYSAQKKTNDYTNILPSLHSKVRFSDDLILYLAWTNTISRPQWDQMYYGKFTDDDGNIEIGNPDLDPYEAMNWDATLTYYMPDSLGMASIGVFYKDIDNFIYEQTADMGDYELTTFRNGDEGEVYGIELAYQQKLSFLPGALDGFSIEGNLTLSDSEVDVLPSEEGGEGRTVDMMRHSDTVGSVALSYEKYGFFVRLSGTYRSEYLDDLGEEKFEDRYIDDHFQVDLSTAYTFMDKYTLYANFINLTDEPLDAYYDQSGRNSQYEEYGWSARFGLKFNF

SEQ ID NO: 14677 - protein, 181 aa, Wolbachia endosymbiont
SYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVG

SEQ ID NO: 14678 - protein, 181 aa, Wolbachia endosymbiont
SYYVRLQYNGEILPLYTKVNGITNTTGKEKDSPLTRSFIAGGGAFGYKMDDIRVDVEGLYSQLTKDATVVSDNKAADSVTAFSGLVNVYYDIAIEDMPITPYVGVGVGAAYISNPSKADAVKEQKGFGFAYQAKAGVSYDVTPEIKLFAGARYFGSYGASFNKETVSATKEINVLYSAVGA

SEQ ID NO: 14679 - protein, 185 aa, Wolbachia endosymbiont
SYYVRLQYNGEILPLYTKVEGITNVTGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDAGIKNVLYSTVGAEA

SEQ ID NO: 14680 - protein, 181 aa, Wolbachia endosymbiont
SYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGTYGANFGKTAKDDGGIKVLYSTVG

SEQ ID NO: 14681 - protein, 175 aa, Wolbachia endosymbiont
SYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCFGSYGANFGKTAKDDGGIKV

SEQ ID NO: 14682 - protein, 181 aa, Wolbachia endosymbiont
SYYVRLQYNGEVLPFKTKIDGVTYKSGKDNNSPLKASFLAGGGAFGYKMDDIRVDVEGLYSQLSKDADVVDTSPAVVESLTAFSGLVNIYYDIAIEDMPITPYVGVGVGAAYVSNPLVTEVTGDKKSGFGFAYQAKAGVSYDVTPEIKLYAGARYFGSYGANFGKAAKDDGGIKVLYSTVG

SEQ ID NO: 14683 - protein, 183 aa, Wolbachia endosymbiont
SYYVRLQYNGEVLPFKTKIDGVAHKSGKENNSPLKASFLAGGGAFGYKMDDIRVDVEGLYSQLSKDEDVVSNDNAADSVTAFSGLVNVYYDIAIEDMPITPYVGVGVGAAYISNPSKADAVKDQKGFGFAYQAKAGVSYDVTPEIKLFAGARYFGSYGASFDKAAKGDTGIKNVLYSTVGAEA

SEQ ID NO: 14684 - protein, 325 aa, Chlorobium ferrooxidans DSM 13031
MKKAALATAILSAVVTGSSFAATVYKTDGTELKIGGRVEFRGDFIGTDKGVEIDGTMEDSTRARLNVKGTTDLGNDLQAFGFYEAEQKTGESSFKNRYMYAGVKTNAGAFSVGKQDMASVIVSDLTDITEFSGVQQFIDASSDKTDSTFAYRGSFDALQIEATYSASDADNSDLMGISGLYSLPIGLDLGLAYSTGDNGAGNGSQNQILVGAGYTLNDLYLGATFSTGDLDDKAKQEFTAYEIAVQYKISKPFSVAAMYTFAEEDDNGTKSDATKGLELVGYYKLNSNFRTYLSYYLNKLDDVKDVNGKVTSGEDTLRLGVRYDF

SEQ ID NO: 14685 - protein, 836 aa, Chlorobium ferrooxidans DSM 13031
MKTKHANMYRIFRFVLSAFCLMAMLVPLPSYGADTGTVKGRVIDKADGEGVYGASVTIAGTTIGTATDMNGNFILQNVPAKSQKISVSIVGYAPTSQIVTVGTGQTASISLQLGQTTVMASEVIVGAALYKQDRLEVPVTANVVSAEKIKQEPNPTLDQVVEDIPGVVVTRAGGQTTSTLQIRGSNTYQGGAIGTRVQGFYDGFPLNSPETGEVVWSSVNMNAADKVEVLKGSAATLYGSGAMGGVVNVFGHLPETLEVKAGSSAGFYDAPPSGDKSVYRDGYTPWFWNSYLGIGNKSGKLSYSLLYSHSEDDGYRQNAQTLLNDVKLKARYDIDAKQYLQLSAFYNETEGGYAYTWPYDATVATGTFIPHPELAYDVYVNARFPAAGPYTKYDVYTDDLIKRKNALAGLNYVNLLSDNLTLDTRLYYTRNATTYEYNNTPANQMYATGATRYPGEFNETSSNRYGAGAKLDWRVSDSHRLLFGLDGNIIDVQSTQYTGEIPSAHPLSNSDLNDIQEKNFAAFVQDEWKLTDKLTALLSLRYDWSGIDADEVTYVDYTTPAPGFPPSYPNTPTESIENPSVDAISPRIALNYKATDDMSFRASWGTSFRAPTLAERFVRDAGILKGVPNPALDKETMTAYEIGVYKQFGDKVSLDVAAFLNDYDNLIESVKLQGTTFEFQNITKARIWGIETNLNIRPNPSWNVNLAYTYMNAKNTDYKPSTPAVAIDSNPDPEWLPMRPEHTASVGVTWKPVNRLALNLNGRYVGEYKAVNLYTNTEGNNYPGDFIVFNAGAKYKITDNIGATFLCNNIGNVQYEEAEWFRAPGRSFVAGMDFTF

SEQ ID NO: 14686 - protein, 650 aa, Chlorobium ferrooxidans DSM 13031
MNKKVFLAVMLGLLSSRGVFAEEASLTYMMDEVVVTSSRFEEMKSTVTSNVTIIGRAEIELSSAKDLSELLAEKSLGHFQKYPGTLTSIGLRGFRSETHGNDLMGKVLILLDGRRAGTGNLAKIMTENVERIEIIRGPASVQYGSAAIGGVVNVITKTGSGAPSFFAAQQVGNNEYVKTGAGAEGSIGRFDFSGSVSTADMGDYQTGSGDTYQNTGFDDQVMGSLSLGYEFLPHQRMQVIYHVFDLERAGSPSYFATPDFDAYTVQNNHSTDLMYEGSDGEGRWSWMARYYMGMDKYGYVSPSSSYMSQSDTDQQGAQAQISYAEASMRVTAGVDWLQYELESTLAPKWSQYENPAAFVLGRYLFFDDALTLTAGLRYDDYSVDLHANEGTSRNTDNTSGQAGLAFRIADGLRLRGSYAEGFRMPSARELAGEIVSYGKTYIGNAELKPESSLTWEGGIDVAWKRLVASCTVFTTDYTDLIETSATGASSYTYVNVGSATVSGLEAELSWPFAPLGENWTVEPFAGYTHLFEFKDDKTGANLPYTPEWNASTGIRLRDKGGFAGSVNVAMTGSTIVQDWENNNGAFVTKGSFAVVNLAASKKFPFDHTKVNGRGITLKGEINNLFDRDYQYVTGYPMPGINFVVGIRADF

SEQ ID NO: 14687 - protein, 473 aa, Chlorobium ferrooxidans DSM 13031
MFSASAFAQDATKTDETMVVTAAGYAQVIQNAPASISVISREDLESRYYRDVTDALKSVPGVTVTGGGDTTDISIRGMGSNYTLILVDGKRQTSRQTRPNSDGPGIEQGWLPPLQAIERIEVIRGPMSTLYGSDAIGGVINIITRKDQQQWSGNVQLSTVVQENRASGDEQSANFFVTGPLSDALSLQVYGQTTQRDEDEIEHGYGDKSLRSLTSKLNYQLNPDHQLQLEAGVSAQDRENNVGKSAQSSGCRGTCSNTDNQYRRNHVAVSHQGDWQDVGQSDTYLQYEENTNKSREMSIDNTVFKSTLVAPIGEHMLSFGVEGKHESLEDKTSNKISSRTHISNTQWAGFIEDEWALAEQFRLTFGGRLDHDKNYGSHFSPRVYGVWNLDPLWTVKGGVSTGFRAPQLREVTPDWGQVSGGGNIYGNPDLKPETSINKELSLMYSTGSGLAASLTAFHNDFKDKITRVACPAN

SEQ ID NO: 14688 - protein, 851 aa, Chlorobium ferrooxidans DSM 13031
KAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGFGPGGFGPGGFGPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAG

SEQ ID NO: 14689 - protein, 404 aa, Chlorobium ferrooxidans DSM 13031
MNKRLMALAVAGALAAPLAASAEGTHVTIFGRLQAEYATVDMDGFNAQTAVADDALQSRWGLQIAEDLGAGLRAIGRIEYSLNPGGGEDKHLAREQWVGLGGDQWGELKFGRVQSVLKDFAGGHTIDPFAYTSLHANGSGGLMASSDNGYGSGDHGFVNSAVRFDSPVVEGFSVAGLLMPGDADKNDPTRDPSYAGGENGEWDFQVAAKYSGQFDAVGVDVFGAYSRDNVSKLQKSLGASKDEQIWRGGAIFSVGDFRLRGQYERVYDANPFGGAASCTHASAFGDYNPLSPTQSADGGRGQCNSAMNPNGNGSLWIAGADYTIGNTTLIAQGGMAVAKKTGDILTLDPYYAKRNVENITVGVIHNLSRRSSLFGGYQRVWVKDRNIATDTDRNVYSVGVRHDF

SEQ ID NO: 14690 - protein, 840 aa, Chlorobium ferrooxidans DSM 13031
MLSSFFVQAAAASEGGASLFCQSSSYENNQVFQDQYNEDMKTGRCILGASNDGIVRTRNELGFLKKPSNFTLVKGTRVFASQQEFDSSHHNNVGYNVHEQNTTFFKKPELIFIKDGARLENYVLDNEGKAYISNDGEIDSPGRSIDNTVKNGAELYVYAGGLSENSKIEHGGIENVQALKGKQGFSKNAVVKEGGQQSVGNGGKVEGTKIYGGEQLVFGEGDVGGEIKGSSASHTVIYGQDEILGQQKVYDGGKVWNTKVMRGGVQEIGKKSQSAKNDGFAFDTEVFAGGKQRILGGGQAIGVTLNENAIQEIDTDGFVKNLTMNDETKSWVHAGATLEGKTQVNHSGQLHLYAGNEQHRTTVEDILLNGKETKLYSLTDESDGKSSLIQKLSGEGSVIFAFTGSDPYYSQLHVNNLSGSLHFAFNTTIAQNRGDYLFVEKGIGNHTISVADSGVEITDPFSNKRDLITDQSGGAHFTLTDLKGVNINAIDGGTYMYGLKERKDENGKVWFLSADRLSGPENSIPDPTNPFVPGGTATTPSTDAVLTSSVVPGLIFNNELQTVRNGRKIWNRNRKGIELWTYGIKSRERIATGHTHFKLGQTGLVFGADQLNELRHGELYVGGFASYDQARISHARGGDSDLSSYSIGTYATYFDHRGWYMDGVLKYNYYRDNLKAISTNGLAIQSRYNQWAIGGSFEIGCYFEPAQNTWMQPYIKLTGLQVEGKKIKLSNGMIGDLRPLISFRSEVGLTAGHEFFVNSETSLTAYIMAAWLRENINNNSAIINNQHKFITNLSGSAGKLGIGLNSSVNDKLTLYAEAHYLKGHKIKNALQGILGLRYNF

SEQ ID NO: 14691 - protein, 1010 aa, Chlorobium ferrooxidans DSM 13031
MYLDRFRQCPSSLQIPRSAWRLHALAAALALAGMARLAPAAAQAPQPPVAGAPHAQDAGQEGEFDHRDNTLIAVFDDGVGINLDDDPDELGETAPPTLKDIHISVEHKNPMSKPAIGVRVSGAGRALTLAGSTIDATEGGIPAVVRRGGTLELDGVTVAGGEGMEPMTVSDAGSRLSVRGGVLGGEAPGVGLVRAAQGGQASIIDATLQSILGPALIADGGSISVAGGSIDMDMGPGFPPPPPPLPGAPLAAHPPLDRVAAVHAGQDGKVTLREVALRAHGPQATGVYAYMPGSEITLQGGTVSVQGDDGAGVVAGAGLLDALPPGGTVRLDGTTVSTDGANTDAVLVRGDAARAEVVNTVLRTAKSLAAGVSAQHGGRVTLRQTRIETAGAGAEGISVLGFEPQSGSGPASVDMQGGSITTTGNRAAGIALTHGSARLEGVAVRAEGSGSSAAQLANGTLVVSAGSLASAQSGAISVTDTPLKLMPGALASSTVSVRLTDGATAQGGNGVFLQQHSTIPVAVALESGALARGDIVADGNKPLDAGISLSVASGAAWHGATQVLQSATLGKGGTWVVNADSRVQDMSMRGGRVEFQAPAPEASYKTLTLQTLDGNGVFVLNTNVAAGQNDQLRVTGRADGQHRVLVRNAGGEADSRGARLGLVHTQGQGNATFRLANVGKAVDLGTWRYSLAEDPKTHVWSLQRAGQALSGAANAAVNAADLSSIALAESNALDKRLGELRLRADAGGPWARTFSERQQISNRHARAYDQTVSGLEIGLDRGWSASGGRWYAGGLLGYTYADRTYPGDGGGKVKGLHVGGYAAYVGDGGYYLDTVLRLGRYDQQYNIAGTDGGRVTADYRTSGAAWSLEGGRRFELPNDWFAEPQAEVMLWRTSGKRYRASNGLRVKVDANTATLGRLGLRFGRRIALAGGNIVQPYARLGWTQEFKSTGDVRTNGIGHAGAGRHGRVELGAGVDAALGKGHNLYASYEYAAGDRINIPWSFHAGYRYSF

SEQ ID NO: 14692 - protein, 273 aa, Haemophilus gallinarum
MKKTAIALAIAGLAAATVAQAAPQENTFYAGARAGWASFHDGVDAFHNSDGLSAKKNSVTYGVFGGYQILNQNNFGLAVELGYDDYGRIRLIETDAKRGKFTNHGVNLSIKPSYEVLDGLDVYARVGAALIRTDYKDYSIDAAGHSLKVSPTFAAGLEYALPILPELAMRLEYQWIENVGRDQKWSGYNDADFTPDIGAVTFGLSYRFGQGAAPVAAPEVVNKTFTLNSDVTFPFAKATLKPEATSTLDGIYGEIAQVNNVSVNVNGYADRHR

SEQ ID NO: 14693 - protein, 141 aa, Chlamydophila felis
KREYFHQYEVFAVYGLPWSWRTSSGWGLEPQLNTAAGALIGGNETGFIGSAGTGLSFNRPGNGIALEAGVNINLLDRRQFGQQDFGSILLWGAYVGLSYRFTGGLGVSYRLQHLSNNRILYTSCTPNPGVDMHMIGISWNF

SEQ ID NO: 14694 - protein, 126 aa, Chlamydophila felis
ILPFYTKVDGIANATGKEKDSPLTRSFIAGGGAFGYKMDDIRVDVEGLYSQLAKDAAVVNTSETNVADSLTAFSGLVNVYYDIAIEDMPITPYVGIGVGAAYISNPSKVDAVKDQKGFGFAYQAKA

SEQ ID NO: 14695 - protein, 1444 aa, Chlamydophila felis
THRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGSNPDQHRFTYKIVKRNNYKAGTNGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFHDNNNGTGKIDAKHEHNSLPNRLKTRTVQLFNVSLSETAQEPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGKVILDQQADENNKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTNTDISGNVSLADHAHLNLTGLATLNGNLSANGDTRYTVSHNATQNGDLSLVGNAQATFNQATLNGNTSASGNASFNLSDHAVQNGSLTLSGNAKANVSHSALNGNVSLADKAVFHFESSRFTGQISGSKDTALHLKDSEWTLPSGTELGNLNLDNATITLNSAYRHDAAGAQTGSATDAPRRRSRRSLLSVTPPASAESHFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAGKDNAQSLDALIAAGRDAVEKTESVAEPARQAGGENVGIMQAEEEKKRVQADKDTALAKQREAETRPATTAFPRARRARRDLPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIGRFDIGISTGAGFSSGSLSDGIGSKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 14696 - protein, 242 aa, Chlamydophila felis
NKYGERVIHDQSKRRNIQFSYENFSQTPFWDHIKLSYSSQKITNKARSDEYCHQSTCAGVLNPQGLNLVEEGGVYKIKDQYGGELKYEEEKGSYYRKFKNSRNEDADNGISEGGSLDSVLINCEKLNCENKKFQIYKEKDEDWMDKYEYEERQIEIKTLNGKKYGKIPLKSKIGRFGFPQDEIARFLFPKSHGYSTDFVNDRDLNTHTQQIKLDLDKEFHLWHTQHQLKYGGLYEKTLKKYG

SEQ ID NO: 14697 - protein, 184 aa, Chlamydophila felis
LFRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEA

SEQ ID NO: 14698 - protein, 1605 aa, Rickettsia tamurae
MGAANRDINANVNLDAAGIPGIVTGDSLTYIVQAGGPYTATATGGNDNGGNATVLFGSINMLQNGVFAVNGADIAIGSVSGTAGQLLTVNIVSGNTLTLNGAPGVAAFPVNTYTNLGPVNFVDAAAVFKVSLAANGADGTKTAIFGNTATFNGTAAGKGIINIDNGNIAIFNGTIGNNNGIQGLTLTGNAQATLNANTKFDGTVGAGSVSLDNGSILNVADGVNITGITAVNNISIDGKAANNGTVNFLGDSAVSTDIGANNAIAAVNVAGELTFQGGNNGGGGTFTAQAINLTSAGSLIKFTTQDHAVTGNILNTSGTNNQGGFSVNGGDVTVTGNIGADGNSLATINFETDDSLIVHKAAINATNALFIQNVNTATANTGILKLHGTNYAINGNIGANNALKLVDLADDDNGAATNFTLKQGSSIKAQNISLADIQDNTLTLEEGTTITGDIINTKGNGNGTIVLTGNATINGGIGVDIAAGGNLGKTIKNINLGGKDLSYGGNTVKVQSAPNNGINFAANETLSLTNTTDPILIASDIITTDKQGIIDGSALTNDQTLTIAGKIGIVDIINNPAQNVALGQLKIGSSKTALNSGNVAINELVIGNNGSVQFAHNTYLITKTTNAAGQGKITFNPIVANNTTLADGTNLGSAANPLSEINFGSKGANADTLLNVGKGVNLYATNITTTDANTGSFVFNAGGTNIVSGTVGGQQGNKFNTVELDNGTTAYFLGNAIFNGETTIKANSTLQIGGNYTTDFVTSADNTGIVKFVNADLITVTVQKQARVVDVLKQITVSGSGNVVINQTGNAANPGAVTDTIAFANASLGASLFLPSGLPFNDAGNTIPLTIKSTVGNGPEGDFNVPRVIVSGIDSVIADGQVIGDQDNIIGLGLGSDNGIIVNATTLYAGIGTVNDNQGTVTLSGGVPNTPGTIYGLGIGNGTPKLKQVTFTTDYNNLGSIIATNATINDGVTVTTGGIAGTDFDGKITLGSVNGNANVRFADGTFSDPTSMIVTTKANNGTVTYLGSAAVGNIGSSNALVASVKFTGPAGSLEKLQGNIYSTATNFGNVNLNVAGSNIILGGGTIAINGEIDLDTNILTFASGTSTWGSNTSIETTLTVANGNIGHIVIAEGAQVNATTTGTTTINVQDNASANFSGTKYYTLIEGGARFNGTLRGPNFAVTGSNRFINYGLIRAANQDYVVTRTNDAANVVTNDIANSPFGGAPGVGQNVTTFVNATNTTAYNNLLLAKNSADSANFVGAITTDTSAAVTNAQLDVAKDIQAQLGNRLSALRYLGTPETAEMAGPEVGAVPAAVAAGDEAVDNVAYGIWAKPFYTDAHQSKKGGLAGYKAKTTGVVIGLDMLANDNLMIGAAIGITKTDIKHQDYKKGDKTDVNGFSFSLYGAQQLVKNFFAQGSAIFSLNQVKNKSQRYFFDANGNMSKQIAAGNYDNMTFGGNLMVGYDYNAMQGVLVTPMAGLSYLKSSDENYKETGTTVANKQVNSKFSDRTDLIVGAKVAGGTMNITDLAVYPEAHAFVVHKVNGRLSKTQSVLDGQVTPFISQPDRTAKTSYNLGLSASIRPDAKMEYGIGYDAQIASKYTAYQGTL

SEQ ID NO: 14699 - protein, 1603 aa, Rickettsia asiatica
MGAAMQYNRTTNAAATTFDGIGFDQAAGANIPVAPNSVITANANNPITFNTPNGHLNSLFLDTANDLAVTINEDTTLGFITNIAQQAKFFNFTVAAGKILNITGQGITVQEASNTINAQNALTKVHGGAAINANDLSGLGSITFAAAPSVLEFNLINPTTQEAPLTLGANSKIVNGGNGTLNITNGFIQVSDNTFAGIKTINIDDCQGLMFNSTPDAANTLNLQAGGNTINFNGIDGTGKLVLVSKNGAATEFNVTGTLGGNLKGIIELNTAAVAGKLISQGGAANAVIGTDNGAGRAAGFIVSVDNGNAATISGQVYAKNMVIQSANAGGQVTFEHIVDVGLGGTTNFKTADSKVIITENSNFGSTNFGNLDTQIVVPDTKILKGNFIGDVKNNGNTAGVITFNANGALVSASTDPNIAVTNINAIEAEGAGVVELSGIHIAELRLGNGGSIFKLADGTVINGPVNQNALMNNNALAAGSIQLDGSAIITGDIGNGGVNAALQHITLANDASKILALDGANIIGANVGGAIHFQANGGTIKLTNTQNNIVVNFDLDITTDKTGVVDASSLTNNQTLTINGSIGTVVANTKTLAQLNIGSSKTILNAGDVAINELVIENNGSVQLNHNTYLITKTINAANQGQIIVAADPLNTNTTLADGTNLGSAENPLSTIHFATKAANADSILNVGKGVNLYANNITTNDANVGSLHFRSGGTSIVSGTVGGQQGHKLNNLILDNGTTVKFLGDTTFNGGTKIEGKSILQISNNYTTDHVESADNTGTLEFVNTDPITVTLNKQGAYFGVLKQVIISGPGNIVFNEIGNVGIVHGIAANSISFENASLGTSLFLPSGTPLDVLTIKSTVGNGTVDNFNAPIVVVSGIDSMINNGQIIGDKKNIIALSLGSDNSITVNANTLYSGIRTTKNNQGTVTLSGGMPNNPGTIYGLGLENGSPKLKQVTFTTDYNNLGSIIANNVTINDDVTLTTGGIAGTDFDAKITLGSVNGNANVRFVDSTFSDPRSMIVATQANKGTVTYLGNALVSNIGSLDTPVASVRFTGNDSGAGLQGNIYSQNIDFGTYNLTILNSNVILGGTTAINGEIDLLTNNLIFANGTSTWGDNTSISTTLNVSSGNIGQVVIAEDAQVNATTTGTTTIKIQDNANANFSGTQAYTLIQGGARFNGTLGAPNFAVTGSNIFVKYELIRDSNQDYVLTRTNDVLNVVTTAVGNSAIANAPGVSQNISRCLESTNTAAYNNMLLAKDPSDVATFVGAIATDTSAAVTTVNLNDTQKTQDLLSNRLGTLRYLSNAETSDVAGSATGAVSSGDEAEVSYGVWAKPFYNIAEQDKKGGIAGYKAKTTGVVVGLDTLASDNLMIGAAIGITKTDIKHQDYKKGDKTDINGLSFSLYGSQQLVKNFFAQGNSIFTLNKVKSKSQRYFFESNGKMSKQIAAGNYDNMTFGGNLIFGYDYNAMPNVLVTPMAGLSYLKSSNENYKETGTTVANKRINSKFSDRVDLIVGAKVAGSTVNITDIVIYPEIHSFVVHKVNGKLSNSQSMLDGQTAPFISQPDRTAKTSYNIGLSANIKSDAKMEYGIGYDFNSASKYTAHQGT

SEQ ID NO: 14700 - protein, 143 aa, Rickettsia mongolotimonae
STANVNGEILFAKPLVTTDPFWQAFVPRPTVGGSYNTGGRTSYAYIGATWTVDLFPETLGRRVFLEGFFGGAAHNGYTGLKANAPYGFNALGCNPLFREAAALGFRIDEHWSVMATVEHMSNAGLCGDNRGLTNFGGKLGYTF

SEQ ID NO: 14701 - protein, 737 aa, Trichodesmium erythraeum
MRLKFALLAAAAVIVPPTLGLAQTAPAQTAPAQAAPAQAAPAKPSDAPTAVEGVVIRSDSTAMRTDIDRRSYSVANDLSAKTGSISDALRNVPSVEVDVQGNVSLRGDPNVTILIDGKPSGMFNGDNRADALQQLPADQIDRVEVMTNPSAAYRPDGSGGVINLITKKTQKPGVTGTVRANIGTDGRYNGGISATRREGKVTLSGDASYRYDRQEVTSIVDRQSLSATGATVLDADQTAEVLNKGGALSLRTGVDYDLDKKTRLSAELRYRGMDYEGDGRETYLSRNGAGVIQQAYLRDSTGVMIRDNSAIAGDYRRQFTGAGHELTSRAEYEITRFKRGGDAFADYSAGASDFYEAFSFGSEQKRANWKLDYTKPLANQSKLKTGLDFEGADNDYNNYGARGATLRGQSIDPARTNRFAYDQDVFAAYVTYERPFGDLTVQTGLRAEQVEIRTDQITTGQKGSNDYLRLYPTLNAGYRLNDANSLSAGFSRRVARPGPQDLNPYPIYQDPYNFRAGNPDLKPQVTDSFELGWQYRKGPTTYLATAFYRDTRDGVTDVVKDLGGGVFLTTRENLAKSRNGGLEFVVVGRLTPKLTYNLSGQAFWNEIDAASLGFTGKRSDTALSGRANVNYQATPKDFFQVNAFTSGRRITPQGYREPVQMINLGYRRKVNDKLNFVVTVNDVVDSFKIAGVTNAARLRDRNETKVNVRTAFIGFSYAFGGGRPRPEQFDFSTGGPN

SEQ ID NO: 14702 - protein, 805 aa, Trichodesmium erythraeum
MGQVRAPRSLRAGAALKFIDGRGEGPFVTKVSAVAGLMAVASVSSAEAQPASDLPPVNVDAPIARAKPTASKPTAEQVRARNALRRAARQQGAQQAAVAFPNAGGLAAPDANPYADAAEPYKVNRVQASGKFPEPLLNTPKTITVMSKEVLQDKHVTALKEIGRSTAGVTLGSGEGGNAFGDRFFIRGFDARNDVFIDGIRDPAVSIRENFFTEQIEILRGPASSYAGRGTAGGAINIVTKQAGDTNFKRMDTEFGTDQQKRVTLDVNQTISPTFSVRTGGLFQDSNVAGRNYVTDDRWGAFLSTKWTPIDDLKITTNYVHTDLSGYPDFGVPYYKQGNVPVTSAGIPRGTWYGFLNRDFQTARQDFGTAAAEYKVNEAITLTSKFRGEHSLLNYIGTLPQNPNTTSPNPLLWTTTASAQSRYQTVDVWANQNDATFKLDTGGIKHTAVLGTEFSNENISIDRYTGLSSELFGGGSTSTGAVTGVNVYSPQYTNIPFSITPSLVGNPTRYGVNTNSVYVMDTANWRDTLILNGGVRYDGYNMSSSTNSPKYLKMNADLVNYNVGLVYKPMPIGSLYAAYATSANPFGSELDATGTDYGGVPANTAILLGPERNKAAELGTKWELVDRHLLVSAALFQTTKDNARETVNGLLTSGAAYRIQGIDIEAEGKLTDRWSIFGGLVLMQSKVTQSGVASNIGLQLANIAHQSFSMLSKYKLDSGWEIGGQAVYRSKVYGGTFAANTGNELPSYWRFDAFVEKQIDKNWTMKLYAQNLTNKLYYDTLYRSAVPFVAVAPGRAFYIITTAKF

SEQ ID NO: 14703 - protein, 789 aa, Trichodesmium erythraeum
MIKLILSICLCVGLYSISFAQNLFQIKGNILDATTSQPVEGASVVSGNLFSTSSSKGSFVINNVSEGSHTLTINHISYAPKTIAIHVRANMEVITVLLSETSNTLEEVAIQGKSATRKNKESSIVTHIVTEEFLENNRENSLMQTLSKIPGVSTINIGSGQSKPVIRGLGFNRVAVVQNGIKHEAQQWGNDHGLEIDQYGIENIQIIKGPASLLYGSDAIAGVVDIQPSKIPQKNSFDGEVNLLAETNNDLLGISTGIESRKEKLFYRGRITYRDYADYKVPTDKINYENYIFDLYDNNLRNTAGREFNASFSIGYVTDNFKSETFFSNVNAKNGFFANAHGLEVRTSSIDYDSSNRDIDLPYHKVNHFKVINNTRINLNDHTIDIDLGFQNNHREEHSEPVPHGYMPTPPNSEERVFLKNTYDLNIRDAFTLNEKHDIVAGINLEFQDNDIDGWGFLIPAYDRFTVGAFAYDQFELNKDLHLLAGIRYDFGVMNTKSYVDWYPSTVNNENGTTSNIYVQRAQQKSLDFGNFSASTGISYINNNTTYKLNIGKSFRMPLANELASDGVNYHMYRFERGNLDLDPETSYQLDVDIEHTQNAFSVGISPFLNLFDNYIYLNPTSNYYETLQIYEYTQSSVFRYGGEAKASTTIIKNLQLDASVAYVFSRQTSGAKKDFTLPFSPPLSGLVSASYQLNDIGFLKTPQLIMDFKIAAAQNEIVPPEEITPGYQLFNMSFISKMDVFNNSKPFEVRLKLNNLFNVKYYDHTSFYRLIDVPEAGRNVSMSLNIPF

SEQ ID NO: 14704 - protein, 756 aa, Trichodesmium erythraeum
MSKSVILFFLFCFSNIFAQSNIKITGNVKSSDNQTLAGVHVLFEINQKQKHAVTDTLGNFFESIPAGDMALTINQLGFTSKTIYCSVQKDTMFSIILEKDIAQLKEVIISNDKKNGIKTLSGGKLSFNLKDLNSVPTLLGTTDVIKLLQLTPGVQNSGDANGYLYVRGGDPGHNAILYNETPIYGMSHLLGIFPFYNTDHIKDIEFDKSSSNAKYGGRLSSTTLLNTNKKIPSEFSIQGNAGILASQLTLAVPINDKNGFYISGRKTYIDEVVGPLLKSDSENDVQDMKYGFSDANFTFLSQISTKNLFSFDAFYSGDKLKVKDGDLALQTNLKWNNFTVSPSLTTIFSPKVSMSNSVYFSHYSNDLDMEQAAIHFGVSSYVKDFGFANAVRFSIHNIPFESGLQYVYHNLQPQKVNVENLTTIDNNSQSVINANEAAIFANAKPKLFENVTADLGLRINYYTSGANSYLHFQPRAVLNYYANEKYSFYASYNRQYQYLSLITTSSVGIPTDFWIASSDGIKPQSSNEFSIGSNQNITRNFSSSFGGFYRSMKNLLEYPYGITQFNETTTLKNDLYVGEGKAYGFEMMLKKSNGKFTGWLSYTLSWSERNFDELNNGKTYFAKYDRRHSLSVVGMYDLNAKWNFGVTQIFGSGNRFTMPTSWYFINNNPVKEYSGYNNAQMPNYIRTDISANYYFIKTAKKESALNFSIYNTFNISNPIYVVLNVRTTDNKNEILVTQDKKVLYRILPSISWRFKF

SEQ ID NO: 14705 - protein, 841 aa, Trichodesmium erythraeum
MKITEVFKRAGILALCLSAGNALADERLEARRHFRNGMSLISQGEFDKGIAELQEAYAIKPHPSVVYNIARAYLDAGRTAEALEWYQLYLQTNPADAASVRATIARLEEAVKAAEPANLAQKLPMPPPPGTPPAPAAPAPDAQAMARLLERLEKAIARAESLPVAAPPTAPTASSSTSSARPAVPQSEDEGAVPYEERVVTASRRAQSALEAPNATTVITAEDIRLSGATSLLDVLRRVPGADVMEMGVTSANLSFRGFNQRMANKVLVLVDGRTEYQDFLGMTLWANFPIGMEEIDRIEVIRGPGSALYGANAMLGVVNIITQAPGSGDRQFIARAGGGNTVSGSFLSHGAAGGLRYRLSVGYGQEDKWSRDFESDRPDVAQTTPLKDLGYRGARANLATTYTFDSGVDLGVSSGVHRYYTEVYPLGTLRNFFLDGLSAYAKTDIGLGPVKLKGFWNHTGVEAGPQFEAIGQRPLSSRVDFHVFNGEALFSKGFQLAGEHQLNVGVEGRFKRVIWSYLSPGPKEEFHTAAFVQDEWRPVDPFRLVASYRMDRHPLLSQGKPGLAHSPRVSAILMPLEGHAFRATAASAFREPAFLESYTQLPVPVPGVPGASALTLGNRTLRPERLVAYELGYRGEAPTLGIDWDVALYQNTVKDLIGLSPLERMPAGESFDPVTGTYLAGRSFFQNEQATYTSRGAEVGVSLSPVDGLGLKASAALQKVTAKGEEEEHCAPCSQAPQLRLYGGLTYRTRADLEFGVDAAFTSDTTWIEREPDLGDPTRIDFSANKLPAYTVLNARVGYSVLQDRLTVAVVGSNLGSNHFQHPFGNRVERRVYATVTVTP

SEQ ID NO: 14706 - protein, 822 aa, Mesorhizobium sp.
MKNNYLLLILLLCFTTLGLAQTATIRGIILDDKNTPVPGASVAFMGDGTVTNDNGFYVIVIPANEDIAISYTYVGFKKITQTFNLKANADIEFNPVLKTDIEQLGTVIITTTTRQRVEGVTTIAPETIRKTPGANAGVENLLKSLPGVSNNNELSTQYAVRGGNFDENLVYINEIEVYRPFLVRSGQQEGLSFVNSDLVQNVAFSAGGFQAKYGDKLSSVLDITYRRPVDFAASADASLLGGSISGEGISKDGRFTALAGVRYRDNSLLVNAKQTETNFKPRFFDAQSLLTYKFTNKFQLDFLGNIAINKYDYEPLTRQTNFGSLTDPLALIVFYEGQEEDKYETYFGALKGTYQLNEHTTLKVLGSAYHTQEQEYFDIFADYRLGRPNTNIGDEDLGDVEFTQGIGSQLTHARNDLDALFINVEHKGTYLKDTNQIDWGIKYTREDIRDRLEEYEVIDSAGFSIRPPIGDFTNEQPYAAFDAPLEPFTNIRARNNVQINRLSAYGQYSKRTEIGNNELWINAGVRAQQWTVSGDNIESTTQTVVSPRAQLSLKPGGNSDMIFRLSGGLYAQPPLYRELRDSLGQVRPDVKAQKSFHLVAGHDWSFNLWERPFKLVTEAYYKGLTDVNPYTLENVRIRYRATNNATARAYGIDTRLNGEFVPGTQSWISLGVLRTEENIDNQGYIPRPTDQRLKVAFLFQDYAPNIPSLKLYINMVYQTGLPGGSPSYADPYVFSELPRLRDYFRADAGINYVFTDASKPFPKGHWLHVFKDLTAGFEIYNIFDRQNSITNTFVRDASTQQQFAIPNFLSPRVFNVRVSAKF

SEQ ID NO: 14707 - protein, 700 aa, Mesorhizobium sp.
MQKNNSLTIAIRNALVCALAPTAVVAFTAQAQEDVVQDDVIAMETITVTAQALKVETPAAETPRSVSIISEDELRVRAPKKLDEALRYTSGVTAQPYGADNDTDWFKVRGFDAATYLNGNRLFRDGYYTWLVEPYGLESVEVVKGPSAILFGESAPGGIVNAVQKKPTFTPQGEVKVEVGNNQHQSVGFDIADEANDAGTVRYRLVGLMTSQDGELDGTNNERFYLAPSVEFDISDRTMLTVLATYLHDDGVPTNPFFPAAGTLIGSNFGKIDPSTNLGQPNYDKYERTQFSLGYLLEHDINDTWSLSQNLNYGSNELYLRSSYAFSNNDPAKEELTQGIVFRDGKNQSITFDNNAVGNWMTDNAEHTVLIGMDLQLHKTDGDEQDNYAFGTINPWNPVYGNFTPLDPANNVKREIEKSQASLYSQYQLKLHEQWIGNIGARYDWVKTENSGKGATVDQSESRDDGQLSLSAGVMYLANNGLSPYVNYSQSFEVISTIDAATNELYKPLEGEQVEVGVKYEPSFMDGFINLAWFDITQKNALVTNPSTWIATQTGEVTSQGIELESTAQLTDDLKLMASYTYTKAKTDESFGQGKKQAALIPEHQASAWVDYSAYSLIPGLNIGTGVRYVGESKDNPKSSNLTVPSVTLWDASVTYDITSQWQAQLNVNNILDKEFVSGCDYWCYYGQSRSVMLNANYRW

SEQ ID NO: 14708 - protein, 708 aa, Mesorhizobium sp.
MSRMFKLHPLAACLAVALPALADDRAPPPLALPSTAITDTLDSHAIDLATPTQAGSRLGLSALETPASTSSISAEQIQQRNNLTVQDAVTRSPGITFVGSPGDGGTGLSARGFAGHSSVMTLFDGTRLYTGAGTQTFPVDPWMVERIDVIRGPASVLHGEGATGAVVNVIPKKPFAGEVRNHLRLGYGSWDRQQLGLDSGGSLSERLSYRLTLNQQDGNGWVDRTHSRSLAVSAALRFDASDDLSFTLAHDRGEAQPANYYGTPLIDGHYRSSLRNKNYNVQNDVQRYDDEWTRLTTDWTLNDHLSASNQLYYIKSRRHWRNAEDYSWDAERQQLLRGSYLEIKHNQEQFGDRQTFTFDHTLFGLASKTVVGAEYNKVRFNVDSNSPYNDVGGDYIDPWQPQPGGFHSASPLRPQTLSTTHTFALFAENRLQLSDRLSLVTGVRRDQNHIDRDNLTNDSRSDRSLQGGNWRAGLVFAVTDDLSLYGQYSTSEEGVNNLISLSPTQMHYDLTEAKQTEVGLKQRFWEGRGEWTLAAYHIVKKKLLVDDPITHEKQQAGQQTSDGLEATLELALAHQWQVSANASLVRARYDDFDEMVGGVAQDRAGNRPANVPRRTANLWLSKGFGQQVEAGIGARYVDERYADTANTQSAPGYTVVDANIAWQVLPDVRLGLQLNNLFDREYVQSAFSGQQWLMGMPRSYFATVDYTF

SEQ ID NO: 14709 - protein, 610 aa, Mesorhizobium sp.
MQKSALAIALASLLTPISYLYANEAQPQETVVVTANRFEQVESSVLSSVTVVSRQEIEAYQANSLTEVLRRVPGVEIAQNGGRGHSASVFIRGTNSNHVLVLVDGIRINSSAGGVALNRFPIGLVERLEVIRGPNAAVYGSDAIGGVINIITRSHRGDDAKQVSLGIGSLSSKKADVIAKADLEESGHFQVAAGFEQTDGYDIKNTGNGTQYGFDGQNLMAGYEHQLNEQWLGYFSASWFDSDAQYDESGSVKYGYSQNESFTGQLNFQGEQLKSLVSLNYQQTENLDYSLSEGKANASTKANITMTQLQWANLYQLTENAEVGAGVDARRESLADDAKNYGASHKLAGESRDTQGVFASGRVYVDSWTFESGVRYDKHDKYDHYTTWSLAAGYQLNDEHRIRAAYGTAFKAPTYSDLTTTPDLKPEESKNIEFGVSGVYSFASWNASVYDNKVDNLIIWYKPALSSGRWYSDNTDARIKGFEFDVNFNTGPVNHMLVAEFKDHKDDNGVQLSRRAKQNYKWISSLSFGQFDLNATYTYTGKRLDLPTATPKDEDYIPATNLWDMSVGYWVSQDMTLRGRIENVFNEQYESAIGYKAPERAYYFNVSYQF

SEQ ID NO: 14710 - protein, 788 aa, Mesorhizobium sp.
MRSILFAQRNEHAIGRARQGVTSRTLHGYSPAGGLVRADRKCGAMGFQGKRYGSRPATQRQPRTARLAALAMALLPAAAAAEAVGEGAGNGLPDIVVSAQKRSENVQRVPISIQSFDSQALDRLGAGQLTDLDAMAPSLSFGDGNEQGRTGIRGIIDYSRNAGYDSRVGLYVDGVYYSRSWMTPLTLLGIRQVDVLRGPQGTLFGKNTDAGVLSITTIQPSAQPNGEIKAEVGNFGYWRVAGRGNAPLGPKVSLQLAGSHAESTGYYRNVLLGKHNSGVNADMIRAQLRFQPSDDLDVTLAADYAADDNSTLHYTYVPPAGTDPFAFASYWDDRATRRTGGASLTVRKDVAGGFQITSITAYRSGHQFLYFNNETGPVPYLTTGLIQYADQFSQEVRIASPRTENHDFVAGLYYFWGNNKDRQSLAAGSGLGALGLGGLVGKASLTRTSVSTGSVAGFFQASFRPVPMIELFVGARLTYERKKLNDITTNDPTGFIAIPITGYRDRFSDSFLTPKGGINLHLGPDLVLFGTIGRGVKSGGWNVEGTTASTFAAGIRFRPETVTSYEAGLKSEFLDRRARLNITGFYQRFEDFQVFTFVNTVVAGRTVQATSLSNVGKVTSKGVEIDLALIPVEGLTLSGNYTYNKSAYDHYPGGGGMVGTTILDADGVQTPYAPTHKAYLAADYETPLAKGGPLLFAHVGYSVQSSENFDPKVVNPTVGSAYFIKGYGLADARLGIGFAGGRWRASLWSRNLFDKRYVRFATRTVLLRAPAILYGEPRSYGVTLSATF

SEQ ID NO: 14711 - protein, 2005 aa, Mesorhizobium sp.
MNVFDTPDIPANGQSFAQRPIIGKRTADEYDNQISPRFNNAVVAQNYDEYTPEPDTPNGNIDVNMGKTTTWGGGRIKLKSTVPEGRPFENGEEEYENIKDEHGNVIGQRKMPKDPYILKRSGTYYLNPGKVETKYVNDTEGRKLDTVNAFISDSRDHNTTINGNYTVKNLGDGPTTKLFFSYNPSGVGGKKYDNKASWGWSDGTEQAVNRVAKFTGNLTLKGVEDPNNKTALVGLEHQLWAKSRTSTHKDDQAEWNNSNSNTTLLNTGNITLASGNYLVGMMIDVEYSNDKNHKNHKTINKGTININSKNSVGIDFARYELGLLQTDVTLGNINVNGSNNYGFRMAKLFDGETKTYQGADNGNNLTVDGNKYYDNTTITGEGGKIVVGGKENVGVSISKGVSAGKSANPISNIKSLNIEVVGENVVGFLRNKDFSTNNTGNIVLDDTTVQSLTFGNGAKNSTLVRSDNGTIDIKKNLNAEKGGEGNSFSQTTNGATIYNYATLKSALANFTGMISYGKSNLRSSTATNKGTIELTGDSNSNIGMAALNRGEIRNENGTIKVLGKGKNKAAIYTDQTSSATLNGGNYFISGESSSGIYNQGSTILGDNNKIFASNGAVGIYSSGGTIDGSHAANGVDIEVDDGNSEEKGLAVYGENGTDIKLQNSKINVKKGAAGIAAFGTNTKINLNGATLKYSGSGYAAYATGGGKIDLSNSRIELRGRATGFEMAGSGTSPITLNSNTRIHVYSNDVTVMNIKDMASLNYSNLNSTAFNSYLQGATVHAENGATDYKLAAVDGIGAYNINSSLDKKLAVNPANKNTNDYIFTRLLSVQRARMNLKSGNNVRAVLSSSDLAAMKEKTVVGLAMNSSKNAVSNTETAINLENNTTVTADRTDAGNGAIGLFVNYGTVNVASGATINVEKENNVVNEKAVGIYSVNGTKVDNKGTINVGGKNSIGILGIAYRTDNAGNKKIDEFGSNAVGQGKVDIKNQGTLSLNGEGASGIFVKNNKGTAASSGEHKALNTGTINMSGNKAIGMFAEKGYLKNEGTINITGSQQGIGMYGHLESILENGTNGTINVADSNDENKLNIGIFTDDINTKITNAGKIIAGKNSYGIYGKNITTSATSKIKTGDNGVGIFSSTKDSNTTLDLASGSEITVGNNNAVGVFSSGNKAAHITSFSKMNIGNGSFGYVIKSKGSTLNSNYAGETELKQDGTYIYSTDEDGTITNKTKLKSSGNKNYGIYASGNVKNLADINFATGYGNVGLYSTSNNSNKGITNGEAGPSGIKPKITVGASKIRDTNGNLLKEKDRLYSIGMAAGYSWTEEDLKKPEVQRPKQFIGRIVNYGTISVTGDDGIGMYAVGRGSRAINHGLIDLSGKNSIGMYLDQGAIGENYGTIRTAPNNTKDGIIGVVALNGSVIKNYGTISISGAGNTGIYKAQGGNNEGKKPEVSNGATDISSKATADTSKKLGTTQILSPPGATNAVIKEKGKVLTPDYVDRPTPNAPNVRAGSTILNLKQLQKFNGNSRARASELGMYIDTSGIKFTKPIEGLEKLTNLKRINLIFGVEATKYSNNTAIQIGSNILEPYNKVIEKLSRSGSGKKWILNSSSLTWMATATQNPSNGTLGNVYMKKIPYTTFAVKGDTDTYNFLDGLEQRYGVEGLDSREKELFNKLNDIGKGEAQLFVQAVDEMKGHQYANTQQRVYATGQILDTEFNYLREEWATASKDSNKIKAFGARGEYKTNTAGVIDYKNYAYGVAYIHENESVKLGKDIGWYTGFVHNTFRFEDIGKSKEEMLLGKVGMFKSIPFDDDNSLNWTVSGNIFAGHNKMHRKFLIVDEIFNAKSKYYTYGIGVKNEIGKEFRLSEDFSIRPYGALKLEYGRISKIKEKTGEIRLEVKSNDYVSIKPEIGTELKYKHLFTNRKTLTVGLGVAYENELGKVANPKNKARVAYTTADWYNLRGEKEDRRGNIKTDLTIGLENTRFGATANIGYDTKGHNVRAGLGLRVIF

SEQ ID NO: 14712 - protein, 777 aa, Mesorhizobium sp.
MIRRPKAAGWYGAMRRGRRARCVGVTVGTLALFGLPPGSVRAQQQPDGGAITPPEPPAIVLPAVVVVGTTPLPGIGTPLSKVPANVQTVRAAELDAQHRATLTDFFAANLPSVTISDAQGNPYQADVNYRGFTASPLLGTPQGLSVFVDGVRVNEPFGDVVNWDILPTQAIDRVQLIPGSNPVYGLNTLGGALAITTKNGRSNPGGEAEVSGGSWGRKTASVEQGGTIGSNLDYYATANVANDGGWADHNASRVRQAFGKLRYTDADTTLSIAAGGADNTLSGTQTIPRSFLDNRKQAYTYPDRNRNSAGYLTLSGERFFGEHVELSGNAYYRHLRNTNTSSNNNTDYGSVDEDGAIDTVQGSNAQSTIVTDSYGGSVQLTLLGKLGGMANRLVAGVSADVANSSYVASSQDASFTDARAAIGIGDFVPQTSAKTRNANFGLYLSDALSLTPHWTLTLSGRYDWSKAQIGDESGVQPLLDGSHVFSRFNPAVGLNWNPVPGFTAYATYNEGMRSPTAIELACADPAAPCSLPNDFIADPALKPVISKTFEAGMRGRIGAATTWSAAAYRTTLTDDIQFISSPASAQGYFRNVGDTRRQGIELAGRTRVGPLGVGLSYSYVDATYRSSWTEHSPANSAADANGNVTVKPGDRIPGIPAHTVKLRLDYAATPVWDIGANVTWRGGVYARGDENNGDVNGRIAGYVLVDLDMRYRITKRFEVFASVTNLLDKRYASFGALGQNFFNGPNHTFDGARPVNEQFVGPGAPRGAWVGVRYAWD

SEQ ID NO: 14713 - protein, 724 aa, Mesorhizobium sp.
MKVNKFLWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLISYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMITSEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 14714 - protein, 745 aa, Mesorhizobium sp.
STCAWATPPRRRRVVRPERVSGFSNDRFTAIYGAELLVQNPLWAYDRARQDSTLDGPSAGSRAPRRTFLRTNWYDEYLDPETACDGLATLNGGNTYRAKRAGYGVDGEDGYYCGSDRSIGYGTIISKRRGLNAYGSLSYRFDNDTEWFADLQLGYHELSMFRDVTQWVYQRPDGDESGYFFNQATDQLEYWQRQFTPEEMGGLNNGDIRTRQKTFSVTTGFKGRWGANWDWETALSHSQYQSTISWPQIVAAKANALFLGPQLGSDDDGYPIFNADPSRLYRPLTRAEYDSIAARTVYQPKSRTDTLSLTFTNTELFQMPAGAAGFAGTVEAGNQSYNLRPDPLATQYYYYSWRDSDGHGSRDRWAAAGELRLPLFERLNLSVAGRYDQYRYSGSSIDKFTYSAGLEWRPLDTLLLRGSYGTAFRAPDLHYVFAGEGNSESAAIDYYRCRSEEPGVDYADCSYSDESLIVTRRGNRKLDPETSTSWTAGVVWSPLANLDFSLDYYDIDLRHQVQDLRADSVLQDEADCRLGQRPDGTAISASSPTCVDALARVVRTADGRLYGTYVNPINIARERTNGVDFTARWRWETAVGTFRFSGNYSWVREHESQQYAGDRVEDQFAVNSGFDIPRSKASASVSWDRDRWTATLHGERLGKLPNYDSYSESYDPADGGSPWIGATYRYNLSLQYRFTDHNQLSVSVTNLFDKMPPHDSSYTGYPYYDVSWFDALGRQVFVQYTHKFGGAPL

SEQ ID NO: 14715 - protein, 708 aa, Mesorhizobium sp.
MRFSCLSVLLILGAALVAPAYAQQTPDLPGAPDTTQAAESDLDEVTVTANRRATPRSKTPATVSIKTRSELDREQPLLRTVADALQTLPGITINRLGLLSGAANIRGLTGERIAVLVDGERLPNLEFGPDLGSVDPFRVERLEVLKGPASSIYGADAFGGVINIITTLPRFDTPPKVRTYLYGGNFSEIGGNVEFQGPNVVAGLSLRTAGDAKDGLSRPIPTNGTGYDAFDAYASGRIDFDATNHLELRFDRYRQSYADLNGFPTPPFVFAQNQFRNRDRYSIAYINDGAPGGTSFALRANYQKNERRFDNTTAVTIPVFASPFAVGGNGTSSLFGTPSRQAAFFPPAPPTFITLTTPSSTYSLTETYGLSAQANTALGSAVLTYGYDFSQDASTSIDRFAVPSVQSPLATRSFNGVFLQGSYDITPSFTVAGGVRYDTYDQNTNTGLVNNANRVTFNAGAIYSITPELALRANFAQGFRPPSLLFLFGSSPEGTFFAPSAGNVQANPNLRPERADNFDIGINYTSPEFRAGITYFNNQVTDFLGFGPLVAFGAPPFGPPPPSQTVLNKNVQLQGLEFSSAYFFSPQAFFEANLTYVDGRDGSGLPLSQLEVFPLTALLRLVYDDKTFNALLQSRIYGGQGSVIGNNGVVGPGTPPAGVLDLSFGYRFVPNVQLTVSVENVTNAQYIYPTSGFVAPGARLLGAVRAEF

SEQ ID NO: 14716 - protein, 704 aa, Mesorhizobium sp.
MKGLEASRKNARRILFAWQVGFLGRTICISCLRAACVSTTAALLLMVTATHVQAEEVKPAKLDLTEMSIDELMKIPVTTVSRKAEEFSKSPAAIYVLTQDDIRRSGATSIPEVLRLVPGLDVAQVDSQQWAISARGFNDVFANKLLVLQDGRSVYTPLFSGVFWDVQDTILEDIDRIEVVRGPGGTLWGANAVNGVINIITKSAKDTQGVLITGGGGTYEHAFGGFRYGDKVGEDLYLRVYGKYFDRDESVRPNGSDIPDSWQMGRGGFRMDWDKWEKTGNLLTVQGDIYEGWLDQEFGTFNPFNPPTYSSLVQDEERVSGGNLLGRWSHQFSDSSDLKIQTYYDRTERDTAIFRESRDTFDLDLQHHFTLGDRNDFVWGAGYRLDMDRIGNTPSVSLFPSSETTHLFSTFVQDEITLVEKRLRLTLGTKLEHNDFTGFEYQPSGRLLWTPHEKHTFWASISRAVRTPSRAEEDVRLSSVIAPGVVNTIYGNNHFLAEDLLAYEFGYRVQPSSRVSFDLAMFYNVYDQLRSVEFGFSPTQPVIPPPPPPGFFIPTFVANELYGDTYGFELASTIQLADWWRLKPSYTFLEMQLKQRAGSTDISSIGDMGKSPEQQFSVTSAMDFPHGLSLDCAFRYVDQLPTLNISSYVALDVRLGWRATKNLEMAIVGQNLLSAQHAEFAPTFIQTPRAEVQHGVYGKVTVRF

SEQ ID NO: 14717 - protein, 237 aa, Mesorhizobium sp.
MKLLVATAAACVISSSAFAADILYDAPPAPPAPPPPPAPFNWTGPYVGVYGGIAAGDIKHNLNVLGNVPFTGLLTERSRAGGAIGGIQVGYDWQVNNWVLGAVADIAATNYEVKNSYYVLGTRIAKDSSKLSYLGTVRARAGYAWDRTLVYGHGGFAYGKTKQTSDFIGTDTLKQSQTRTGWTIGAGVEYAVTDRISLGSEYSYVDFGKKDIYKDANISINEDVALHSVKAFLNVRF

SEQ ID NO: 14718 - protein, 1094 aa, Mesorhizobium sp.
MMGRSANGLELIRLSLRRALMPVWVAVVLLLGSIPAAEAGCNLTSNSATSATIIMLGTGPANTLGVCVTKDAVLWGLYGTSNGANPNADAKNNLPMTANGQTYTSLSYTTSKASYSLVPVPIGGDTSQLPEYDLTINTLAGSGTDTITLWYASDCSHAANGCSGAGTTNTTFTINVVLPSPTVTAIAPSAGPISGGTSVTISGTGFTGASAVKFGAANATSFTVNSSASITATSPVGTAGAVDVTVTNSGKTSATSAADQFTYTPAPTVTAISPATGTAAGGTSVTITGTNLAAASAVRFGSTSAASYTVNSATQITATSPAGSGTVDVTVTTAGGTSATSAADQFTYIPLVTAISPASGPTTGSTAVTITGNGFTGASAVKFGAANATSFTVNSATQITATSPSGAAGTIDVTVTTSGQTSPTSAADQFTYAAAPTVTSISPSSGPASGSTSVIITGTGFTAATAVSFGATAATSYTVNSATQITAFAPAGTGTVDVRVTGVGGTSATSAADQFSYLGAPAITAISPATGPSAGGTSVTISGSGFAGTTGLGAVKFGAVNATSYTVNSASSITAIAPAGTGAVDVTVTNNAQTSAVTAAGRFSYVTTATQTSLASSRNPSEFRQPVTFTATVTAVSGTATGTVTFADGGSPIGSATLSAGVATLTISMLAVGSHSITASYAGSTLFSASTSPALAQTVNVPIDSVRLRSLQQTVSKMVAQNSGQALSGAIDDAIADGFSDGGGTFMTPGSTRMRFNFSVDPRDQDERAADRVGGGTDAYSSGLPGAPQRGRAVNRNRVDDAFAAIDRGEKKQAAPNWHEQKEWLLWADVRNSGVDRWGTTTTGGVTQASQASLYGQQLNAAMGLTYRATPSVLVGVLGGYETFSYTQQDINGKLKGDGWTTGAYLGWKIVPTLRFDAALAYSGTGYNGSAGTAQGSFTGQRWMASTGLTGTYKWAGFVIEPSAKVYALWEHQNAYTDSLGTRQGSYDFASGRASGGLRAAYTVASLDSGLMLTPFLGMYGDYYFNKEDANALVANAPASTPLLQGWSARATGGLGIRTAGGAALGFGAERGGIGGSIRAWTFAARARLPFDAR

SEQ ID NO: 14719 - protein, 758 aa, Mesorhizobium sp.
MPARMWAFLLVLSTGAAAQPVEPATETPPSAEEPVPSPPEPRPEEPPAAVEGSSPPQEVIPLDEPKKFESVVVGTSETRTSGSIHILTPAKLQRLELDDPAAILQSVPGVYARGEDGFGLRPNLGLRGVNPDRSKKVTLLEDGILFGPAPYSAPAAYFFPLITRMQSVRVLKGPSAIQQGPQTVGGSVEFITRDIPGGEDYGVDLGGGQNMYGKFHGHYGASTEHSGFVVEGVHLRNDGFKELDSGGNTGFRRNEWMMKARHEFEPVGEARQSLQLKLGYSDESSNETYLGLSDADFEENPLRRYDASRMDHMQWHRTQAVLSHQLELDGLAVTTQAYRHDFHRIWRKVNRFEGASIASVLADPTSARNAIYYGVLTGQIDSSTAQETLLIGPNNRAFVSQGIQSVARWSPTTGPVKHNVEWGVRYHYDRIDRLHTEDGFLTLAGELIPDGKATRTTADNIDSTHALAFHVTDALAWERLLVTPGVRLEVIRSKSKDHLTGTTDKGSLNVLMPGLGLYGALTRSLGLFAGAYRGFSPPAPGQNAKPEKSINYEGGARWTRSGERFEVVGFFNDYSNLTDICTFSNGCVNDDLDSQVDAGRAHIWGMEVYAEKTFRPGGGVTFPTSVAYTLTRTRLQEDFRSADPQFGVVRAGDEMPYVPLHQLAASAGVEAALGGLFLNATYVDTMRESAGQGEIPAGERTGALLTFDVNASWNFSREGLLYLNVRNLLDKEVIVSRRPFGARPNAPRLITAGLKYSF

SEQ ID NO: 14720 - protein, 781 aa, Mesorhizobium sp.
MKTTAKTHLALCIAMAIGSQSFISSAIAQETPDDAAIEEITVVGKSVSYANNQTSDEMAKQQSSLTSALAVIDNLPGVLINEGDTFGSDDWSTTVSIRGFQLSLDEQQIGITIDGIANGNSNYGGGAKANRYIDTENLGRVEVSQGTGDIASRSNEALGGTLNFTTIDPGMEESMVVSISAGSFDAQKYFVRYETGEIAPDTYAWFSASSSENTDWVTQTAENKRDHLAAKFMTVVSDVDIKGYFSWDDVHEDNYQRVSLAQFEQNPESDGLSGEWVGIPYVDQVFRQAWSSLRENMFAYLSADYKADNVEISGNVYYHDNEGRGDWAPQYIVDVKEDGDGVAHSELSSGNTVYGGSAIRELLFVNASGLAVSPIAGCESTITAPYGGAGPEYDPGCYAQGAIPVGSYRHTHYEKERFGFDADFAWYTQINDMDNTLRGGIWYEDYNRKESRDWHKILDSRSSFEFDHTPYWVQYEREFPVETLMVYAEDELDMGWASIRLGMKRFFVDLERQDNFDAANKAELNSDSDTLFSGGIVAQTPIDGLEVFAGYAENFAAIKDTVLERDASTLTQVEPETAENVDVGLRYVSQNINASLTYYSIKFDNRLTFIAPDSPDGIDYLIGTNGSYVNVGGIESSGFEASLSFNVTDELSVYSSYTFNDSEYTDGSIDFPEGNTVFGSPENMAVVSLDWTRGNYFIGSSTKWVDDRFIDAANTQVAEAYLVTDFYAGVSLDAPIQGIDSIDLRFTVNNMFDESYLGGIAGQSAWIGAPRTAAFNAQARF

SEQ ID NO: 14721 - protein, 951 aa, Mesorhizobium sp.
MKLLTTKPAAIALAIAAALTATHSAANEIPAEQQTKTKEQVQAKDTAQAQDAEVERIQVTGIRNSIKEGMFLKQNAVSVVDLVVADDIGKFPDENLAEALQRIPGVTITRNGGEGQNILVRGLGDGYNVTTLNGRKLASENAGRDFNFDTIASELVNVLAVYKSPEARLTEGGIGAIVDIQTRKPLDLEGRTIQASAKGIYESRTEDIHPHASLIIGDKTDDDSFGALVSAVYSRKTLRADTYSAEGFFDEDEGWGVDSAGVPVDTNNNGVIDPGEIYASKIPSYMYFANAQDVRERVGGTLALQWRPLDNLDINFDGLYSRYNTDGHKYQIGFVNYDEEWTPGTPLFTDAIFDDQGRVVSMNQTGDNTMVELLNLSTPRKTDTYQMGLKADWYVMPNWSITADVAYSAAQNANNGDNRFVVARGFVDGIDIDYTRGNMLPDVVISPGLSADQKYGAHYSRNSGVDVDDKITDIKLISQYIPDEGIISKVDFGVNYVKQVKKQTEFASANSSQFSRGGYYLTRDGYTFDNSTVFTQGEFELFQIPSSVFVPANFDNFLDGENSISPEPWPSFDYDKLLEYYRSINQEAADKSIVASLNKAGSYEVTEAVTSAYVQVNIEEEIFDLPYMLNLGLRASQTKVTSDGYAYDLAKVELDSAGQPTNNDWKNVVQASYDDSYTNVLPSMNFKLNLQDDLLLRVSAAEVLSRPSLYALRVWAAPSFTTRENGLPTLTRGNPSVAPEKARQGDISLEWYFHESSSLSGAIFIKDIESFITDEKGPQMVEGTEYYVTQPVSGKYGAKVQGVEAAWQQSLDEYLPEPFNGLGFQLNYTYVDSSYDDPEIDAKGLPFKGMSKNSYNAVLYYEQYGLQARVAYNWRSKFLVDPEAWGGPAWIQDYGQLDASASYDIFENVSIFAEASNLTNNRYSGYVKYEDQVNYLERFGTQIALGIRGSF

SEQ ID NO: 14722 - protein, 667 aa, Mesorhizobium sp.
MRKHLLLLSFFISLLFSIDNRSYGQAGDTSKRVFQLGQVNILGLRDSLRANRLNTTQLNLHNRYDVSHALNLLPGITLTSVGPRNESAVNVRGFDLRQVPVYLDGVPLYVPYDGYVDLARYNTFNLSEILVAKGYSSMLFGPNAEGGAINLVSRKPGNLFELNATAGYLSGGYLLNTNIGGNAGKFYYQLSASQLSRDFFPLSDDFSAVANEDGGRRNNSASKDLDLSGKVGFTPTAAQEYAIGYNYHHGSKGNPVYAGTDEQNNLFRNPRYWKWPKWDTQGIYALSNNKINETNVIKTRWYYDRFVNQLDSYDNSDYNAMTRGYAFTSHYDDYTLGSSIVFENTDITNNSFSIAGHFKQDVHRENNVGEPVRRSADHNLYFAIEDTYHLTAALKVNGGVSYNNRKSTQAQQYTNNTISELPANSNDAWNLQGLLQYDLSTNHTLSFSVASKTRFATIKDRYSYRFGTAIPNPDLKAERALNYDLSYHSLVDGKLSLDVSGFYSKLNNTIQMVNNVRIDPVTNVNQSQIQNVGKAEYYGAEFAVAYPVLPQLYANANYTYMVRSNLSTAAVRFTDVPKHKVFGSIKYTPISKVYLMASEEYNSKRYSTSYGTVSGAFYLTNVKANVQLPKGFTVEGGVNNVFDRNYTLVEGYPEMGRNFFANLIFNY

SEQ ID NO: 14723 - protein, 677 aa, Cytophaga hutchinsonii
MVAVATPVGSYAQTPDDSSVDGDTIMVTATQYAGTKTDTPIIETPQPITVIDADRYLSQGAISISDTVKYAAGVLANPYGRDTRVDGFTIRGLDALQFRDGMRDIFSYYASITSDPYNFSRVEILRGPASVLFGQGSIGGLVNLVTKTPNFTTGGEINLVYGSYDRKEALGDVNFAIADNLAVRFVGRARDSNTFIDHVPDDRVMVAPSIRWQPTPDTDIILTGLYQEDDTGSTSQFLPIVGTFLPNRVAGAQLDRDTFVGKAGWDRYAGRSLQGAAFVTHDFSDQVKLSLKARYIDSDLEYNTHYADSYSNPQDPFSVYGTDGRTIGLTADASDARMNVFSTDNNLLFTFNTGANLEHKLLVGIDYSWNKVAKRYAGGTEIVDLYDIDYAALKTYDPTGPFLADSQKQLGIYVQDQMRFFDRVSIVLGARRDRVTGSSGQKDNATTFRAGIIGEIGAGFSPFFSYTESFLPVAGRIDNGDGTFGDPYRPQTGSQYEAGIKWQPAPGTLVTATAFKIKERNRVLYLAAGGTAQSGELNTKGFEVEASHTLPGDFELLANYGYTKLKSETNTNLDYMPRHTASFWTTKTFGLPDEAQLRLGGGVVHSGKSVSTSAIWSIVTPSRTTVDALAEINWNSWRFAVNATNLLNNHYYASCLARGDCFIGAPRNVMGTVGFRF

SEQ ID NO: 14724 - protein, 1943 aa, Cytophaga hutchinsonii
MQFTQSNGQKFVFEETFNPGSITYKYFTIHSSLFHTDADSKDIWSQVRKQFDFIPGKTPVCVGVCYIAPYKNQDLIGSSAFAWSLNFGATVVGTLLLGSAQEKANNNGGSIWFGKNNLLYLHGNFNATNIFLTNNFNVGNPNAGGGATINFNADETLNADGLNYTNFQTVALGLQTSASQHSWANFNSKLSMEIKNSNFRDFTWGGFNFNSGRITFENTTFSGWTNINGATESGSSYVNMVANTDLIFSNSILGGGIRYDLKANNIIFNNSQMVIDVSKNVNQSSLNGNVTFNNSRLSVKPNAAINIGDSQTQTALENASSLSFYNNSVANFNGTTAFNGVSYLNLNPNAQVSFNQVNFNNANVTFYGIPLFGKTPDFGNSARLINFKGNTNFNQATLNLRAKNIHINFQGVSTFKQNSTMNLAESSQASFNALKVEGETNFNLNNSSLLNFNGNSVFNAPVSFYANHSQISFTKLATFNSDASFDLSNNSTLNFQSVLLNGALNLLGNGSNNLAINAKGNFSFGSKGILNLSYMNLFGGDKKTSVYDVLQAQNIDGLMGNNGYEKIRFYGIQIDKADYSFDNGVHSWRFTNPLNTTETITETLHNNRLKVQISQNGVSNNKMFNLAPSLYDYQKNPYNETENSYNYTSDKVGTYYLTSNIKGFNQNNKTPGTYNAQNQPLQALHIYNQAITKQDLNMIASLGKEFLPKIANLLSSGALDNLNSPNSFETLFGIFEKYGITLNQENWKSLLKIINNFSNTTNYDFSQGNLVVGAIKEGQTNTKSVVWFGGEGYKEPCAVGDNTCQMFRQTNLGQLLHSSTPYLGYINANFRAKNIYITGTIGSGNAWGSGGSANVSFESGTNLVLNQAKIDAQGTDKIFSYLGQGGIEKLFGEKGLGNALSNIIYEESLNDNAIPKDLANMIPKDFGSKTLSSLLSPTEVNNLLGVSAFKNAIMEILNSKTVGDVFGENGLLNALDPTERKKIDQMLLEQIQAHSSGFEKFIVKTLGIENVENFINNWYGKQSLSSFANNFVPGGLNQALDKIGSSSDAKDLQNFLDKTTFGDILNQMIEQAPLINKLISWLGPQDLSVLVNIALNSITNPSKELTSTISSIGEKALNDLLGDGVVNKIMSNQVLGQMINKIIADKGFGGVYQQGLGSILPQSLQDELKKLGMGSLLGSRGLHNLWQRGNFNFVAKDYLFTNNSSFSNATGGELNFVAGKSIIFNGKNTINFTQYQGKLSFISKDFSNISLDTLNATNGLTLNAPKNDISVQKGQICVNVLNCMGEKKAHSSSATAPTNETLEANANNFAFLGAIKANGLVDFSKVLQNTTIGTLDLGPNATFKANHLIVNNAFNNNSNYRADISGNLNVVKGAALSTNENGLNVGGDFKSEGSLIFNLNNKTNQTIINVAGNSTIMSYNNQALIHFNTQLKQGAYTLINAKRMLYGYDNQIIRGGSLSDYLKLYTLIDFNGKRMQLNGDSLSYDNQPVNIKDGGLVVSFKDNQGQMVYSSILYDKVQVSVSDKPMDIHAPSLEYYIKYIQGSAGLDAIKSAGNNSILWLNELFVAKGGNPLFAPYYLQDNPTEHIVTLMKDITSALGMLSKPNLKNNSTDALQLNTYTQQMSRLAKLSNFASFDSTDFSERLSSLKNQRFADAIPNAMDVILKYSQRDKLKNNLWATGVGGVSFVENGTGTLYGVNVGYDRFIKGVIVGGYAAYGYSGFYERITNSKSDNVDVGLYARAFIKKSELTFSVNETWGANKNQISSNDTLLSMINQSYKYSTWTTNAKVNYGYDFMFKNKSIILKPQIGLRYYYIGMTGLEGVMHNALYNQFKANADPSKKSVLTIELALENRHYFNTNSYFYAIGGFGRDLLVNSMGDKLVRFIGNNTLSYRKGELYNTFASITTGGEVRLFKSFYANAGVGARFGLDYKMINITGNIGMRLAF

SEQ ID NO: 14725 - protein, 270 aa, Cytophaga hutchinsonii
MKKFVALGLLSAVLSSSLLAEGDGVYIGTNYQLGQARLNSNIYNTGDCTGSVVGCPPGLTANKHNPGGTNINWHSKYANGALNGFGLNVGYKKFFQFKSLDMTSKWFGFRVYGLFDYGHADLGKQVYAPNKIQLDMVSWGVGSDLLADIIDKDNASFGIFGGVAIGGNTWKSSAANYWKEQIIEAKGPDVCTPTYCNPNAPYSTNTSTVAFQVWLNFGVRANIYKHNGVEFGVRVPLLINKFLSAGPNATNLYYHLKRDYSLYLGYNYTF

SEQ ID NO: 14726 - protein, 808 aa, Cytophaga hutchinsonii
MKQLKLLTKFLIFFSISVALAQKEVKVQGTVVEDGTNIPLEYATITFKTKPDNKIVTGGITDAKGVFSVDVPIGTYTISVEYISYKSKTYVDKSISKNINLGTVSLAIDTESLGEVTIIAERTTVEIKLDKKIYNVGKDLTVRGGTVSDVLDNVPSVSVDVEGNVALRGNDDVRILINGKPSGLVGLNSTEALRQLPAEAIERVEVITSPSARYDAEGTAGILNIILRRSKLQGLNGAITVNAGYPTSAGVSGNTNYRTGDFNFFNTTSYNYREVPGNSFTDTEFTSTNNNIIENRDFDRIRKGLNTNLGVEWYINETASLTTSLQYRDSNNESETINVLREFDSNNDLTNTTTRFDPEFEDDKTLQYTVNFDKQFNGNSDHRFTANFQYESSSELEASMIEQDAITVEDVVTDEEQERIFLQSDYVQPIGEVSQLELGYQGRFSTLDTDYAIAFNDGNGNFDLDEDLSNNLVYKEYVNAFYTQFGSKIKDKFSYLLGLRMEESRITIDQITSGNFEKKNYVGFFPTVNLAYELTKDENITLGYNRRIRRPRSRFINPFPSRSSATNLFQGNPDLDPSYSNTIDLGYYNKFGKLSLNTSIYVTNSTDIFTFITEDTGETVIVGGTEVPVIRRSPINLATNDRVGFEFTLTYRPSRKWNINGNFNLFRSKTEGVYNGIDFGAENTSWFMRLNNKYTLPGGIDWQTRMNYRGPTEDAQSKRQGIFSMNLAFSKDLFKDKASIAFNVSDLFNSRKRITETSTPTFNADSEFQWRERSFNLSFTYRFNQKKKLERSGRGNANGGGEDFDFEG

SEQ ID NO: 14727 - protein, 841 aa, Cytophaga hutchinsonii
MIYIYITICYSYTLTVLFLFQKKLLKTYYIFVAGVFIFLCTAKHDHAIAMDRLSGIPQRDQVETDSSSSEGEEEEQGATGIDMGFYNTLDSIEFAAEVTGRNHSEECNYRYENRRYRKKKEREEEIQEEKKRCEMIEKQCREVTHYQNVKQKVESFIAYPSLVAEQKCWMDTYKEEALDRLNNVSQERHEKERSIEEKQQQILRSQEINQRLIAEGQSESFFNIFEQSESRILRPVFRTRFQLRVRREELNAYFNRMMDFLYGSDAFLQEIIDEEEEAECLEREERVALDALEQLRVELEHNLVQQHQEMQRRIPDNILNHREELILQELTWSYTEVLSNAFIAYDTHCQTLSAQQSRPPFFPYLEEAMRQKRSKAEIVASVDMALLSLDDSREDSESSERGEIHDVSWFGGNALLDETLGEVEEIEHSESSKSDVSQKSTACTEGESEEASSTQQSEQSISLEQRYLLQGARPRQPSKGGASDSSLSFIPGFSFGGQISSLQSMQYILCDVSEKVSTELKSLVQHARQQQYDKDNECCLTNLISRKRYSSVPQYDTVQHTYNISSPYRVFGGVDSYSKNLEHKIRSSQAGVMFTPHNGYTVKLLYDRHKKDVQEHSGLQLGTAIGSVKSYIDTDGLSTIFSWYPCGSGFTGHLAGYYGWGQLKNTRFFTHADNQACSKGSTDIHLNGGMIQIGYIFLLSKKLAIIPYIESILSRVGWHSYKETIGVLPCTISSHKEVCLEKSIGLFCQWNISASTQLQCWGIRTSGTSNVDKVTSQPTRGPNTYTIVVPNYKKKYMRTELGLSYSSKLTDFFTIVLNSNAQFNSNKRHIQNATVHLRYTY

SEQ ID NO: 14728 - protein, 416 aa, Cytophaga hutchinsonii
MNKLKALAVLLLISTMAYAGGYRVSTQSNRQLAMGHTGVAVVNSADILFFNPAGLVHLENKINFSAGGFGVFSSVSYQNSDFGTSSETDSPTGTPVYAYGTYKINEKLAVGLGIYTPYGSNVTWPTDWSGSHLVNEIELSAIFIQPTISYQLFDSVSIGGGPILAIGGVEFNRNAGQSLTDEQGNRSNVGIEDTGVTAWGWTAGLMFKPDEHFSLGFNYRSLINIESTEGTATFSNFPNSALTPSNGTTGFTATLPLPAELTVGIGYEWKKWLFAFDYNRAFWSEYESLDLVFENGSTSINPRNYKDSSSWRLGAQYTATDKLIVRAGWYYDQSPVQSGYFAPETPRNDSLGYTFGLSYQVNSKLAIDASFLYLRFKEVNESYDFFTDPGATTPSSFGGTYKSQALIPGIGVTYSM

SEQ ID NO: 14729 - protein, 675 aa, Cytophaga hutchinsonii
MVLTPFLSRIAFFTLVALSTCAAAGAQNTQGNKSQPEQDDSDIALLWNMPLADLLQVRVTVASGNPESITEAAGTVTSYAAQDINKLGLNTLAQLASLTPGYSTYSNIGEHTLETRGQKAGGFDNNRHLLLIDGIPANHIRAYTAQVDHNLPLHFADQVDFLRGPASALYGVSAFYGVISINPALSNRRSSQPGTAVQVQASDNTSSIKFNRFINTDTAQGLISASHYQQQASLEPVASNPSQLNFDNQTSEFAFSKWQWDKGALTGLTAGAMYSSKKGGLGNFWADYSSDKNHITWKNFLAYAKYEKELSANLVSHSYIKYGYSSEDAEYYNATESERSAYSYPFHNYQAQTELHWHLEGAQHITAGINLDSRYGEAEDVEVAGVSRVTPKTPTVLTQSFYVQYKNEFDVLDGSLLTLGARLDNGSADSESYQQVSPRIAFVQKFNRWLSVKTLYAEALRGPSVKELGVNNEVRIEQPSVELQDLKPETIRSVELAPYIELNNWLMGLTFYSNKTSRYLARDWSQFGEYINIEQGFTSTGIELELNYAINKNVKLFANASSSKTEDNSGNAFLDVPRKKINLGWMWSMLGSAPINGAVTYTSVYDYANNLTNTNANNSAASLVNVNIAYPMNRHMQVGLNVTNVFDDRAYWLLNGEANVQMPAREARLDLTFSF

SEQ ID NO: 14730 - protein, 784 aa, Cytophaga hutchinsonii
MKFILILLSLFSITTAIAQDKQAVISGTVTYNGDPVPFANVYVKNGTNGTSADIDGKFTLNVPSGTIAIVVQSQGFRTQTKQISSEAEITQEVNFSLVEDVLGLEEVVVSATRNRISKKEAPVIVNVLSSKLFQATQSISLADGLNYQPGVRVETNCQNCGFTQVRLNGLGGQYTQILVNSRPVFSALNGVYGLEQIPVSIIDRVEVVRSGGSALFGSNAIAGTINVITKEPINDSWEISSNLGIIGGEALDRNVNLNASTVSEDLTSGVTVYGIFRNRDAFDANDDGFSEITKLTNNSLGAKAFLRPNDNSRIGVDFTGIKEYRRGGDRLDLAPQFTDITEDLDHNTIFTGVDYELFDDARKNSGTAYVSVQNTDRDSYYGGLGGGRTAADSIVANNAFGKTTDLAFVAGTKYTRNFKRDVFTTGLEYQLNDTKDAIPGYNRLVDQKVSSIGLYAQYEWKPSEKFTALVGARLDHVDVDGFYTIQDVARSSNVSETVLNPRLTILYNINEDLQFRGGYARGFRAPQAFNEDLHISSVGGEQRFVIVSDDLESEFSNAFTASFNYTKDFNKTQTNFLVEGFYTTLENPFTIVSTGTSLPNGSILEESRNGSGAFVAGTNLELSVSPSSDFLFQAGVTIQRSIFKEDQVLFEADGSVPGEQDVILEEFVRSPDVYGFLNVNWTASEAFRFDVTGSYTGPMIAPRVISDSGFIDLVDTESFLDMTTKVTYHFDLKDTFHVELSGGVQNLFDSYQDDFDRGAGRDSDFIYGPNRPRTFFVGLKFGDF

SEQ ID NO: 14731 - protein, 750 aa, Cytophaga hutchinsonii
MLKLVSKTICLSLIGSFTALEAFQKHQKDGFFIEAGFETGLLQGTQTQEQTIAATQEKPKPKPKPKPKPKPITPQSTYGKYYISQSTILKNATELFAENNITNLTFYSLNPVYVTAYNQESAEEAGYGDSSLIMIQNFLPYNLNNIELSYTDDQGNVVSLGVIETIPKQSQIILPASLFNDPQLNVDGFQQLQTTTTKFSDASTQNLFDKLSKVTTNLQMTYINYNQFSSGNGTGSKPPCPPYENQENCVAKVPPFTSQDAKNLTNLMLNMMAVFDSKSWEDAIKNAPFQFSDNNLSKPCYSDYSTCVNPYNDGLVDPKLIAKNAGDEYNIENGQTGSVILTPQDVIYSYRVTNNLYVNLLPPRGGDLGLGSQYGGPNGPGDDGTNFGALGILSPFLDPEILFGKELNKVAIMQLRDIIHEYGHTLGYTHNGNMTYQRVRMCEENNGPEERCKGGKIEQVNGQEVQVFDNGHEVRDTDGSTYDVCSRFGGQNQPAFPSSYPNSIYTDCSQVPAGLIGVTSAVWQQLIDQNALPVDYTNLSSQTNYLNASLNTQDFATTMLSAISQSLSSTKSSTTTYRTSKTSRPFGAPLLGVNLKMGYQKYFNDYLGLSSYGIIKYNYAQANNEKIQQLSYGVGMDVLFDFITNYTNEKNPKNNLTKRVFTSSLGVFGGLRGLYNSYYLLNQYKGSGNLNVTGGLNYRYKHSKYSVGISVPLVQLKSRVVSSDGTTTNSITLNEGGSHFKVFFNYGWIF

SEQ ID NO: 14732 - protein, 1171 aa, Cytophaga hutchinsonii
MHACRTQLLSILIAAAVSVTTAWSQESRATVLGRVTDASGAVIPAAGITFLNQETGVTTRTETNQEGNYISAFLIPGTYRITAEKMGFKSLVRSRVTLSVNDRVELNLTLEVGSQAESVTVTADASLLDSANVAVGRVVSSEEVRNLPIHLGDVDNIIRLGNGVAFTDEPAKDQPWQPLNTAYSMAGSPSSRNEFTLDGASNTFHDEARSAVGQAWTPIADVVAEFKVQTATFDVSTGSTEGGVVNVSLKSGTNKIHGSAFFNKETASLDANSFFANAAGTPRANLNLTNPGGTVSGPVYIPKVYNGKNRTFFLFGYNWVKSIASGGTAGGIVATVPTAAERNGDFSALLKLGSVYQIYDPFSRTPAAGGLFQNQPLPGNIIPANQINSVAKNIVNYYPLPEQPGALNGTNNLDRTNWPSRVVYHSTVYKFDHNISDRNRVMFRVTTNRNDNHSVDYFGYDNPSVGALFYQKSIGFAFSENYSFSPTLNMDVRVSDASFVRAQGPNDAGRAFTLSSAGFPLYLQNALGPSQRNFPSFAIPGYTSLGDRAPLYKNTETRSAGVTLSKMRGAHQIKFGGEYRIDPENRAGVSPTNGNTPLAFSAPTAYTVGPLSNAAAAPIGQGLASFLYGIVGGSITVPSTTDFAEIDKSIAAFVQDDWKVTRTLNINLGLRYEFQTPLTERYNRSALGFDPTAAMPFAAQAQANYALNPTPEIPVAQFLPAGGLSFAGVGGKPRGLYNAPKTEFMPRVGFAYSPNSKTVIRGGIGIFYGSLGVRLQDAIQTGFNQATNVVASNDGGITFASSLSNPFPSGILQPTGASLGSLTYIGNSINFFNQDPRPPQLLKYQLDIQREFAGFVASAGYLGSRGANLEVSRSYKPFPNQYLSTSPVRDQATINYLSASLPSPFANIPIFAGTGLAGSVISRSALLSPYPQFSGIGYYTYDGQSWYDALNMKLEKRFSHGYLVSATYTFSKFLAANTLLNAGDTAPAKFLSPQDYPHHIAVSAVYELPIGKGRPLFPGIKGVPRLIIGDWNLSYVYTYQSGPPIAFGNVLLTGDPKSIGLDSAGRSAAQWFNVNAFNRVTAQQLANNLITLSPTFAGIRAAAYNSSDASLIKQVPIHESIRLEARIDSLNIFNQVSFGVPNTTPTSTAFGAVTTQKNVPRRLQATIRLTF

SEQ ID NO: 14733 - protein, 717 aa, Cytophaga hutchinsonii
MLLFCLSIKAQTNDIQIKIVTEENEPLMGATVYFETLEKGAVTNFDGIAEFTKIPDGQHQIIISFLGFETFETSIQIPSNTALVFKLKEGANQLETIVVQSTRSTRTVKKIPTRIEFIGVEELGEKAIMNPTNISMVLRESTGIQMQQTSLSSGNTNIRIQGLDGRYTQLLRDGFPLYGGFSSGLSILQIPPLDLQQFEIIKGSSSTLYGGGAIAGLINMVSKTPDFEPALDIMLTQTQALGSTANVFYSKRNEKFGFSLYGSAHYQKAYDPEGDGFSNLPKTTSISFNPKLFYYPSENTTVWLGLNGTYDDRIGGDINKIENGEEGIHQYTEENNSKRLSSQLVYQTQLDAVSSLEFKNSVSFFDRNLTVPDFNFDGKQTNTFTEISYTTASEKTDWIIGANLYTSNFDENDNLPLQRDQKDVTFGAFANNIYDLSDNWILETGLRADYNTDFGFFPLPRISLLYKNDNGFSSRIGGGLGYKIPDIFTEEAEYINFENVLGIDKSTTNAERSYGVNFDFNYQTRLSDEIGFSINQLFYVTAIKDGLLLNSTDNGLFQFENATDEILSKGAETNIKFTYKDFRWFLNYALIDTKLNYLPGNPQKPLTAKHNAGSVLMYESEKWRIGYETFYTGKQFLSNGTETTDFVTMGLLVMRNFKLGSVFVNFENFTNRRQSRFSPLVLPPHENPVFPEIYAPTDGFIFSVGLIIKPFGNKEQD

SEQ ID NO: 14734 - protein, 696 aa, Cytophaga hutchinsonii
MKKLCLSVCAISLLASNAISQNVELDSSIISASGFAQDIKEAPATINVISKKELQSKPYRDVAEAIADIPGVDLYASKGKTGSYNITMRGITGYTLVLIDGRRQGIGGEVGPNGFNEISNSFLPPISSIERIEVIKGPMSTLYGSEALGGVVNIITKKVSDKWETSVSLDALLNENKDWGNTYGTSIYSSGPLMNDKLGLTLRFREFYRQQSNVEFTNGSGQRVPGDQAQSPTKANNFNIGTRISYLANDYNTFIFDIDFSRNHYDNKKGQLGTITKPGDKGSLIGGYTDIMEVDKFVTYLSHEGVYENFSITSGLQYNRVSNNGREVVGQATQPFLGENRDIVAEDIILDTKSVIPLGQSHILSVGGEYRLEKMQDKIANPTNFDQYLLAIFAEDEYSIKDDLRFTFGARYNHHEIFGNNVSPRAYLVYNPTDELTLKGGVSTGFRTPYANRLINGAYNYSGQGRFPIYGNPDLKEETSLNYEIAAIYNNDLFYVSATGFLTNFKDKISTQRYDKNNMIPGIGTCNADGCFRAINHGKVEYKGVELGAGISPLDNLNVNFAYTYLDSEVKEAQDKSVIGKPEQDSLKHNIMLKTEYSFYNKITPWIKGEWQIDRYMGDTNINREYYKDIFLASMGVRYDINKQWSINAAIYNLFNKSFTDGWESYQNSGTTTTWVNTYNRIEEGRRIYISINGSF

SEQ ID NO: 14735 - protein, 956 aa, Cytophaga hutchinsonii
MKKNYVLRLMVMFLFSFSFFAQEVEIKGVITDQDNQPLPGVTVVVEGTNRGATTDFDGNYTIKVEKGETLLFSYIGFDPQKIKIENNTTINVTLKMGMQLDSVVVIGSRSPGRTTVNSAVAIDVFDIQQLTKASPQVNLNQILNYVAPSFTSNTQTISDGTDHVDPASLRGLGPDQVLVLINGKRRHTSSLINVNGTFGRGSVGTDLNAIPAAAVQNIEVLRDGAAAQYGSDAIAGVINIILTDKTNELQLNVTSGANFSRNANSQTGGVDGETTNVSASYGLDLGDKGGFINFSGDFDIREDYNRMKEWEGDVYNRYNTVERFANADGYDITNLLDNDVSDVIQYGNQAGFNLDPNATKEQLQDILSVDNTSAELEARNQVRSDFNMRVGQSRLRGGRLFVNFALPLDDDGTELYSFAGISSRNGNSAGFYRLPNQSRTFTPTYINGFLPEINSKVKDESLSVGIKGSVGDWNVDFSNTYGKNSFLYVIGNTSNASLQNASPTVFDAGGFSFAQNTTNLDVSQFFEDVSKGLNVAFGGEHRLETYEIVAGQESSYSQYTSAGEVITLASQQPATDFFGAARPGGAQVFPGFSPKNELNRSRSSVAGYVDVELDVSEEFLLSFASRYEDYSDFGSTVNFKLASRYKLTDNVNLRASANTGFRAPSLHQLNFNSTSTIFDQNGDPQEVGTFANDSRAAELLGIPELKQEISRSISLGLTGKFPEANLTFTADAYWVGIDDRVVYTGQFTGPGTGTELDNLLRQANASRASFFANAIDTESRGFDFVITHKTNIGTNSKLNTDLSGTLSQTRQVGDIKASEVLTNAGLVDTYFPQDSRVYLEEAVPRTKINLTNNYTVGNFNVFLRNVFFGKVTEATPTIENQQIFSEKLVTDLSFGYVASPSLTFTLGANNIFDIYPDRAEDAFGNRSGGRFDWSRRAQQFGIAGRFLFARMSITLQ

SEQ ID NO: 14736 - protein, 1148 aa, Cytophaga hutchinsonii
MNKFKWRSFLSFFLTERNIRLVRLMSFILFLFVFQGVYAQQTRINLHVKQVPLKQVLKSIESKSEYTFFYNDAEIDMNRKVTVQANNERIDVILSKILPDCKCVVENRKIILVPGAEKQNTPNDNTAKTKEITGTVTDTRGETLIGVNVTVLGTTTGVITNIDGKYSLKVPAGKSLKFSYVGYIAQTVKVGDKSVIDIVLEENSKALDEVVVVGYAVQKKVNLSGSVATVSTKAIEDRPVLNMGQALQGAVANLNVSVGDGEADDSPSYNIRGTTSLNGGSPLVVIDGVVSTSDQLNRMNPVDIANISVLKDAASSAIYGSRAAFGVILVTTKDGSNEKLTVNYNNNFVLRTNTRMPEIITDPYLVATTRNTMAYPWYNLYNEEQLAYAKKCSEDPSTSPYFLNPDGSYTYFGRTNWVDEAYNDVGFSTIHNIDISGKTDRISYYFSGGYNRQNGMFKYGNDIYNRYNLRTKLQFKLTDWWSLNSNVSLTTSDYDYANAMTNTYKQMYRKNPMDMVKNPDGTWTDASVGTLGALAEGGRATDWKTNTNINLSTKIDVIKDVFFVQGTFAFSNTKTRSNWYNLPVTYRNGPELPVLTFNPISTVSDASSSNSDTKHILFDVYGTFQKTFAKKHAVTAVVGFNQEEYKYDYVKANRKELISSSLPTINLATGDMNMSQSITTWALRGAFARLGYIYNDKYIFEFNGRYDGTSRFPKNDRFVFNPSVSLGWVISREKFFEPLTGVVSFLKLRGSYGSLGNQDVDAYAYLATMGSGKISQILDKQQPVYVGAPGLVAGNLTWEKVTTTNLALDANFFDNRLSITGEVYVRRTKDMLTPGVTLPSVLGTDVPKQNAADLKTEGWELTVGWKDQFKLAGKPFYYDVNFNLADSRAYITKYENPKGLLGDYYVGKEIGEIWGVETLGFFTSEEDIKNHADQSWCTSYPGTRPLAPGDLKFKDENKDGKITDGAWTLEDHGDYKIIGNSRARYTFGLSANAQWNGFDLSLFAQGVGKKDYYPGTGDLYFWGIYAQPWTNITKGNMYDHWTEENPDAYFPRMKAYVAENTDRECGVVQTRYLQNAAYMRLKNLTVGYTLPKVLLNKIGIERLRIFFSGDNLCEFSGLYKHYKVDPESLGNIVYPLQRSYSFGLNVTF

SEQ ID NO: 14737 - protein, 716 aa, Cytophaga hutchinsonii
MQFLRFFTVFFILLAFFAMLNGIKVTGIVTDEENKPVEAVRLISGKKTTLSKQNGNFTIEITDSLQVSRLGYKKQVLSIQEVIALPKTASGIQIRLQSEPVQLSTYRVFAYLSEENISPADVVTLPIDPDKHYSSASELISQTASFQNYGTQLKGEIAEINILGNISRHTLVLLDGIAMNTLGEPFDFSRLNLDNIESIEVVKNNASVYGGSSAIGGIIMITTKQGSALKKNLESKTEIGSYGYLLQQISLSGISSQNSYRLCLNAYNADNDFPIPKGDLIPEDSANKRKNNSKQQLSFSGAYSTHLSKLLMSISTDYLTFQRELPGPLNFADLYYKAFLEGSSLRPQIRFSANFGNFTWQSNNWLLKDETVYDNTQSLIEGFSQKYKQKNDNYGIKQSLSYNKNSLQASLSGEYVYNRYRYQDLINPFQGKIDYVRNQLAFSLKLNQQKEFAWLILNNGLVGRYDYIDGEDEFSGRLEFSLRNWGTKYLETGATIGNSFALPTPYDLYWKGDSQTLGNPNLKSEKATGYQIWLKGNIPQATLKATFHQNTIKNLIQWRQVQMYGPVWKPMNIGRAEIRNLELEGNYQPLEQLEFTASAVFTKAKDTTYYSFAEAPKLMYRPETLYSLAIDYQPGIFHFWTKYSYTGKQWITPDNLIDPISAYALVDCGISLHWQKGNWKFTPAFTVKNLTDENYMVHAYVPEPGRTFYATLQLNR

SEQ ID NO: 14738 - protein, 869 aa, Cytophaga hutchinsonii
MCWRVWCKQRITLVHDDNVANSTSAMTLTCATQPQFDMELRVVNGLERTAAAALDAAWEGAPALHPFPTRSCHRMNCKTSPLAVAVVLALSFSASTAAAQSQAPTQKTLDTLIVTGTRVADRTVAESASPIDIISPQALESTGTTELATALSRAIPSLNFPRPAISDGSDAVRPAQLRGLSPDQVLVLVNGKRYHSTALINLNDTQGRGSSPADLNTIPIAAVERIEVLRDGASAQYGSDAIAGVINIVLKGSGEGGSVNGRYGKYSAGDGEQYQVSGDAGFSFAGTGKVHLAAQAGHSDQTNRALPYQGRVEQRYGDPEIDQGAVSFNGEYSPTDYLTFYSFGMVSRREVLSNGYFRSAGDNRNRPEIYPDGFLPQIYNVSKDVSWVGGLKTSTEGGLNIDLSYNYGQNNLTFDVRNSLNNSLGVTSPTDFHAGTLEVTQNVLNADFTKTLDWGLAYPVTLAFGAEWRGEKFNESPGDAASSANGGIPSANGSLIPGAQVFPGFKLSDSGYYNRNSHSAYVDLEADLTAKFSAGLAGRYEKYSDFGDTATGKLSLRYAFTDKVALRATASTGFRAPSLQQQNFQSIATQFLNVAQPDGSVTAIPFEIGTFRTDNPAAIALGAEPLKAEESRNYGLGVVLQPVENLYITVDAYRIDIDDRIVLSENLTSDAARNYLQTNGFPGIGGGRYFTNAVDTKTQGVDAVGTYRWNLDGGSAELTSGYNYNKTEVKRIADNPAALMAIDPNAVRIGRAELGRITEGTPRDKFFLGGTWSPGNWSFTGTATRWGEFSTFGTNAGSDQTYAAKWTLDLAASYTLGAWSFTVGGDNVLNEYPDRQQAGLGTRTYLPYSSTSPFGFNGALVYANVNYKW

SEQ ID NO: 14739 - protein, 726 aa, Cytophaga hutchinsonii
MITMACSLQRSARTGLLLALIASASGAALAQATPAAPAPAPAAAADDGGIAEIVVTAQRRAQNLQNVPIAVTALAAKTLEAANIQGTPDLVILTPGLTFNSVGGYGQPRIRGIGTTADTPTLENPIATYVDGVYYAHQGGSILSFNNIERIEVLKGPQGTLFGRNATGGLIQIITREPGQAVEGEASLSYENYKTLTANAYLGGGLSETVAADLALYVRRQGDGYGDNLVTGQEINKTDSFAARSKWVATPGDHTKLTFIADYARNSGATAQGPAPGTTPPGGTPLLDGQDVAVPAPYRNRFTQGGASLKIEHEFDVLHFVSTTAYRKSRGTIFFPNAVTDPAFLTLVKLYDRAEQASQEFQLQSPAGAGLDWTAGLYLFYADGGWRPAALSGGGLAPLTGIAFDSGQKTYSGALYGQSTIHLGEGTGLTLGLRYTIDRRKWHAEQSFDAPFPLGPFADEGKKTFRKLTWRVSLDHKFDSGVLVYASANRGFKSGGFNDLVIPATPYLPETLDAYEVGLKSTLFDRRLRFNAAGFYYDYKNLQVTRYSNGILVLYNGAGAEIYGLDLDAEASVSSRLRLGLGLSLVHGRYTSFPNADITTPAPGGGTIIATGSAKGNRLSYTPDWTLNLSADYSVPLPNGSLDLNMTYYHSDGFVGSPDERLRQGRYDTLNASFGWTSRDKNWAVTAFGRNLTDKRYAAAIYAQANGDGVQYAAPRTYGLRVRRSF

SEQ ID NO: 14740 - protein, 448 aa, Cytophaga hutchinsonii
MHCIGRRNNRASAHAPIRVDPSVARTPTRKAPERCPLLRSPSDCIGGLTHCRCAFPEAGITTGHHHPQRKETSMSRIKFALAATAAAAATLAASAAHAQSNVTLYGLIDTTISTVNNTNAAGARTTGFQVPWFSGSRWGLTGKENLGGGTSAIFKLESEFETPTGNMDTPGVLFNRDAWVGLSSESLGKLTFGRQNAIARDISGIYGDPYGSASVTLDEGGYTNVNNFKQLIFYAGSATGTRLNNGVVWKKLWDGRFFTGLAYQFGEVPGQFTQGTTESLALGYNGDNFHLAGFAQQAKVNGFMDRSYSVGGNVIFGMFRVNAGYFHYTGEQPAALGNRKDDAYTVSLKIAPQGAFDYEIGYQIMKAGNAAFSADGNTLNAYANVAGATAAGSGRKNTLYGSVFYHVSKRTEFYVAADYMKLKDQYIVGGTNGHNSQTEFAVGMRTRF

SEQ ID NO: 14741 - protein, 777 aa, Polaromonas sp.
MNESRITRNNEAVYKPEELDILRLGLDTDLYPNVDWMDMLLKDGAWSNRINLNMSGGGTTARYFVSASYVKEDGMYNTDESLKDDYNTNAAYHRWNYRLNTDIDITKTTLLKVGVAGFLSKRNSPGLGDGDVWGELFGYNPIKTPVMYSNGYIPAIGSGNKTNPWVAATQTGFNENWTNNIETNISLEQNFDFITKGLKFVGRFGYDSNNQNTIRRLKWPEQWLAERARDPETGELRWKKISGSQNMKQESSSSGNRREFLDMMLNWDRSFGAHHPSATIKYTQDSYIQTQNLGEDLKTGINKRNQDLAGRVAYNWNYRYFIDFNFGYNGSENFAKGDRFGFFPAFSLAWNIAEEPFIKKHLKWMNMFKVRFSYGKVGNDNVGTRFPYLYTIADRYKNGDNEIIYGGYDWAQYPSSYSFGGLGFADVASNGITWEVAEKNDLGIDLALFNDKFTATIDYFDEKRTGIYMVRNYLPQIVGLNGHNPAANVGAVSSKGFDGHFSYKQRINDVNLTVRGNITYSKNEVLERDEENNVYAYQMQRGYRVDQCKGLIAEGLFKDYDDIRNSPTQSWGKVQPGDIKYRDVNGDGVINDGDQVAIGATSRPNLIYGLGASASWKGLDVNVHFQGAGKSTFFTYGKCVWAFTEGEWGNIFKGMLDNRWVDADTAETLGIPANENPNASYPRLSYQGDNASNNNYRNSTFWLKNGRYLRLKTIDVGYTLPKSIVNKMHFNNIRIFLVGTNLLTWSSFKTWDPEMGDPRGESYPLTKSITMGISVNL

SEQ ID NO: 14742 - protein, 635 aa, Polaromonas sp.
MRSLYTLLLIASTSLSISAQDDVEDFDLEALMNIEVTSVSKSEESSFTAASAIYVITEEEIARKGALNLAEALRGTPGVQVSRRTNNTWEVSVRGFDNLYSNKLLVVIDGRSVYSPVFSGTYWEYTNYPVADIAQIEVIRGPGATVWGSNAVNGVISITTKSAKDTKGGLAKLDYGEYNESYYLRYGETLDKDDKLHLRIYGQFQQNNELEPGVNLKNTHEDDRWDYLQGGFRLDYDVTAKDTLTLSSDIYQSDFKQYNALVINNFYEDGDTKGYNFTLNHKRQFNSKEHWSTLFYYDYQNIEQDVTLDSTVHSFNLESDYHFSPWDRHEVTIGAGVRTYRSKLKDGTSQLDFQPSDETIANYTLFVQDKIALQPDRWTLTLGSKFEKNDYTDYEYQPSARVAFTPDRKNTYWAAVSRAVRTPSRYEHGSDIFFGAAVGNNDVDSENVTTYELGHRILVNEKLSFDTTIFYNDYSDLVITETNPGPDIIVNDLNAESYGIEISSNYFVTHDWQLKLSYTYFDADFDYKDGTADTLPVEKAAAKNKASFYSFYSVTEDIKWDVMVYYQDSKNPSYNYDPQDGTPSFIKLDSRLSWSPREDLEVYIIGQNLWDHSTRETLYYAETPRTFYVGLNYKF

SEQ ID NO: 14743 - protein, 360 aa, Polaromonas sp.
MKTHSTGCRAPLLGLSLLALACAGHAQSSVTLYGVADAGVRHGSGLTAAYGGSADSSNAVNSGINTTSRFGFRGSEDLGGGLKAIFNLESGVNLDTGASASATKLFDRAANVGLQASWGSVTLGRQTTVLADVVSATDPLGSRFASFNPNVGIAALSAHRLGAEFGPAGSTTGAYRLDNSVKYVGRFSDFSVRAMHAFGEQAGNSSNLSSSGVGAGYQSGGYTAALSYAQFRNAAGLSLKGYLGGASAMIGSNKLALTYGSHEAETSATAKTRNRTLGLGGTVPLGASVDLILAHYQVKRTRTAAVDDGFNRSVAFLEYKFSKRTRAYAELDHTRWKNGYQGAAFKSSASGVSAGVVHSF

SEQ ID NO: 14744 - protein, 355 aa, Polaromonas sp.
MKKIIILLTTFFLLSGCTIPRAVFKSSLINQDDPRYNLVEVTPTLKLSAPDTVPKTIVDPVFAANNWHWTSLAKGDVLHITILSSGGAGYLSNNASGDRADFENILVTDSNTVQVPYAGTIPVSGLDVTQLADEIKKRLSRVVLNPQVIVTLTARTGAMVTVEGSGKTGRYPLEQSMNRLSHLLATAVAVENTSTDMMEVHVTRQQHYFTARLSDIYQYPGLDIALQPDDRITLRQVTEYVNVLGAAGVQGKHALVQRHSSVVDALALAKGLNDNLADPQAIFLYKHNEAEQAKQQMRKLNIYHVDMSQPNSVFLAQAIRVDNGDVIYISNASLTDFAKVKAAFDSFLTRGTNSF

SEQ ID NO: 14745 - protein, 897 aa, Polaromonas sp.
MTKRPIFASLLLLSTALVAPAALAQGSGADPAPAAADEPVADAAAQDEDADISIPGGADAEIVVTGRFTPNVVRATPEVVSVLSSADIARTGEGDIAGSLQRVTGLSVVGNGFVYVRGLGDRYSLALLNGSPLPSPEPLKRVVPLDLFPSNVIDSTLVQKSYSANFPGEFGGGVINLTTKSTPRETFLTFSGGVGWDSETTNELGYTYYGSDTDWTGFDDGTRDVPPLLKAAFASGKPILEGADFTQDDLEAIQMELVNAETSLLQQNDHIPINWSAGITGGTTITLPNGELGIIATMGISNKWRTRDTLQQTSLNQDLSGDPQTSFNRVITDNRIVVNGLLGFGLELGDHKFRWTNLFIRDTLKQARLGLGVDRNQSERDILEQDTAWYERQLINTQLVAEFDFDRLQLDLRGGYANSQREAPYERGFTYVRTNLPTEQDPTGDKFVNDLGGNRGDATIAFSDLTENLWSGGVDLSYEVAPRITATIGYAYSDTSRTAVRRAFQFRGSNLPVEVTQLRPDYLLSDATIQLYDISLLETSAQDGTAAFDAALTTHAGYGQVQAEIIPGVNINAGVRYEDARQTVRPIDLFNTGSSAIVATNLNNDYWLPAVTLTWEVAPDMQLRINGSKTIARPQFRELIAQVYQDPESNREFRGNPSLTDSELWNAEVRYEWYFDRDQRFTLAGFYKSIDRPIETFTSISTDSVANSSFANAPKATLYGAEVEVQKYVPLDTLSDAPFWQSRRLVLIGNYTYTKSEIKVGDDDTTVINGVTLSAADFFFDGSPLTGQSDHIVNFQIGIEDQDKLSQQTLLFTYASPRVTSRGPSQQPDIREKPGISVDFVARQGVTLLNKDIELKFEARNLTGRTYKEVQEAGDNRIFLNRYKLGRTFSLSASLKF

SEQ ID NO: 14746 - protein, 223 aa, Polaromonas sp.
MKKSLFLLLPLVVTNAHAVYVDVRHEYLDDSKANYDRAYISHRFANGFGFAIEAISKSGGDDTDRPFNDLEVQGNEYTVSYQFKTGEVAWQPGFVLETGNGYSNYKPYLRATWTLNESWWVGARYRFEYVRRSSDAREDDTVNRMDAWVDYKWNNFDWTIEGIYKKADKYNLYDGGKDNYEYNFRTAYAIGQWTPFVEVGNVSVNSTSDECQTRFRVGLGYTF

SEQ ID NO: 14747 - protein, 373 aa, Polaromonas sp.
MKISSLITLSGLLATGAVQAQTQSATLYGMIDTGVEAVSNVSGAGTLTRMPSTTGILPSRLGFRGKEDLGGGLSAVYTLEMGFAPDTGASGQGGRLFGRQSTVGFSGDWGAVTLGRQWTMLFWSILDSDIVGPAVYGLGSLDSYIPNSRIDNSLAYKGKFGNVTVGGTYSLGRDTVNAGPSPAGTNCAGESGADTQACREWSALVKYDTASWGAAVAYDSLNGRTPASGTDVVLPAGLTSSAKSDARLMLNGYVKFSDVKLAGGVIRRTNDGSATKPKSDLWYVGASYPLSPAWTIDGTYAKLSYKDIANFDSSLLVVRSLYKMSKRTTLYVQLGGISNDSLANVSVSGGAPGSNPALGDSQTGVMLGMNHAF

SEQ ID NO: 14748 - protein, 828 aa, Polaromonas sp.
MLAVNECNRTLPINPTKASLARAVHRALFSVALATPLATAMIAQPAVAQTQAEMRFDIPAGALGTALTQFASAAAVTLSFEPSSVQALHSPGLHGRYSADAGLRQLLAGSRLQVLKQGSGSYSLLPMVGDDSTLQLDTTSVTGTAVESAYGPVSGYVASRSATGTKTDTPILEIPQAINVITADQVQAQGARNLTQALRYTPGLATGGFTDRNSIADEITSRGFAPTPLYLDGAYLPYAGSLGGAPQIDPYTLERIEVLKGPSSVLYGQNQPGGLINMVSKRPTREQRSQVKLGAGSYNRVNGAFDTSGPLDEQKVFTYRLVGVADKGNEMVAHAHSERLLLAPSLTWAPNEDTSLTLLAQVQRDDGLPDYQTLPMIGSLKRGPTGQHIDRDFFSGDSHYNDYKRNQYIFGYDFNHRFSDELAFRSTARYTDVRDRYKGFYLRSFVTEGDGVDYTRANRVKLDWRQHNISYTVDNNLEYKFNTGALQHTALAGVDYRHFTRKYDGYNAYNVLPVDLYGKNNFDTSSITPVLDTRWDNTVRQTGVYLQDQIKLDNWILTVGGRQDWAEIDNKDLLAHSIASQRDSKFTGRIGLTYVTEFGLAPYVSYSQSFLPTLGTAAPERGGKAFEPTEGEQYEVGLKYQPFEGTLFTASVFQVKQKNVLTGDTEYPQYESQNGEVRSRGVELELKSSIENVDVLAAATYIDSFYTKSTYGDQGNRNESQAPVSASLWVDYHFTQAMLNGLTFGAGARYTGRKPGNSANTFDVPAYAVYDATVSYDLGKLDPSLRGLQASVNVQNIFDREYVSDCNYAFGCYYGQERVASVEMTYDW

SEQ ID NO: 14749 - protein, 861 aa, Polaromonas sp.
MKISTPRKLSAVFCALATTGFTLSTPTFAQDGADVERIEVTGSRIKRTDMEGPSPVQSISKDDIANMGYDNLQQLLERMPVAGNGTFSTRGNSQDSTANGAAAVSLRGLGADATLVLINGRRVAISAFAESITNSFVDINSIPVSAIERIDILKDGASAIYGSDAVAGVVNIIMKKDIEGIEVNLGYGSAQGPSYEETSGSLVWGTVSAKSSASIILDYYKNTRLNSNEMGRLGTADQRPYGGEDFRSSRGFPGYFRVDGVKTIDPSCPSDRAADNGSCLFDYGPYGFVAPASERIGAISQFEYRFDNNITGFMEIAVQHNTSEAGGAPTPLDEDAGLTVPANHPDNIWNKDIEIGRFRTVDAGARRWDIASDSLRFVAGLKGELNDWAWETAVQKGRSQSLQTGGRDQGWVRTDFLQQEINAGNYSPFGGVYNDPAVIDRITTSLVRRGESHMTSFDANISGEAFKFGSESVMMAAGVEYREEDVNDIPDDQFQRGLIFGTESVSAQASRDQFAAYVEFSIPLAENLELQLAGRYDDYSDFGTTTNPKVAFRWAPDDTVTVRASWAQGFRAPSLAQIGLGPSEKNLFFTDTYRCAATGQDCGKLDYVIRFAGNQDLKPEESESWNVGFIWAPIAEFGFGIDIWSITQDNKIAEQAFGPVYDAECNNQSSTVCVRLPAPPGQSLGVIKKIHSSFENISSQEVAGIDVSANYNYSLEEYGLLKFNLEWAYQSKFEKDGRDYLGEYNFPEHRWIFSTNWEMGNFNTNLNVSFVGEFEDTPDIDFDGTLDFDSNTSRKVKSQALVDLQTAYNVSDSTKVSFGINNLLDEEPPFAIGDGDLYGYASQVHNPRGRYFYTKITYRFN

SEQ ID NO: 14750 - protein, 456 aa, Polaromonas sp.
MQSLSGELQLMSTASILSRATLLAVGIAGVLAVGQAHGAAFQLKENSAKGLGRAFAGSGSAPDDASIMVNNPAGMRQLDGRLFQADVSAISFSARFQPESANYANGAPVSGGNGGDAGMIAPVPAMYFHVPFGENDNMHLGTSLTVPFGFKTEYDRDWVGRYHGTKTELQAIDFNVAFSYDVNPYVSFGASVFAERLDIDLANAVDFGSVLAARRVPGFAPGSADGYSRIKGDSTEVGFTLGGLFSIDENTHIGFSYRSQVEHKITDGTADFTVPGSAAAVLSVAAPGTFVDTKGRATVKLPASATASFTHNVNEQWSIMADVTRTAWSKFDQVTVDFASNQPDSVLDFSYRDTTFASIGADYRMSDTVTLRGGLAYDQTPTTAEHRDVRVPDASRKWVSLGMSWRPSAQTEYNVGYTHLFTNNPTSDTRSATGDRLAGSYDVKGDVLAASINYKF

SEQ ID NO: 14751 - protein, 755 aa, Polaromonas sp.
MKQYSGTQPGSRLFFIPWRTACSGSMFMLVFFMASQICYAQSATPGATLLKPIVITAPREEDSFSSRTKLESLPGGTSYIAAEEMPGAANLTASKAFFGTPGLIVQDFFGGNDQPRIQIRGSGLQQNPVERGILVLQNGLPINRADGSYIVGFINPRQAEAIEVYRGYMANRLSANVLGGALNFISPSGITSPNTRMMISGGSFGQLNLSGQAGATSGDFDGLIQADFNRRDGYRDYNDSRRFSVSGNAGWHLSEDVTTRLFASYTDLGFDVAGPLSKDQLKSSPRSVSAGPVVIPAGAIYPGPNVIRDQPERTASQFLVGSRTTLQFDRHILDLALGFTHTDDTFRFPVSSGIRETRGSDLTGVIRYTIESTDKNALPIFESAAYYTAGWADRKNYLNRSGTKGEHFGSNKLDATTLSLHANLNIPIHRNLTLTPAISYSRATRDNKDTYDSPTRPTLAYRPNDPTQLLPGGAVPYDSTRYKRSFDSWNPSLAMTFRPAAGQTLFTAISQSFEPPTHDDLLATVNGTPNSSAGRPNPANSALPAAVFVTPDLKAQTAMTLEGGWRGSHGIFTWDAVAYYAWIDNELLSLRDESGVSLGSVNADKTTHLGIELGLKAQLTEHLLARIAYTYQDFRFDNDPVRNNNQLAGAPPHFIQTQLQARIIGNLVMQAAVKWVPARIPVDNMNTLYVDPYAILDLRAEYRFNRNFTVFGETTNLFNKTYASSSLVVDQARSDQAVFLPGDGRAFFAGIKATF

SEQ ID NO: 14752 - protein, 390 aa, Polaromonas sp.
MNPRIRAAVRGCIVALFIPAVARAQGTVAISGLIDGGIAFVDDIGSHRGDAHAFQAKSGDANVSRLTLSGNEPLGADLNALFLLATGFAVTSGALGQQGRLFGFQSYVGLASGRYGTVTVGRQFDSTLQLVQPFALAGTPFGGVAFAHPFDNDNLANYTRTNNSVKYTSPLLGGFRFGATYGFSNEAGGFGNNRGYAFAATYEHGPFSAGASYLAFDREGNLPPANADGAEPAGAPFNAARQRTVSAAAAYTWDRLRVSAIATRTRLDAVTSINNVADAPIVLHGANITFHNAEINARYALTRKWTVAADYVFTVASFDGAAGAARPRWQQAGVIAIDALSPRTDVYTEALFQHANGLAGTGIAGAQISNFSRASGANQLVMAVGIRHRF

SEQ ID NO: 14753 - protein, 721 aa, Polaromonas sp.
MTLNTNMTSPKIPTYSLFYGLSCVLTLPVMAEDNDNEAMEVMTITAHKQEIASYKTGETSTSTGMDLSYLETPQSVTAVNEQAMKDQQLNSVVDVMNSVSSVYARPMDNDRYTVSARGMEVSTILYDGVPITYDTRFNYGDNLMDTAIYDRVEVVRGANGLMIGAGEPSASINLIRKRPTHDFNANVSVGTGSWNLKRGVVDISGSVNTDESIRARLVAVHQERDSYLDRYEQKRSTLYGVIEADLTTDTLLTVGTDYQYNEPKGTMAGGLPLFHSDGTRTNYSTSATTAPDWASAETTALNSFVSLEHSFNPDWVIKGTYTYGDNSLDFNYLWPKGFPDPNTNEGMVPGSINYIDGNRKINNLNLTLKGHFSLFGQDHQMIAGFNNQKMTFENTYYKGLNAQSEVGDFTDPNWSYPEPEWSREKSWESTGETKQQGIYVASHINVTDQWSFVLGGRLSDWETDMNDFGTLHKNKISNEFTSYVGTTYAITPIVAVYASYSDIFTPQNVKGKNNTYLDPIKGKNYETGIKASLLDDQLNLSLNGFNTLQDNLGIKTGDVDPNTGMPIYRGVDGTETKGFEFETNGAITDDWNLTLGYTYFKIEDPQGNRLKTDIPNKQLKLFTTYELGDVLEGLQIGGGARWYSSIYKEVSGIPNVGDTKVKQDSYAIYDVMVRYEVNKKLNVNANVKNLFDKEYYSQMGIYNQYHAGEPRNISVNVDYQF

SEQ ID NO: 14754 - protein, 204 aa, Polaromonas sp.
MKKTLIAIAAVASALTAGAAFAQSSFDGTSPWMVRARAVHLDSDNSGAAGDAGVSINNKWMPELDVSYFFTPNIAAELILTFPQKHDVRLNGDKIGTLKHLPPTLLAQYHFTNFGAFKPYVGAGVNYTRFSNVSILDGAVTVKKNSFGGALQIGFDYALDKNWSLNFDVKKVYLGTKVTGAGVFQDTKFKVDPWLVGVGVGYRF

SEQ ID NO: 14755 - protein, 236 aa, Polaromonas sp.
MKKLTLAMACTSLLLTPLAFAAGSSYVTGNVQIHDRADFNGSDTTSTLESGHTFDSGTTLLVEFDGIQLGQTTPNGASPAYITLGVEQMFNLNDNLWVAAGYHQLLHDGKATEYRPLVKIGYNFDNGIAISNRTRYQIQAYDAYNSIDEDITNDKIRFDNNIAYSFSDIDLNVKYNNVFYINEGDANRNSMEHELRATWTRNGVQPYIEYRNQEDSAKYNYGHNNNVLVMGASYVF

SEQ ID NO: 14756 - protein, 469 aa, Polaromonas sp.
MSHIQRETSCSRPRLNSNLDADLYGYRWARDNVGQSGATLAVLISAAIISSAQASEQSEAKGFVEDANGSILFRTGYLTRDKKQGAKDTSSVAQSAIVSIESGFTPGIVGFGVGVVGDGSFKIGENKNAGNQMIPKHNDGSAYDHWARGGGSVKARFSNTTVRYGTQVLDLPVLASNTGRMVPEYFTGTLLTSHEIKNLEVVAGKFTKDQMSDQINTDADASGRGLDRAIVWGAKYKFNDNLNASYYGLDSKNALERHYANVNFKQPLANDSSLTYDFSGYHTKFDANAHTYSATGTVAPNYAADGIAGEEKTNNIWAISGTYATGPHSVMLAYQQNTGNVGYDYGQNADGFQSIYLPNSYMSDFIGNHEKSAQIQYNVDFGKLGVLPGLNWTTAFVYGWDIKVRNVTDDAQEREFFNQVKYTVQSGFAKDASLRIRNSYYRASDAYQGAYIGDTNEWRIFLDIPVKLF

SEQ ID NO: 14757 - protein, 435 aa, Shewanella denitrificans
MIIARSVFSPIRFFPPGKRREGLHPLRCYASALSLWPASVGIHYVLPTTGFQCGSSEETILKRKTLALSIAAAGLCAGHAHAQSSVQLYGLMDLSFPTYRTHADANGKHVIGMGNEGEPWFSGSRWGLRGAEDIGGGTKIIFRLESEFVVANGQMEDEGQIFDRDAWVGVEDERFGKLTAGFQNTIARDAATIYGDAYGSARLSTEEGGWTNSNNFKQMIFYAAGPTGTRYNNGVAWKKLFSNGIFASAGYQFSNSTSFATGSAYQAALGYNGGPFNVSGFYNHVNHNGFRNQTFSVGGNYTFDIVRLNAGYFRYNGDQGPLGQRHDDSWTVSMKIAPKGALDYELGYQQMRIKNAANNADGFTPNANLGAFSLTNGVANGFKETIYGSVFYHLSKRTEVYLAGDYMKLHGGYTVSSTFGAKNQLELTSGIRTRF

SEQ ID NO: 14758 - protein, 705 aa, Shewanella denitrificans
MRMPFSLKRSVLLCGIALFTPGMTWAADTLVVTAKPEETASTPTEGYTAKISSGATKTDRPLITTGQSVSVVTRQQMEDQGAMDVNQALNYTAGAFTNFAGAASRYDTVSLRGFHGGDVDNIFVDGLRLMSDPGSFNALQIDPWFLDRIDVIKGPSSALYGQTVPGGLVMESSKRPQFAPEGHFRLSTGSNSTNSAAFDYTDAINEQWAFRLTGITRSSHTQYDHTREEKYAISPSLLWQPDEDTSLLLRAYLQKDPSGGYHSAVPGEGSITAHNGRKLSTGFYDGDSSLDQFKRREQIYSAQFSHRFNDTWAFRSNASYSHSNVDLDQVYQIGWDTNNADLLNRYYSGSRSSLNAFAIDNQLEADFATAEVAHRVVLGAEYHQYKNDLSDARGSASQLNALTGQVVGSNDNFTFSKSQRRYYQAGVYLQDEMTWDKWHLDLSGRYDRLVARTDNIDQETKFRRQDDHVGGRASLLYAFDNGISPYASYSQAITPQSLPGKDGNVLKPTTSEQYEAGVKYQPVGTSDLYSIAVYDLTQKDVGNRVIVGSYYVPAGKVHSQGLELEAHNQLTPRLSTLATYTLNHVRYKDAIDGNDGHTPYVTPNSMASAWAKYQFDYGISVGAGVRYIGKQWADNANTTRLPSATLFDASVRADLGAWNSSLKGAFVQVNANNLTDRDYVSACYGTGYCYWGAERTVMATVGYDF

SEQ ID NO: 14759 - protein, 661 aa, Shewanella denitrificans
MNKRYPVLLLLAPLSLSFAQELVLEKVEVKTKREVLTQQEVRESFAKDPGEALEEMEGVWKIRKGGIANDIVIRGFQRSNLNLLFDGARLYGACPNRMDPPAFHIDFAEVESIEVVKGAFDVRNYGTLGGYVNIKTIKPKKGLHGKLHVGVGSFSYLNPSLNLSYGTDSYYGLIGYSYRYSKPYKTGEGKRFTEYPTGMNAYKDSEKDSTAFRINTAWTKLGFTPAKDTELEISYTMQRAKDVLYPYLMMDSPEDNADRVNLTLKKNALKVITHYSYVYHRMDNSKRVNPTFMETIAKTKTYGAKVEYDLGKLTLGAEAFRWNWTAKTKMGSMPTQNTIPDVDITDLGVFGEYREKLSDRIRVVGGLRFDTTETKADESKANTTLYYAYHNTRDTSERDTYPSGNVQLFYRASKSTELFAGIGYSARVPDAQERYFALDRMMSQPDWVGNPKLKPPKNTELDVGVEFKTGRLSMKTTLFYSYVKDFITVYEQREVNNLVSGDRARSYANVDATLYGGEARADLALSDTLFLSGDLSYVKGKKDTDPSRNITDEDVAEMPPLKGRLALRYDTGVYFAQVETLMQATQDRVDSDLGETKTSGWAVVNLKAGGDLGGLRVVAGVDNLLDKFYYEHLSYLRDPFSTGSKVPEPGRSFYLNVSYLF

SEQ ID NO: 14760 - protein, 1078 aa, Shewanella denitrificans
MKLTNLIPIKAGKTLSRLCIIGALSLGSSFVFAQNQQVRLSGSNLTLKAAFKQIEQQTKLFVDYNTQDVNDSRVIKKVPAGDNVKNVLEQLLEGTNCSVTFSNGHIIISRKSPASSKTKKVTGIVKDEKGEPIIGANVVEKGTTNGTVTDLNGQYSLDISPSAVLLVSYIGYDTKEIRVDGKNILNISLAENTENLDEIVVIGYGTSRKRDIVSAMSTVKGSTISAASTSNVQDALQGKVAGLDIQSARYAGDDQQIYIRGARSLNAGNNPLIIVDGIPGSLGSVNTYDIESIEVLKDAASSAIYGSMGANGVILVTTKRGKKGVNREVNFNSYIGLNVPHMMPLQSGEEYVQFRRDGYRYAHGWDTPFTDEDVFTQSELDMIKNGNYTDWQDLLYRNALTQSYHLSISNSGEKTRLLLSFKYDKEQGYYKTNDAENYNLTLTADHDLADFWTLGTTVRLKRNNISGFQKINNEILYMTPLSDPYLENGDLNYFPNPLNTSGYNPLANDVPGQFADDAQSNLLNLNLTSHIKINKWLSMHTNFGYIFSDYKRGYFYGKDSYKGKGVKTNSGKEYNNYDQWTLNHIITYDNSFGDHNLVVDLVGEMQSRRYDKGTLSGDNQPVEYTSYHNLGSNTENIKIGSSFENWALASVLGRLRYNYKNKYYFNIAFRTDGSSRLAKGNQWAVFPSGGVSWSMKDESFMQNVNWINSLKLRVSYGTVGNTAISPYQTLASLSQYAYLFGEDSSNKFYVYSPTSIVNLDLGWEISKTVNAGVDFGLFNNKLNGYVEYYNTKTSDLLMKRTIPSFTGFNDIWQNIGETETSGVEFNLNYNPVRTKDLNVDFSLNASRNGEKITALISGEDLPNNKWFIGEPLGVFYDYEKIGIWQLGEEEAAAKYNAKVGDIKVKDQNGDGSISAADDRIILGQVRPKWIASLGANVQYKNFDFSFNLNSRWGYLVKPAPYDDITMDGQRWLPAVDYWTPDNPTNSYPRADQASGYDTYRTSNGYQKGDHIKIQDITLGYSFENLLSKKVPIRKLRFYVQMRNIGYLYRAAEFDIIPEQPDINYTVPSSYNFGVNVTF

SEQ ID NO: 14761 - protein, 201 aa, Shewanella denitrificans
MMTFKNLRYGLSSSVVLAASLFSVLSYAATDSIGLTVITTVEMGTCTATLVNDSDQDISVVDFGDVYISEINAKTKVKTFKLKFKDCAGIPNKKAQIKLTKRATCEGTANDGAGFANGSTAADKASAVAVEVWSTVTPATGSATQFSCVTPASQEVTISTAANAVVYYPMSARLVVEKNKTVNNVTAGKFSAPATFTVTYN

SEQ ID NO: 14762 - protein, 345 aa, Shewanella denitrificans
MDLGPIYNTRDINDGKVINIDNPNYTNPVAIKKNENNNAYQFNHLKTLGLYIQNTTYFTDNFIITGGLRYEYFDQVVGRSTLKNIRSGYLAQKDGKLLYQLGSVYKFTPNIATFFNHAESFRPQNNRTLIINGELPAEQGKSFETGLKYENAYLNATVALFNINKRNVAETVNVNGTNELQIVGKQRSRGIEFDLNGQLTDNLSIAANYTYTKVKNLENHNNKLAVGKQLSGVPKHQASLFLAYNIGEFDFGNIRVGGGARYLGSWYAYNNTYTKAYKLPQAIVYDTFIAYDTKISGKKVSFQLNGKNLSNKVYSPSTSGNASRTLIPVALGYAREVILNTKIEF

SEQ ID NO: 14763 - protein, 377 aa, Shewanella denitrificans
MDLHMMMNTLKVVLLTSMLPFAASAAEELTPWYVGGGVGVNNYEPSCDLKTMKTCGKDDPYAWDVFGGYMFNEYFGLELGYRDLGRAEWTDYSNKSHDVGARGASLGLVALIPLANNWSITAEAGAFNYLLSNKKQTSTEYYSDSGVAPYIGAGIGYNFTENLMLQAKYRRYETLNEKQWDTLSMESNYWGLALSYRFGTAAKPVAAKPAPVAPMAPAVPGDADKDGVNDNIDKCPDTPMTHKVDATGCSVYEFVTKMYDLGKVLFDNDSAVIKPGYYADMEILGDHLVKYPAHTVIIEGHASNVGKPDYNMSLSERRAQAVATALMTKYGISASRIKSVGYGVTKPKMAGNTAEAHRVNRRIEAIVTGTEKRVVLR

SEQ ID NO: 14764 - protein, 621 aa, Shewanella denitrificans
MRPSSTFSITTRPAPVLVGFGWLALATCLLADAPDRSLPLLTVYSQRVANQAPVATFAMPVSALRFEPRVDVQARNFAEGQADIAIRGGIFENTGFTLGAVTLFDPQTGHYFAEIPVAPAMLGAPQIVTGADLGLSATNATVGSVLHGWRPIRTAGAVAVGAGQDGLTQGEFYQGYVSDVKLGGRQLAADVAWAHSDSDGSVPYGDHVLNRVNARLQLAGAGAQTDLFAGYQAKFFGWPNLYTPFNSNETDDLETILIALNHRRDFGGGDFFEAGAAYRRNKDEYVYNRLIGPVQPYFRHTTWVQSAALSGRQSLDAFALNYRAEAWHDELKSTSLIFGRFNTRQLYKLALVPEWSRALGGGAKLVARAGASYDDTNRGSGELSPILELARESSGPWQKLYLSYAKTSQVPTYTALNSSAAAGLFRGNPDLGRETSHNLEAGAQLAAAGWRGQAAVFYRRDDDLVDWTFRRGVTARTASAVDIATTGFEVVAQRSWQRFDVVLGYTWLTKDADYGGALVDASFYALNYARQRLTAAVTARLTREIELRLDNEVRVQAANLLRTRGGDHPLISSLGVTYRPAALRRLSLSVQVDNLWDSTFQEVPAVPAARRQTSFSAGYTW

SEQ ID NO: 14765 - protein, 316 aa, Shewanella denitrificans
MMNVFCKTLLASAVATATMSSAYAADPLTVYGKLNVTAQSNDVNDESTTTIQSNASRFGVKGAFELSNSLEAFYTVEYEVDTGDSSKDNFEARNQFVGLRGNFGAFSVGRNDTMLKASQGKVDQFNDLSGDLKNLFKGENRIEQTATYITPSFGGFKVGVTYAAEGASSQYTQDGFSVAAMYGDAKLKKSPIYASVAYDSDVKGYEVARATVQGKIAGLKLGAMYQQQEETYSKDGTAIVGSESKTGYLLSAAYQIEAIVLKAQYQDMEDKGDSWSLGGDYKLGKPTKLFAFYTNRSFENVENDDSYFGIGLEHKF

SEQ ID NO: 14766 - protein, 1126 aa, Shewanella denitrificans
MKTRKYLVGVATIGLATALASSPALANDDNDASDEVSLEAQGNFAGFRTMQSADIIVSTEIAIGTPGPAIERQVNGALVPAYPELIVRDDIGTAGAVDTANTLPSVVQIFRQSNISGGVFFNCTGTMINPRTVLTAAHCLNARGSEDYGLPSTGADSTMLVATGVDTSSRLFNYLDFGSGYNEGGVAQSTDVIIHPSANLENGALPFPWADVAFIALDTPITDVPAMPLLLTPLDELTHMIVTGYGTTGTGETGAQGIGFLRRVGENMLGAVATSADLIDTIFPGFAPSESSLGFETQALYWIDFDDPRRTSPGEDSCTFDGFGINCPNIDTVLAIDWFDGDALPQEAGTAPGDSGSPLIADQIAPFPLITGVLSGGFDFFGTGNRYGDISFYNPLYPFFEFITENTPYKYVSAKSGNGVWSDPARWTQDLDPGFFIEDSDGNIVNGVPGGDEPGVYEQGPRLGLILGEDISGNSNDATAVLPPEGTPNFGANIPESSVLLGPGSTGFVPNNTDGTPGTAFENPALYFDVLLVNPGTTTVDMDVEIDRLTIDGKNTGFALPEAYEFTSIIGVEQYRGNAEIDGQLNAGNVLLFGGTMGGDGTVATNAFFNVSGVVSPGGDNAIGTFTIDGDYVQTSQGTLLVDVKRRGKKPLEFDQLVVTGDASLAGDLFVKPTGKITAKFGAEWTVLTANSVLGNFDEVTLLTRSPVLFAGTRVDGGDVIVAIGANPIAQIVGAQSDLSSLASVLDTLRFGGRYADFESVFSVVDMAGFDIFGQTLAGLTPTSGFQQTFSATNFAQRFTGQVAQRTLRLRGADSGAAGFSAAGSASFAQAGTAPGTKGKLGFFASVSGSYLTMAQGDRNTGTNAVREAAFTEAGELTLGADYKVADGLVIGVAMSSVRDSANAFGALSPMDNESTSGAIYAAKTFGRGFADAYFGFSDQRYGTARGSVGNATGSFNSAIGNAEGSQNFAGIRMGYAMEPMENVRLGPVASVDYVRSNLGGYREYGAGQFGLNVDDRSFTSIGAKIGAMASLGMKVGQTGVIKAFGSVAYARELGDSQDVVTASFVGAADLPFSIARQLDTQWVAVNAGAEMALTNRLSTQLSVTSDIGRGELTNNQANMTLNWRF

SEQ ID NO: 14767 - protein, 428 aa, Shewanella denitrificans
MNNMRLFKKSLLAVTVTLATQQAFAAGFQLNAQSATGLGRAFAGDAVIADNAAVMSRNPAAMALFDEMALSLGFETITTMIDVKNVSYRGVLGNSVSVQDTDDVGGTSVAPNIHLIVPVNEQFAWGVNAYSNFGTKTEFSDSYPASEYGGLTDVKSFNLGLAGSYRVNKEWSFGAGLDLIYGQGTMKRIAGTSFPASTIVVNPTTVIPARGTSLLNVDKADGWAVGFNLGTVYEMDENNRFGLSYRYSPEFKAKDDYGQEITLPLPDIAEFSGFHKIENTQFAVHYSVQWIGWSAFDKIEFRNLVTSRSSVGALTKGSYDKMYEWQDGWHYSIGGTYYLNSDWTLRAGYMYDTSAQDSRTSISVPDSDRQWLSAGFTYNIDDKSNVDFGFTYLMGKDVAVSENDAGSKLTATTHADAILLGLQYSRTF

SEQ ID NO: 14768 - protein, 457 aa, Shewanella denitrificans
MSHPALDSSVSIFTEPARGAERTILAAMLAILGQTLAQPATAAGFIEDSKATLSLRNFYFNQDNRNGGGPRSDEWGQAFFLDYKSGFTEGPVGFGLDVFAMHGIRLDGGGRAGKADAERTPGALFPLESNGKAKTDFGRVGVTGKLRYSRTEARLGTLLPKMPVLIYNDGRLLPQLFHGAQITSNEIDNLSLTAGKIEHSTERNSADSHGLSIAGANSGSNARFSNEFYFAGADYKPTRDLLLQYYYGNLRDFYKQHFFGLIHNWKLPVGALKSDLRYFYSDSDGKNESASGRAEGYRSAGANGSSGEVDNNLWSAMFTYSLSGHSLGLGYQKVTGNSDWPRINLGTGQTVHLITNLQNGKFASAGEKSLVGQYAYDFAKLGVPGLKASLTYVKGWDIDAAGSDKREWERDFRVDYTVQSGFLKGVGLTWRNAALRGNDTTDRDENRLIVSYSIPLL

SEQ ID NO: 14769 - protein, 991 aa, Shewanella denitrificans
MNKNLFIKHTGKCLLLTIVGMLISFQVLAQNLAVKGSVVDKNGEAIIGANILVKGTTNGSITDFDGNFTLEAKKGDILVFSFIGYKNQELPAAANMKVVLHEDTEVLDDVIVIGYATGSQRTVSGAIQRVGREDMNAGVVTNPLQAIKGKVAGVNIQKSGGDPTASASIRVRGTTSLSGGNDPLVIIDGVFGDLSMLNAISPADIESFTVLKDASETAQYGSRGASGVIVVTTIKGKNGVKTLSYDGSFGVETVYKNLEMLDANTYRQVVADRGYANALDMGYDTNFIEAMQQTGYTQNHRLSFGGGTESSNYRASIGVIDQKGIIKDNYMRNYTAKLDASQTMFNDKVKIEFGMFGSKVDKRYLNDYQKTFYSAAAFNPTFPDFANEDGSWPEDPNANETQNPLGRLTIKDIESNSYINTNARITWTVIDGLKLSAFGSYTYNVKENSKYTPNNIKAGQGQSGIAEKSDNKSGVLLGNFTANYKKAFGKHYIDILGLAELQDYKYTGFGAKSKQFGTNFFEYNNLGAGGEVKYGDVSSYSNGYSIASFMGRFNYSFADKYIATVNMRADGSSKLGANNKWGFFPSASLAWVLKEESFLKDVDVVSNLKIRTGYGLTGNQDAISAYNSLKLMSPTGVTTVNGKPVVTYGINRNDNPDLKWEVKRMFDIGIDAGFFEDRLTGTLDYYYSKTSDLLYNYAVPVPPFAFNTLLANLGEMENTGIEVAVTGVPVKTKDMELTISANFSWQKNKLLSLSGSYMGQSLSAKEYMNLGGMNGAGFIGGNNQVIYQMVGQPLGVFYLPKCDGLIDMNGNGEYTYHILDIDGQEGIDLSDGKDRYIAGQAMPKFYLGGNISFRYKQFDIQTQFSGAFGHKIYNGTSLSYMNMSLFPTYNVMKGAPEKNIHDQTVTDYWLERGDYVHIDYVTLGWNLNTKNLKNINSLRLTFSVNNLATITNYSGLSPMINSSTVGSDLGVDDKRFYPLTRTYSLGLSLNF

SEQ ID NO: 14770 - protein, 903 aa, Shewanella denitrificans
MQTLDAMQVTGVRRANAAAVESKRAATNITDVISATDVRALPDSTIVEALRRVPGLSVLPATDNEHPRDEAATPVLRGLGPSYNNVTIDGLTIASPGTPNGTLGSITRGVRLDLLPASMVSELQVVKTFTADLDPNATGGAINLKTRSAFENGGKPFFSAEAALGHANDVGKPRDQDDPGYRLNATGSRTFGSEQQYGFTLSANYQTLSSYTETHMTTDTVHYGFYDNNGVLQTGANLGNGWAVPQQDKYWYVQNQRDRYGVTGKFEARPSAAFEAYAMAGYYYFKDDMERNEVIIDPRNRGQVFNQTATSGSYPGGDIEVGYSNQIVTTRTKVAQLGSIWRPTDRQQFSARGSWSDATYDEPIRMIKYATGINRPAAVPVGQTGSGVTVNATPNYAFNYDTSGFDQRFGVSPQAYNNLDNYSLSYWRPDYKRTAADRILTGRLDYGFNQGESDQGIGFAAGVSYTTDKPSYDIFRVEYQPNTSAPTFGLADVAGTGRAPMRYAGLNLITIDPDKANRVLAATPLSAFNSTDQQAFSNQDNFTHTEKTFGSYGLVSYRSERLNVQAGLHLDSTKLNTVGRQRQLDTASNRYVYVDNPTNADYDYLLPSAIMTYHLTGALELRVGASRTLGRPPYDAYAARTSIGFVNTTDAGNPSAQGVTVTIGNPDIKPRVSNNLDLSLEWRLPGDFDAFASTAVFDKRIQDEIFTLSRTDSFTFDGTTYANALISTPANAAKARIRGVEFNGIVNTLAPIAPWLSGVGFSANFALLDGSLDVPYSVGSGSTVSQRERKLDNLVGQPDYTANATLFYNTGGLELRAAYNRQGKALRAIVSNIDWQDLYWSPRSQLDFTATYAVSKQLSLIGQVSNLTHSRISSVTGPGQNLLKDSYSVPSTYWVGLRFTPSL

SEQ ID NO: 14771 - protein, 209 aa, Shewanella denitrificans
MSAPSNFCPRADMKKIICASVMMISPLLAHAADAGGYVFGNIASMANIWDLDARKAQQYGVRDLTSNKDGNAAAGAWELGAGYRFGDHLAAEASFMKGLGETRIDKAGAMRNQALRFAVLGLLPLSDSFDLYGKVSANYIYSDFRSANPGYASVKDKGWGIGLGLGAAYHLNKSLSLRAELDGIGQVKVKGVTDKSRLGSFKLGASYRL

SEQ ID NO: 14772 - protein, 1033 aa, Shewanella denitrificans
MKQATGKNKPALAPTWKLNALLCALLAAGGVQAAPYTEGGKSGDPASWRSNEFNANWGLGAIHADEAYAAGYTGKGQKVGIFDTPVNKHPEFAGDGKLVNVVTQGNRAYTDPHRKGIKAGDRFYFDGTFHFYNGDGVTLVNHGVHVAGISGANRDGIGMHGVAFDSQVISVDNDNDGPAYGEFLGLDGSVTNAGWQAMINNGVRVINNSWGVSIPDFLSDNGKKPDALHFELKDAQEQFDQVKPLLGSLAGAGYQGAIDAARKNILVLFAAGNDGNYTQPDVISGLAYFVPDIAPNWLSVASVAQDDASTNSVPYTISSFSSRCGYTASFCVSSPGSKIYSTVANGSDPNQLVSDYGNKNGTSMATPHVTGAVAVLLQRFPYMTSAQIADVLKTTATDMGAPGIDALYGWGMINLGKAINGPGMFYTVEDIPEEFRIPDPTGVAYGSSQFVANIPGFGAQIDQGTLQARICDDYHCSVEVYSNDIYGHGGLTKEGQGALVLTGTNTYSGPTWVNTGLLAVNGSVTSDVTVQNSGMLSGSGTVGSLTARSGGTVAPGNSIGTLNVTRNVSFEPGSRYAVEVAPNGQSDRIQSSGSATIGGGEVAVSLENSTNLLSQSEVRSLLGQQYNILTAQQGISGQFDSVAPNYLFLGTGLTYQPNQVTLNVGRNDTSFASVAATQNERAAAAAADALAAGNPVYESILNAGSTGEARQAFRQLSGQIHADIASAQVNDSRYLRDALNGRLRQAEGLATSPDIKADDDGGAWAQLLGAWDHASGDANATGYQASTYGVLVGLDSALADDWRLGVATGYTRTSLDGGYGSNADSDNYHLAVYGGKQFGELALRAGGGYTWHRFDTSRSVNYGMQSDRETAKYSARTEQVFAEAGYSVKADWVNLEPFANLAYINFQNNGISEDGGAAALHGDKQHTDATVSTLGLRADTEWQASKTTSVALRSELGWQHQYGDLDRGTGLRFNGGNSPFVVNSVSASRDGAVLKAIAEVAVNKNATLSLGYGGLLSQNYQDNSVNAGFTWKF

SEQ ID NO: 14773 - protein, 1004 aa, Shewanella denitrificans
MFSTGSEPSRPNAKGAEVSMQDAAAATNRGRLVRQMRREAYGSAGAAALLVSLIATPGLAQTVPASKPEAVTVGEIVVTGTRIQTTGFTAPTPTSVIGESQIQNNAQPNVFATIVQLPSLQGSSGSATNTFSTSSGQQGLSSFSLRGLGTIRTLTLLDGQRVVGAYYTGVTDVSLFPQLLIQRVDVVSGGASASYGSDAVGGVVNFITDTRFNGFKGNVQAGVTTYGDDEQGLVQLAAGRSFFNDRLHVVGSGEWAKEDGVGPGGFGLDLAGDRDWFTQTTMINRNVNNDGAPQYVMRDFAQPYNYTKYGLISAGPLQGTAFDQSGQPFQFQYGSNGVPTKNASGAVTGCFPGFCVGGDLSGNVDSGRTLQSAIERRVAYGRVGYDFAENNEAYVSFNLGQVKTSNQPVNGENRPGLTLQCANPYVPASVQAACATAGVTSFQFGTSNALLPNTEVHTDRRQYRVVTGLKGKFALLNSDWTYDAYYEHGVNKTAIDVDHILLTPHYNQAIQAITLNGVIACADPVARASGCQPLNIIGGKPPSAAALAYVQPENGPFQRLRMTQDVASLAFSGAPLNLWAGPLSVAFGAEYRREFYTVRADAYGAGVSGRSPNTAEFPADPVLLPGGNNWYAGNYKNGNGAYNVKEAFLELDLPLFDSDALGRANLNGAARVTDYSTSGTIWTWKAGGTWDTPIKGLRLRGVTSRDVRAPNLSELFAAPVTTTLPNFLDPVRNVNVVAIQNAVGNPDLTPEIARNTSFGVVLANPSWLPGFSASFDYYKIKVDDVISSLGAAQIVDLCYRNILPETCGAYNLNNTSGPNYINVQAFNLASIKTSGFDIEASYRWRQPLGLPGAFTVRALATHIREFITDTGLPGTAPTDSAGVNTGATPDWKWLAIQTYEGDRFSLTVQERWFSDGNYGNQYVVCAAGSCPVSTAIAPTIDSNSMPGAFYLDVGGTYNIRKDVTAYFKVDNVFDHDPAKSPQYANPALYDIVGRIYRGGVRFRF

SEQ ID NO: 14774 - protein, 881 aa, Shewanella denitrificans
MKLSYIHGFGNKGNIFEAKGISAESLSHQANLNVTPKYLTPDYFLPSSSNAHYYRKKYKGNLNLNFKSKFRKISRVASVMLLSLGFIATTLEVKAQPVIEANQSFLFGKGSAGISTNVPLPPIMPQSLPPAPPIPPVLPAMPDFISGANIAGKADNRSALFESIRNFGKNILKKVKREPKPKVISSDGEDLMSQLHNTLERRRNGIAGEKNGAKPKKVVKQLPKLTSEEQARKKAEIARERRRAEVEAVKARIEQKAKERGENREGVVNGIDPALHHNIVSDLRSEIALLREQLKNQGINNLAGTLGGGAEEPIYSKPIDTISMASSVTEYSEPWQDPDTEIGEAFETEFSMQKQIEPTAPPLSVLSSLEDLHISEDASLSEEERVMKMLDEAIEDSGYSGSSCGGVDDWSGEDSIADTDGYDTVCTSSGSEYSEDSSDEDGIPFSPPATEEKKAELDIIREFQVSEQSSAVASNASINEANIAADSNESEEASQEESTTASVFEILDEVDEKDSVSKDISTNLGSTASTEPQEQATSMSQEELRKKAEATSVMQNQARKMSKISSKQIRDRIFARDIVTAAVASGDDDADDASEKTIGYSIWSSGTLGINKQKSKADSNGYSSKIAGGTIGADINLENDLLLGASFSRFNSRVKYQDQGGSSDLCSSGTSTRAKYDTHIFSLYGSRPVSRNMNVAIIGSAGHSKGKKVRSKLMSFEPHLNYKVEMPREVTLIPHIGLRYEYEKVSRHKEQIASNLSIERSKKSYQALNGEIGSRVIFAPIKLKGSTPSTISITPTAHFSVERRIGSRGKSNSFTLTYYEAQQTIGTGIVSVNAQNERTSLNAGIGLIANHKNIKLELLYDQQRQKRFKSHQGVLKLKVSL

SEQ ID NO: 14775 - protein, 771 aa, Shewanella denitrificans
MLLFIGTTQYLAAQNIISGHVYSNTDSLAIPFAHVYVKNAQGHMQHTVTNESGAFSFSDITEATTLTINFVGFQHHTQIVLPGNSYAVYLIETHSDEIIIYADRFGKREEEVISMTLLDNKTLVEQTSINSNLNEMLGKTVPGMAVSTESASTYGQGIRGRDMLVLIDGIPQSTPVRSSSRELRSIDVSAIEQIEIVRGTTALYGYGSTGGIVNMVTKRPLYNKDTLQFITSVSGNTALVFANNAYVKSGPMGGRAVQQISGQKKNFFFNVGGSVEHIGKYYDAQGDLIPLDPLGQGGMANTNNYNIQGKSGYHIDSVSSIEGSVNYYSSTQIPGYTAVSGEYGVKKATAYTRGKYPDELGTATRSLNTTLRYRNDAFIKHTALNVLVYFQQSYSRFPYDPASAYFPPYNGNTSAQTFIESKKIGSRIDFKTKTPFIRGNSIQYGLDIISDNTTQQLTDGRVWVPPITQLNLAPFLQMQQTLGKLILRGGMRYETVNLIVSDFNTLATIVPAHFVEGGSLQYNQLLFNAGIRYNIVRWFSPFVSFGQGYATTEVGRELRQTSASKVTDLQPKAQLVNNFEFGWDSRIGKRLIFSAVAFYNTSKYGVTLIGSSFDVQRAPERLYGAEAEATYTLKKWIFQATASYVEGKVDYNNDGAYTDYLLGTRISPPKLTGRISYDVTPKFRVLVQGLYAGKRKRFENQTQSFGMGTVTDYALFDLIINYNIWKGNLSLGINNVLNTFYYPAISQFAATSLYYVAGRGRTASITYTIRY

SEQ ID NO: 14776 - protein, 1084 aa, Shewanella denitrificans
MKSLRFLAYAILIVAAPLCAQPTAGTLLGRILDQTQAAVPAAIVEAHNEATGLKLATRTDSAGGYWIPALPPGTYLLTVNKPGFGTAARTGVVLAIDQKLRVDLQLSLGTLLQQETVTASVQALQTQSAETGEVIESRQILDLPLLGRSFLELTRLTSGVTGGSGGNTLNIAVNGQREFANSVVVDGVEATSNRNNDTSIRPSVDAVEEFKLLASAYPAEYGRASGAVVAVQMKSGANRPHGDLYEFFRPNSTAARSFFAAESSPLKQHNFGGTLGGPIRKDKTFFFASYEGVRQRNAFSYLDSVPPAGQIGLSANGSVDLSHLKDPLTGKQIPIFDPYFYAGNYYASPFPGNVIPANRVSPAGKAVLQNFFPAPDRTGALNGWFSNFTSRQSYAYDADTASVRIDHIFSEQDRLSAVYHYGSFASDTGDRFAGRIPVNGGGDADYGDHENARNQALSLSETHLFSSHWLNEFRAGYTRYRLDQSSLLNGRNLAAQFGLGNVNLPGYPQTSGFPDIYLGFGAQTGGSTYKPLNFLDRNYQFSDEVTARLGRHQLKAGAQYRRVNSAPFFSLFPTGFQYYAGPGISLTGDPNYNFYDPAAFYYNGGSDIADLLLGLPYSVNLGLQLTSPETRSWEGSFFTQDTWQVTRALALYFGMRYEYFAPWTEKSNQLANFDLGTSQMLIAGHGSNSAALVAPDRNNFAPRFGAAWMAAPHTVVRAGWGIFYSPENDAREDVLTKNYPFAMQQTSFNSLYSGLPFAYTLDSGVPRTGASVPSTGQNVLLVDSSMRTGYSQLFNLMLQRELPGGVAAEAGYAGSLSRKLPYAIGNLNRASRITPAFGQIQGQFSEGSANYHSLQLKASRRFSRGLSFLAAYTFAKNIDNGPAPFNLGHNLNSHNQPQDPFLLNLERAVADNDVRHTLVISSLWRLPFGKGPVLGGWQVNGIYTARSGLPVNVVRNPQDTGYDGLRPNALRDPSLNGGPQTLARYFDTGAFSTAGLTGANKHALGNAGRNLVRGPGLANLDFSLFKELLAERKARIQLRFEFFNITNTPHFANPSGDMSSGSFGSITQTTGNPRIAQFAAKLLW

SEQ ID NO: 14777 - protein, 75 aa, Shewanella denitrificans
MPQISRYSDEQVEQLLAELLNVLEKHKAPTDLSLMVLGNMVTNLINTSIAPAQRQAIANSFARALQSSINEDKAH

SEQ ID NO: 14778 - protein, 279 aa, Shewanella denitrificans
MKNVKMLALAGATVAAISGNAFAADRTDLHATDYKWLQFNAMYSIGEKPDNPASGDQHNYLEMEFGGRSGVVDLYGYVDVFNLANESTDNGDKNPGSGTSKLFMKFAPRFSIDAITGKDLSFGPIQEVYFSTLFNWDGLNGEGVNSTFWGVGADVNVPWLGKTGMNLYGYYDMNAKEWNGYQFSANWFKPFYFFDNKSFLSFQGYIDYQFGADEDDNMFVPKTSSGGNIFFGLYWHSDRYALGYGLKGFKDVYLLEDEGGLVGLESTGWSHYLSATYKF

SEQ ID NO: 14779 - protein, 660 aa, Shewanella denitrificans
MIRRIALLTLLLATASAPALAQEVEAISVWGQRANDLGRATSASEGRIAYADFASRPLLRPGELIEAVPGLAATQHSGAGKANQYFLRGFNLDHGTDLAASLDGVPLNLPSHGHGQGYLDLNVLTPEFVHDISFKKGPYSAENGDFATAGAVAFETADHLHGDGLQVWAGENDYYRAVGSKALTSNVLVAADITTNDGAWTASEDLRKINLLGRAIVSGWSITALAYDARWNATDQIPRRAVDSGLLDRLDTVDATDGGTTSRYMLSARKRDLLRGLDTVAYIQRYKLDVFSNFTYFLDDPVNGDQFEQVDQRWIYGGAITKRWTLGQGWSARTGVTARVDDIGKVGLYRTTARLRRATVRQDALTQWSTAVWGEASRRFGQLDVTAGLRADAMGADVKAGDPRNAGTVSDVLLSPKLALAWRISKTFELYADAGRGFHSNDARGAVISVDPVTGDPAERAPLLSPTDGAELGLRWRRDDLTLTAAAWALHVDSELVYVGDAGFTEASGATRRRGIELLADWRPTARLNLTASYAGTHARFTNGDRIPNAVASVFTGGASWKLGPTSSVTLTYRRLGAAPLIEDNSVRSGPTGLVNALFVQDFGPASLLVEVLNLTDSRRDDIAYVYASRLPGEPADGVEDVHFHPVEPRAIRAGIKINF

SEQ ID NO: 14780 - protein, 697 aa, Shewanella denitrificans
MNKKPLVIAVAMALSSTALSFALAAEEGVKPTAVQKSAEQGVVETEFDEVLVSATRLSEKVSETSRSVAVVAEEQLNVSQASSVAEVLKNEANINLTNGPRATSQGVEIRGLSGDRVLQTIDGARQNTSSGHRGSYFMDPELLKSIEVIRGPASSLWGSGALGGVVAQNTKSAQDFLAPNETFGGYLKQGYDTNGDRTKTSGAVYGQQATVDWLLNGSYFDSNNINTGNDETLVNSASSGSSGLAKFGWQADEASRLALSARVNKINELVPSNPSAAVSSSVPLVRRKTDDQNITLNYSLAPANNPYLDTHLQVYWNSTDYDEDRVTKGQLDSTEYRTVGINLNNSSQLGNTKLTYGVDGYRDTLKTVRDDKGQVGQRPEDIDGETTVWGAFTRADVQLTQTVNLDAALRYDSFKNQSHNLNASADDTELSPSLGLSWQTQPWLTLSARYDQAFRAPTVEEMFSSGTHYCIPPIPGFLPKGLCNTFATNPNLKSEVARNKELKADFRFNELAGDDELAITLNIFRNDVDDFIVQQVSNPYRGIPGLEQTTSWNNVEDAQLTGFELSGRYRIGQTRLAMNYGQTRGEDRNTGDYIEGMPANKFNVDLSQGIMEGDMKLGTRVTYVASQTNTPTGYSVAKYDEYTLWDVYLAWEPAMGVMSGLRVDFAIENIGDEKYQQAWQTLYQPGRNMKLSARYMF

SEQ ID NO: 14781 - protein, 326 aa, Shewanella denitrificans
MKKIFLMIPLAFSVSNSVHASTDNPWYIGARAGASFLTNMDDAVTSVSEIQDTNFTGGVFAGYQVTPWFALETGYTHLGNAKLDNKQGSYEAQGADLVTKFSYAISDNVDIFAKAGAFYYDWNAIGSGVIKSDNGWSSTAGAGLEYFINKSFSTRLEYQYYNDVAGPDIHFAGLGLAFHWGAPATVEIKETINVNQVTIVTLEELRLTVPFAFDSSTITTDDAAKLAPFEQRLKEQDTAKIYVVGHTDSRGSESYNQTLSEKRAEAVADTLRQHLNLDSSRIIAQGRGESDPVASNQTEDGRSQNRRVDIISPSLDIETSTQVITE

SEQ ID NO: 14782 - protein, 659 aa, Shewanella denitrificans
MGTKPTKIALLLSAVFSVASVNAVAIESVVTSPSSSAISMDETIVVIGRNAAKPLNIAANVNVIDAADIQMSGATNLTDLLRGQSGIQVSDNNSGTVFSMRGFSASQAANNTLILVDGRRLNNIDISAPSIESIPINLVERIEILSGSAGVLYGDQAVGGVINIITKAPTETGGGLQVSGGSFDTYEAKGDISGAINDAWRYFLAASYNESDNYRDNNDNETSSILGRLQYQTDIEDFFVEVNHFDNDRQAPGALTLAQYEADPRQVASFSEGEFSHEITTALRSGYQYQLNKIWALGADLTYSDTSTSSLLFGGAGRIERDLLSFSPKATANYHLEHGDLNFVAGIDVSKGEADFDTLYTQRNNEQTQKSAYVQASVPITPTLSYVVGGRYSEVTDDLYDQLLYPNRIEIDNDAHALELGLNYRPSSENRFYIRANDNFRFAKVDEQAYTPLDVQGLNPQTGRSYEAGWDFTTTTQTLKINAYQLELEDEIVYEGGRTDGPYGGGANVNADESRRFGVSTAYDVQLSNDWLLGASYDYIDAEFTQGENDGKALSWVAKHSGKAFVSYDFADNWQAFVEGVYTGERYMEGDNSNTGDKLDSYVLTNLALNYTYSGWNGSLRVDNLLDEDYVGTGYYSAYGSGYYSGTGRSIRLTAGYRF

SEQ ID NO: 14783 - protein, 899 aa, Shewanella denitrificans
MKQQIGRLLSTLLLATFSLGITAGVIQGTIIDKQTKEPLTGATVQIAGTTTGTVADVEGNYTLTLSNGTYTIEVKYIGYKTLRMNEVKVKANATLNFELEVDAQTLDAVTVVARKNLEGEKALLQERQKATLAIENMGAKEMTLKGISNVQDGVKKITGISIASAGQLIVRGLGDRYSTTTLNGLPIASPNPDNKLIPLDLFPASTVKNITVSKVYAAGAFADYSGAHIDISTKENTGSDFFSIGFNVGGRFNTVGKDFYYSDRKGGLFSTGNLRNKDRILAMGKSEFRDYARNNDPFGTNFAISKHRSLPEFGGNLGGGKSWTLPNGNRLSVLASVGVSNENQILKDAYVTTMTAQGTHLDKFNYDSYSSALKIAGLGNIGYSFRQADHINFTVFYARNAINDYMSREGIDAEKNNITSSNSVFHAYSLLNNQLLGHHELTSQWDVNWSASYGLTNSDEPDRRQVVFFRNEGSDKLNLFKLNQTTNRYFGELQEKEIVGDLRTSYKWGDANLIRVGGTYKSKKRDFESVNFYYDINALNADVTNIYDTNGYLNQENIANGTIKANIDAQPRYNYYAGMDVWAGFAEIEYYPMESLLVNVGLRYEQAKQWVRYWTDGGQEKKTNLDKGDFFPALNLKYSLNETNSLRLSVSRTVTRPSFIEMAPFLYQESYGSAYIRGNNELKNAYNYNIDLRYDFFPKRNNGDMFSVTGYFKKLKSPIEQTQESSGGTVIRSFRNAEDGIATGVEIEFRKELFKNFRIGANGSYMYTNVVLPEGGVYTDSERALQGASPFLINADLSYTPQLRGESDLTLALVYNVQGPRIETVGIYGTGNIKQQTLHTMDFIASYAINKHLSLRLQMKDLLNSTIRFKQELPATGQKVEVESFRPGTHAEIGVSYRF

SEQ ID NO: 14784 - protein, 391 aa, Shewanella denitrificans
MMKKTLIASALLGLFASQTAMASDETAELRKIIEQQQQVLKDLEKRLEETEKRVEQTADATEANASAKSATTIGGYGELHYNNIDNNADSSKDKTEMDFHRFVLFFGHEFTNKTRFFSELELEHSLAGEGKKGEVELEQAYIEHDFTDAITAKAGLFLMPVGIINETHEPNTFYGVERNPVESNIVPSTWWEGGLAVNLKAAPGLAFDAAITSGLKVKDDYNVRSGRQKVSNANADALAYTGRVKYTGIAGLELAASAQYQSDLTQGKDGVDEASATLLEAHGIYSIGGFTIKALYAQWNIDGAEAELLGRDSQKGWYIEPSYRFNDSFGIFARYNEWDNEAGNDADTTKKLTSVGINYWLHENVVFKADYEKQSGALDSDGFNLGVGYQF

SEQ ID NO: 14785 - protein, 1016 aa, Shewanella denitrificans
MKTKPLRLLRQKRASWLKSVFVLTCLLLSTSVAMAQTKTVTGTVTDSFNEPLIGASILVKGTSTGAVTDMDGKYSISVTPNDVLVFSYVGYEKQEIKVGQQTVINVTLKDDSQMLAETVIIGYGSAKKRDLTGSITNIKGSEIANKPATNPLSSLQGKIAGVQIVNSGQAGADPEIRIRGTNSINGYKPLYVVDGLFNDNINFLNPEDIESMEVLKDPSSLAIFGVRGANGVIIVTTKRAKEGQTLVNINTSFGWKSVVDKIKMVNAPQFKELYNEQMANQGNALFDFSNWNANTDWQDEIFQTGFITNNNVSITGASEKHSFYLGVGYSHEQGNIKHEKYSKVTINASNDYKITKDIKVGFQFNGARMLPADSKTVLNAIRTTPVAPVYNEEYGLYTSLPEFQKAQMNNPMVDVNLRANTTRAVNYRASGSIYGEVDFLKHFTFKAMFSMDYATNDSRTYKPIIKVYDATVAGNVATLGNGKTEVSQNKQNETKVQSDYLLTYQNSFADGTHNLTATAGFTTYYNSLSGLDASRGQGIGLVIPNNPDKWFVSIGDLATATNGSTQWERTTVSMLARIIYNYKGKYLFNGSFRRDGSSAFAYTGNQWQNFYSIGAGWLMTEEEFMKDITWLDMLKLKGSWGTLGNQNMDKAYPAEPLLENAFAAVFGKPAIIYPGYQLAYLPNPRLRWEKVEAWETGFETNMFRNRFHFEGVYYKKNTKDLLATVPGLSGTVPGIGNLGEIENKGVELMASWRDQIGDWGYSVSANLTTISNKVKSLVQDGYSIIAGDKSQSYTMAGYPIGYFYGYKVAGVYQNQAEIDASPVNTLATVTPGDLKFADVNGDGKITPDDRTKIGDPTPDVTYGISLGLSYKNWELSMEMMGQGGNQIYRTWDNYNWAQFNYMEQRLDRWHGEGTSNTQPLLNTKHAINSENSEYFIEDGSFFRIRNLQLAYSFDKTLLSKIRMQALKVYVNIQNLKTWKHNTGYTPEIGGSAIAFGVDNGTYPVPAVYTFGINLTF

SEQ ID NO: 14786 - protein, 739 aa, Shewanella denitrificans
MEQKKMDWATGTRLRAIAAAASVAFGAAAAGQAFAQTTPAANAQAAAPNAASAGTLPAITVNAASEGDGTVGLVAKRSRTGTKTDTPIEEIPQTINVVTAQQIEMTGATDVNTALRYVPGFSSYGSDNRSDWYAALRGFTPTAYVNGLQVPNTLNLSSWRVDPYMIDSITVLRGPTSVLYGAGDPGAIVDVKTKLADGERVREAGVEIGNYARKQFMIDVGDKLDPDGKYAYRFVGVARDGNAVTGPNNDQRVALAPSFRWRPNADTSLTLSATYLQDWGDISSNFLPAAGTVLPNPNGQITKDIYEGDGNFNYYRKKQWSLGYQFEHNLNSMWTFRQNTRWMHLSVDNGSVWGAGFADETLTEINRWAGVFQMNYSRFDIDNNLEGRFATGPLQHTLLLGFQYNRQTATDSEWLAAAPTLNLYNPVYTPVTTAVFSDPDTTYRTNTYTTMNTFGLYAQDQIKWNRWTLTLGGREDWVNMRMDDRAAGTQSKADVSAFTGRVGLTYQAGYGLSPYISYSTSFNPIIGVSLLDGGVPKPTRGRQIEAGLRWQPPGKNLMLNAAIYQINQTNGVTPALPTQDPGGTKSVQTGEVRARGIELSATGKVTPNLSLIASYAYQDVKVVQANDATLNNWPVDIPRPRQMASLWADWTWHTGPLAGFGLGGGVRYQSASAGAADNSLTVSSYTLIDAAVHYDVRNWRFAVNATNLFNRHYISGCQSTSVCMFGNDRTVIATAKYNW

SEQ ID NO: 14787 - protein, 734 aa, Shewanella denitrificans
MLNRTPFASALALAFALPIASSALAQSTSAESSPAAAAKPGDAPPAAAAARETLPTISVSGQAVQQDFQAERSSVGAKTPTALRDIPQSVTVINKALMESQGLTSFQDALRNAPGITIGGAEGGQIGNNINLRGFTAQNDIYLDGFRDRNQYYRDTFDLDSVEVLYGPSSMLFGRGSTGGVINQVSKKANLKPSAEVSTTIGTNDRYRTSVDLNRPLGATSAFRINAFGQSLGSTRDVMKNKDYGIAPELRFGIGTPTEVTLSALIQHNYDMPDYGVLAVNGHPAPVPKNTFYGLTDDRTIQDVQTVSARVDHRVNDALTISNRTSFSHSMTDARETAANAVLTGPLSSSTALTNGNYTSLPMSALYVRLASHDRVIENHSVDNDTMAHFKFDTGFVKHDLIAGVEVGHDSYTNQAYTRSGLPILSLINPAYLASTPTNAKQTPANHAESGATTLAAYMNDTVSIGRDWKFVGGLRWDRFQAHLANTVSAPRYASQTNYFTSVRAGVIYQPTESQSYYFSYGTSFNPSLETLTVTNNTQNLSPEHTKSYEVGGKWDLLNDNLSVTSALFQQEKSNARTQTSTGEYLLEGDVRVRGFQASVTGHITPKWQVFGSYTYMNGVILGARDGTQGKTLANTPRNTFTLWTTYAFTPHWEIGGGPTYMSGRYAANTDYVQVGGYTRWDATAAYHAKQWDLRLNLLNLTNKFYYDALIQSDGGRAVPGVGRTFLATLDYRF

SEQ ID NO: 14788 - protein, 493 aa, Shewanella denitrificans
MNHTFNKTLIASLLTLSAGGVSASLFQLAEVSTSGLGMAYAGNAAVADNASVVANNPALMTKLRQAQISAGGVLVDTDIIISGTSASGSNAYASNVVPTSVIPNVYFVTPINDKFSLGLGYNVNFGLSSEYPDDYNAGSIGGKTELQAHNFNVSGAYDLGHGFSFGAGVNAIYSKAEVRRTLGDQSKSIETARKGAALLSSLPASMTLSTLAASIPNNPRLQALAAANPEAAATLQSLAKSSPNTTVSQAAAALAATANSLSAMNKSTEVASIKGDEWSFGWNAGLTYDLNENHRWGLAYHSAVDVKFKGKYRNGLTQDMRTSKGTTYATNNQEWDGRLTLNLPAYWELSGWHKLSERVAMQYSWKRTEWSRLKALDAYHDLDGKHLFHKTENFRDSNRYSLGFSFIATPDLTLRTGIAYDRNASVNHPSISIPDTNRVWYSVGATYQITPNTSIDAAYAHLRGTSFSFKEDGAAFKTKARGNLYGLNLNYKF

SEQ ID NO: 14789 - protein, 747 aa, Shewanella denitrificans
MGKSVLAFASIAAIGAALAAGAAQAQAASGEAPSGDDIIVTANRQGSQSIQRAALAISAISPNALADKGQGGLADIANVAPSINVQQTQPGVNRVDMRGITTGTISVTNVQDRPLVAIYLDDVPLALQSGNPELKVFDLERIEVIRGPQGTLYGAGSMAGTIRYITAKPDTKGFSGSAEGIVSTTAHGNLNYGLRGIVNAPLSDTLAVRIGGYQGRNAGFIDNTGLGKKNANSDESTQARVAARWTPSPEFTLDASFTFAKLDVNGTNAGYAGFSRYSYITAVPEVFDDNLKIYNVTGAYDFGFATLSASTSYVDRKTHNTSDYGDTAALFGIPSFVSLGIVDNRVKDFSEEVRLVSAKSDRFNWTVGAYYQKTKRHYYQDTPTTDFDSTFGAIIGDPTFNSQTDYQAFQPNDVFSGLQNIDEHQFALFGEATLTLGKFDLTGGLRYFDFKQDFDLFYSGVAGSLAPGQPLTQAGTEKANGFNPRAVIAYRPQENLMLYAEAARGFRYGGVNQPVPASFCGAALAAAGLTSAPLTFGPDNLWSYTVGEKGQFFDRRVTFNVAAFYVDWKKVQTNRNLDCGYYFTQNAGKVRSMGLELESRFKLSDALTIGINGSYTDAQANGAIPNAGAVDGDRVPYFPKYTVAANAAYVVPIEDGSLTFSGDFQMRGNSYTEFNEADPLRRKIPAYQTVNASVTYDRGPWEFSLFGTNLNNSRMISLVSRSRPTAIADRYYYGRPRTFGARAKVRF

SEQ ID NO: 14790 - protein, 450 aa, Shewanella denitrificans
MKKTVLTLAISAIVFGATTQVNAAGFQLAEYSATGLGRAFAGEAAIADNASTQARNPAMLAYLEGRQVSAGGIYVMPNVDVVGDVGISSPLLGSEPLVIGADAYDVADNAFVPNFYYSNQLNDQWTWGLAVNSNYGLATDIPVADAAAIFGSKTSITTVEFNPNVAFRVDDSFTVGAGLRVVYGEGEVSATAPGWIDAIKANPNLPASINARLPSGGTNLKSMEGDDVGYGWKAGASWQINSANRIGLAYHSSVDLKLDGHVSGVAYNGGQNIEIEGYLPIELPAFAELASYHQLTENWAMHASVNWTEWSVFEQLVAYFPGDVKPVGGLESDVVKEENFKDNWRYALGTTYTLNDQWTLRAGMALDKTAVDDQHRTTTIPDSDRLWFSVGTGYQVSKNLNVDVGVTYIRTHGDAPITETQSLQNIASVSFTGEATGDVWLTGVQLSYKM

SEQ ID NO: 14791 - protein, 446 aa, Shewanella denitrificans
MNILKLSCLALAIGAVASQAAVAGQQQEAKGFIEDSSLQLINRNFYMNRDYRHGGSNSQGINRAKPANERNGYREEWAHGAQLNFSSGFTQGTVGVGADAFAYGGVKLDTGRGRVGNGLLPISNNRTADAEVPDSYGQIGGAVKMRASSTELKYGEMRPTAPVFATGDSRLLPETATGFQISSNEFDALSFEAGHFTSINRRNSTNSDDDMTSEYAEVEARSVDFAGLSYAVNDDLSLMFYASEAKDVWRQYFANLNYNIPLADSQALNFDLVAYKTRDEGEARAGELDTLTWSLKGAYSFGAHKLSLAYQKVRGDEFFDYIGGDSIWLANSVQYSDFNAPNERSVQIRYDLNMKHYGVPGLTFMARYIKGDDIDGTKADPNGAFAGWAGDDEKHWERDLEARYVFQEGAAKDLSLRLRHATHRSTAFDDDLDEVRLIIEYPLSIL

SEQ ID NO: 14792 - protein, 426 aa, Rhodopseudomonas palustris
MRQHTVVAMAGFLAVMAVGHDVQAKSLEDILKEKGVITEAEYKEASKAKPLDYKLGKGFVFTSPDQKFQVQLGGQIQAQYELDNYEAASKQDVSQFNLRRVKTLLSGYAFTKDLTYKATYNWANVVKDNTKAMEEVNLKYRVADELQVMLGQEKIQYSRQWITSNTAQQFVDGSFVRNAFMQGYDTGINLHGDLWQGVVKYDAGLFGGAGQNTKNKTNDNAYNFRLAFNPLGDMKYGEGDLEHSAKPLVSLGSSYYLSTLKKTVSGTGSTATSAIDNNNSNFVTDSNGWLGTAVKGKYFGTAAAENISVDSWEADFACKWLGASMQGEYFWGKAQGEASGKDLIAKGAYVQAGYFVIPKRLELALRYAWMDPNRQLANDAVSEIQGGVNYFLYGNNLKIQGDVGNRHTYKNKSDDLVARAQVQLLF

SEQ ID NO: 14793 - protein, 824 aa, Rhodopseudomonas palustris
MPSPRRSRLPFHTLPLCTALLCGAAPWAHAAADAGQNQSQAERRSYSIGPGPLVTVLNRFAEQSAVFIAGHNDLAAGKQSPGLNGRYSVAEALQLLLANSGLQAQAVSGGYVLKVLPATSCPLQLGTTQISAQGLGSVTEGSQSYTTGASASATGLNLSLRETPQTVTVITRQQMDDQGATSIADTLRRAPGVSVQNYDSERWEFSSRGLPITNFQYDGVNATYDGVYDYGTTSTDMATFDRVEIIKGATGLMTGSGDPSATVNLIRKRPTKEFKASVTGTVGSWDNYRSEGDISGPLTESGNLRGRFVGVYQDRSSYLDHYQNTKDIAYGILEADLTPDTLLTFGLDQQNTRSRGATWTGFPMYFSDGSRTRFSRSFNPATDWSRRDFKNQTLFTSLEQQLANDWTLKVSYDHLRRQHDTLLGSASGGNPDQASGDGMFMYMGKFKGDQRQDNLDINLHGPFSLFGREHELIAGFMLMNAKQDIPVHGSVYPPVGGSIYDWRGEFAKPDIPKIGDNDILQRQTGAYLATRLKPTDDLAVILGTRVSDFKGIDNTRYLDPNSPDARQRYQQTGVVTPYAGLVYDLNDSYSLYTSYTSIYQPQMSKDVDGKILDPVQGDSYEAGIKAEYLDGRVNASFAVFHTEQDNVAQLVDGWGIDAIYRPTKGATTKGFEVEVAGELSEGWNLSAGYSYNHTRDANHDYVYGSVLQSTEPQQVARLFSTYRLPGAWDRLTVGGGVNWQSQFFGKVYQPDPSDTVNGGHDSRITQDGYFLVDAMARYQFSQHLSSTLNVKNLFDKKYYTGIGNFSTGFYGEPRSLQLATRWDF

SEQ ID NO: 14794 - protein, 365 aa, Rhodopseudomonas palustris
MTFQTGSYMMGNYNPTSAVTAPQNLGTYNMYGAAPTGGTQPYYQGRYKSSTITSQSFIVGDTLTINKHWSIMGTLAWSWIDQAGALNATSPLKQSFQANAAFSPTTSLMYKPTDNQTFYFTYGQSVEAGPVTPNSQYYTNTNIALPIAHSEEYEVGYKVRYQKMHFNVDGFRMTSPYAMYVGAANGTCAGGKTCQTYTYGGTQRNYGVEAQVSGEVLPNLSVLAGMTWLDAELVGSKTAAYNNKEIVGAAPLQASLLLDYRLPARLGSFASGWAFNAGVHYIGNRAANVTNTLHTGSYTTLELGTRYAFHVARFPWVARFGVSNVTNERYWASVYTGAPSGTSGAASTLYAGLPRVYHFTLSAEF

SEQ ID NO: 14795 - protein, 229 aa, Rhodopseudomonas palustris
MTKFLTAVSALAMAAALNGLPSSAVAADLSAKPIYKAPVVEAWNPWMIRLRALGVVTRDSGYVDQVAGSGLKTTDTLVPELDISYFFTKNIAAELILGVTKHSVSGTGTLANVDVGKAWLLPPTLTLQYHFTEFGAFKPYVGAGVNYTFFFSQKAAGGTVVESHLKDSFAPAVQIGFDYMFDKHWGWNVDVKKLWLRPEWSGTLAGGTPVTGKVNLDPWLIGTGITYKF

SEQ ID NO: 14796 - protein, 856 aa, Rhodopseudomonas palustris
MSLRALRSSLVASASVLAGTVLPAAVQAQQSVTLGEISVVSTSPVGAGGGSSSQAQIFNGSGPVPPAGSVGPSAGVRLRGSEQPLYKIPSTVESVTASDLTIDRASDNLTTTLARRTPGINVSDSQGNNNRVDITYRGFTASPVQGVPQGLAVYQNGVRINEAFGDIVNFDLIPPQAIQRIDVVTGNPVFGLNALGGAVNIQMKNGFTWQGTEISAWGGSDARTAGYLEYGKVSGPWSVYFTGDGLNDRGWRYESPSTIGRLYGDIGYRSQDSEFHLIGLAARSFYGAAAATPVDFTHRDPRAIFTYPQTTTTEVGTLQLTGRVDISPTWDLAGNAYFRRFSQTYVDGNDGNFENCSTRSSFRGNLCFEDDGFSPAAGQSQTAFRNQFLILGQQNQRIPFRSGIPYGTLDTTRTEATGFGGSLQAANRDRIFGLSNSFVVGGSIDAANYGFKSSSTLGVINPNLSITTDPSNPFYGNIPGLGTPQLRTAGALGIAPSSVNGSNLYMGLYTLDTLDVTDRLSLTAGARLNFARIQSEDLTGFSPDVTGTHYFNKINPVAGLTYRFFDALNLYGSYSESNRAPTPLELACANPDRPCLLPNSLVADPPLKQVTGRTYEVGFRGQLPNTYDGGIITYKIGAFRTDLANDILSLATPGNTARAYFVNVPSTQRQGIEVGGEYTADYLRVYANYALVDATFQFNGTLSSPNNPLADDGAIQVRKGNVVPLVPTHQIKAGFDYFVTPDWQFGLYLQAFSSSYFRGDESNLNRKLPPYYVLNFQTKYQVTKNLEVFGLITNLTNNRYATFGTFAEPGAVAGNLRISDPRTTTLAQPFSVYAGIRYAFGADPVPMSPEPIIRKY

SEQ ID NO: 14797 - protein, 284 aa, Rhodopseudomonas palustris
MRSVKLLVAAGAASLFSSAAFAADLPIAPPPPPYFVPPIVDFGGWYLRGDIGFSNQRVRNIAMADGRNAQLLSHEQTTAFDAAGIYGVGVGYQFNNWLRGDITGQYRGNANFKGTDLLTYPVGGGVVGTGVNNYNAAKSEWLVLANAYVDLGTWWGITPFIGAGVGAARVTIANYTDVGMVNNIGFGWGTYPSAAVAPAASTWNFAWAAHAGLAYQVNPGLAIELGYSYVNLGSGTTGPVSTYTGFTRGVPMQFNDITSHDLRLGVRWYLNSPPAYAPPLVTKG

SEQ ID NO: 14798 - protein, 363 aa, Rhodopseudomonas palustris
MAWHSKGSVSVTLNSEAVLGNATDFIANVRTGDAFRGPDGRWYEITNVTSATVISIKPNYQGATASGQVYAVVPIHGYSKNLADQFRDINNQWGATLAGIKPWAVSSTGQQAQADMGISAVGRALNNASTPANALSYLGGVAPNQMGWAGNAMNTADLDSLTVSGLYAHGTAVPSPVNNAQGYVLHMQHGNPDFAVQQWYQLNSATGQYMRIKAGGNWSRWVLQYSQFNLVGLASFDASNNPSGAIIQRGGTVGFNEYVRYADGTQICWGNTTTNVGATMAYQPAGTLSFYITPVAYSWGFPVSFSRPPSVMVNPMRAAGNNASRPWGSTMSVTETLFSWYGYDTASVASGMAASYVAMGRWN

SEQ ID NO: 14799 - protein, 1085 aa, Rhodopseudomonas palustris
MQRMSNKVKNMRSLLLILFSAISLSVSAQTITVKGNVKDTSGEPVIGASVVEKGNTTNGTITDLDGNFSIKVDGKKTLVISYIGMKTQEVAVQGRKTINVQMVDDSKALDEVVVIGYGTVNKRDLTGSVASVSAKDLAAIPVASASEALTGKLAGVSVTTTEGSPDADIKIRVRGGGSLSQDNSPLYIVDGFPVSSISDIAPSEIQSIDVLKDASSTAIYGARGANGVIIITTKSGKEGKTQVDFGASFGFKQVTKLTEVLSPYDFVAYQREIGSLDYGNFADMDIWRSIDGTDYQDEMFGRTGNQQQYNINVSGGTKQMTYSVSYAHNEEKSIMLNSGFKKDNVNAKIKSELNKWMTLDFNARLSYSTIDGLGGGADTNESNAANSTVANATVFRPVDSLKYSDDDEENSSAQQKSPLERLLATDKTRNTFNQNYNVGLNWKPFKNWTFRSEFGYGWKFDDTEQYWGVDAVSNSKYGYNGQPQAYLLREKTMSWRNANTLTYDNKKLFKGRDKLNVLIGHEVSSSQRKSIENVSVAFPVTMNFDDMKANMGSGKALANQSTIAAKENILSFFGRVNYTMMDKYLLAVTVRADGSSKFGSGNRWGVFPSAALAWRISDEAFMSNTQDWLSALKLRLSFGTAGNNRINSGLLSTTYSLGGNDARNPFFNGESTTMLEHGTNLYNPDLKWETTVTRNIGIDYGFWNNRISGAIDFYWNTTRDLLMRTEIPSLSGYNYQYKNFGQTSNKGVELSVSAVLFDKKNFSLNFNANIAYNRNRIDKLNTDSPWQSSNWSGSTMAKYEDFRVEKGGRLGEVWGYKTNGYYTVYDPVTNPTGELVWAGSEWGLKDGMQDNSPTITGGKYYPGGLKLECDKDGNPLKQRLGNTIAPTTGGFGFDGRVGNFDFNVFFNYSLGNVIVNGTKLAASFRSGSRTGYNLNNDFRLSNRYTWIDPETGLNLSSSSTDVLNTYGDMTTAGLRLNEINANANMYNPASATTMQLTDYAVEKASFLRLNNITIGYSLPKTIVRRAFMQNVRIYLTGYNLFCWTNYSGADPEVDTSSKKNAMTPGIDYAAYPKSRTFVGGINVTF

SEQ ID NO: 14800 - protein, 646 aa, Rhodopseudomonas palustris
MKSVVTKQALIGLLFFSISIYSHAANPPAQPTDTIVSGNIALEDIVVTGSRTARLLKDVPVPTKVFKAKDIKAIAPSSFIDVLQYILPGIEFTKHGSRDQLNAQGFDESSILFLVDGELISTGSTSGIDFERINPDDIERIEVLRGASSALYGSNAIGGVINIITRTAKDPFRVSASARYDSRDGQKYDVAAGVKRGIFTSQSGVQYRADKSYILADQFEQELNVAGNTTWNINQKFTISPTENLSFNLTGLVNLRKQHWTDKIDFLYNSYDVKAGANWRISETSDLDVSYHYDKYSRDTCLIKTENQKKLPIFDEDMHHLRAQYNLNLAEVHLLNVGLEYIHDNVASPRLSSPNDPGEKSVNNKILYGQYIYKVTPKLVLSYGGRLDKHSGFGLYYTSRLSAMYKCSHVTNRLSYAEGYRAPSLQEMYFFFNHGAFFIYGNPDLKPEKSRMLSYSAEAHWNKRTLMGNVFFNHVRNRIDFTYKGTDLIYTNVSKEMRIFGFEGQANVVLPYGFGFRASYSYTYDRWKATDKAGTEMKLSNTRPHAATATLSYGHNFSKNYRLASNFSTRFLSDLKTGRMNSDELFEEITYPGYTICRLDIENHFYRNYTLHIGAENLFDYKPKALAFNSPTSPGRIIYGLVRITF

SEQ ID NO: 14801 - protein, 702 aa, Rhodopseudomonas palustris
MLRFVSKTICLSLIGLFNPLEAFQKHQKDGFFVEAGFETGLLEGTQTKEETTAQNTPKIYENPLTHPQTKEQPKEQNKSDTATPQSAYGKYYIPQSTILKNATALFTTNNIENGLTFYSQNPVYANMVNGSVTIQNFLPYNLNNVELSFKDAQGKVVNLGVIETIPKDSQIILPASLFNDSEFEQADSFNYQQLQATATQFSDANTQSLFEKLSQITTNVTMSYENADTNNFKGNCNDCVSDFTPQTAEELTNLMLDMIAVFDSKSWEEAVLKAPFQFSNSPSECGSDFPKCVNPFNNGRVAPIYEKYVLTPQSVIDAFRRAINLEVNIMKSGFLGLGYELDDNDGNLGIAASALNPEKLFGKTLNKVDIVELRDIIHEFSHTKGYTHNGNMTYQRVRLCQENGGAIQECEGGKEELVNGKEELKFTNGKEVKDQDGYTYDVCSFYKDNHQVYTAGNYPNSIYTNCAQVPAGLIGVTTAVWQQLINQNALPINFANLSSQANYLNAGLNAQNFATSMISAIAQNFSTTSTTTYRSSSKNFRSPILGANVKIGYQHYFNDYIGLAYYGIIKYNYAKADDEKIQQLSYGGGMDVLFDFITTYANKKQGNPTKKVFASSFGVFGGLRGLYNSYYVFNQVKGSGNLDIVTGFNYRYKHSKYSIGISIPLIQSGIKIASNNGIYANSVVLNEGGSHFKVFFNYGWIF

SEQ ID NO: 14802 - protein, 1111 aa, Rhodopseudomonas palustris
MDVPTVMGGRIANGRVRIASVAAARIKQLLLSTALVGIVVYPQALQAQSWNGAVDSDFSNGANWSTGVAPTSTDVSTIASTPTTPVVAATTANAGQITMTGATLGINAGATLVLNTLTVGSGSTVTGAGAIATNSLFLDSGSVAPDVALGILATMGGGTISGAISGAGQMFVSGGFNYLTGANTYSGGTEINTNAFLTVGDSGTLGSITGNVLNNGTLTFTRSDTTSYGGVISGAGVVIKNGIGTLVLSGANTYSGATTILNGTLQTAVDYVLSSASALTIAAGATLDLTNTQQTVASLAGAGNVNLGAGHTFSFGGDNASTSFTGNFIGTLSAIKEGTGTFSFSGTGPSAGAIQINAGTLALTGAADFSGAGVTLQANTTLDISGANAGISIKSLQGQNGTAVHLGSRTLTVQRTDFVFGSNFSGVVDGSGGLTVGQNSSLRLFAANTYSGPTTLNSASATLDLRHVGAIATSSEVNLAASGATLDISNAGGDATIQALRGVAGSIVTLRNSNLVITNAASEFAGIIKPAFGTPTGGVILNGGHQTLSGINTYLGATTVNAGTLSVNGSIATSSLTTVNAGGTLGGTGTVGTTLIDGGALAPGNSIGTLNVNGNLVFTAASSYMVEVSPTAADRTDVTGTATLGGATVNAIFASGSYVEKQYTILNAAGGIVGTFGSVVNSNLPSGFKSSLGYDANNAYLNLVLDFTPTPTPTPTPSPLPINSGLNGNQTAVANALSGYFARTGSIPIVFGALGPAGLSAAAGETPTGVQQTTFNAMNMFMGVLTDPFSNGRGRGAQTPVAMSYAGGGSVRDAHAMITKAVVKPPFESRWVSWAAGFGGSQTTDGNATQGSATSTSRLYGIAAGADYWLSPQTVAGFAMAGGATSFGLSGGLGSGRSDLVQVGGFVRHSVGAGYLTAAAAYGWQEITTERTVGIGGVNQYRATFNANAYSARVEAGHRWIAPALGGVGLTPYAAAQITAFDLPAYAEQTVSGTGVFALDYASKTATATRSELGLRGDRSFALDGALLTLRGRAAWAHDFDTERSIAATFQALPGASFVVNGARPARDAALTTVSAEVNWLNGFSVAASFEGEFSDVTRSYAGKGVVRYAW

SEQ ID NO: 14803 - protein, 832 aa, Rhodopseudomonas palustris
MSGAEDNGCGKGAGAAHKIVLLGSAAALMVVVSGAIVGSASAQTIPLQQSAPQTIAFNIPAQDLGGALNAFADRAGLRLLFPSNLVAGLRSAGLAGSLTRNQALTRLLAGSGLTYRFTSANTVTIADSAAASAGAAPAGAISLDTIDVQGASSSDPGKTEGTGSYTPSVTASSTRLQLTPRETPQSISIITRQQIDDFKLLTVNDVMTQTPGISTVTYENERVEYYARGFAIRNFQDDGMPGFYASGYPAGQSLSDMAMYDRVEVLKGANGLMTGTGDPGATVNLIRKKPTSVFQGHTTLTGGSWDTYRGELDLSGPFNKEGTVRGRFVATHQDRGSYMNYFKNRSSLVYGVLEADLTPDTLFTVGAHYQYNIPKGTSFGGIPLFDSNGDFNQMPRSFNPGARWSSWEQYVYSAFTTLEHHFDNDWRVKLQLKRQVNGYDTRLGSASDGNPNPLDGSGVSIWTGAFLGQTQLDVAEAYATGPVHLFGRKHDLVLGGIISKRHWRNSISSADPAYDPTVPNFYDWNGNIPQPAWVLDGVGNEVMRNRAAYATFRFNAHDKLKLIAGTRILRYEWMQRPYWDPSVEERSNRSVVVPYFGAIFDINEHLSIYGSHTGIFQPQYERTEQGITLPPQEGVSNEVGLKSAFFNGRLNSSAAYFEIQQNNYPVPTGGLAPDGNPAYQAVDGVVTKGFELEISGQLSPQWQIQTGFTHKISRRDSIKVSTLTPENQFTLYTTYKLDGALDGLTVGGGARWQDITWSDQVWNGVIGADVTSTAPSYWVADLMANYKFNENLSATFNVRNLFDKKYYSIYNWYSSYTWGAPRSFLLSMTYKF

SEQ ID NO: 14804 - protein, 333 aa, Rhodopseudomonas palustris
MKKYLLPVYILLAPAWASTESPLFFIEAKGGYQWASDDSYKHSNPKGAIFGVSSGLQFSPAWSWDVGYQYHDDLKADATSVNVKAGLIESALRYDWYLQDNLSVYGRLGVAYWDMEKTHLSSDKLDATGLSPLGEVGVNYNFTPNVRLSAGYQYIDSIGESNTGKYDSHGFLVGLTYAFGHAAQPTLIKELSTPATKTVIVETSPQTLTFSSKSMNVIWGFDATKLSHDFIEQLAEVVEVLNTYPQARVAVLAVGHADSIGSEAYNQALSEKRAQTVANKLLELGVSPAQIEVQGEGESHPVANNQTADGRAKNRRVEVSIPSFQYQKQAVLS

SEQ ID NO: 14805 - protein, 384 aa, Rhodopseudomonas palustris
MNGDTNKKGKLMKQTTRLAAIAGGAALAFASQYAAAQSSVTLWGVADASIRYLTNANAKNDGLLSMANGAITNSRFGIYGTEDLGGGLKAVFNLESGVNLQNGGFADSGRLFNRAAYVGMQSPYGTVTLGRQKTPLFDLLADTYDPLTVGNYLENAWLPVALGGGLYADNQIKYTGKFAGLTAKAMYSTGTNYESTGAGGFSGQIPGSLGKGNAWGVSLSYVAGPLSIAAGAQQNSDNSARKQTIYHANVVYAFSKAKVYAGYLRSKDDTGFVDSLLAQQSIPVAKGTGRIDDGPFAGVSWQVSTPLTLTGAFYYDHMRNAMTTNGTLASGNRYAIVGIAEYALSKRTEVYGTVDFNKTNGAANVELPGRSNQTGIAIGLRNIF

SEQ ID NO: 14806 - protein, 191 aa, Rhodopseudomonas palustris
MKALSPIAVLISALLLQGCVAAAVVGTAAVGTKAATDPRSVGTQVDDGTLEVRVNSALSKDEQIKKEARINVTAYQGKVLLVGQSPNAELSARAKQIAMGVDGANEVYNEIRQGQPIGLGEASNDTWITTKVRSQLLTSDLVKSSNVKVTTENGEVFLMGLVTEREAKAAADIASRVSGVKRVTTAFTFIK

SEQ ID NO: 14807 - protein, 753 aa, Rhodopseudomonas palustris
MRNSMARGASWLAVAVAAGGLAQVPARAQDAAAVDGAEEIVVTARKTTERLQDVPIAVTALSASALDARGIGSVTDLQQVAPNLQFTPGTGGNGGAIAPFIRGVGENDFIITADPAVGTYFDGVYVARTFGASPELLDVERVEVLRGPQGSLFGKNTVGGAINVVTRMPGDTAEFEGDVRYGSYNDFRVRARAALPLGGGFSLGLSGLGEWGDGWQRVPSGKDLGNRNVVNGRAVLRYQGGAFEAIAQVDGLRRRQNSAAHSMLDFTPTFFSTLQSLFIAPCCTVPDRIDRTDTTPSLNRDHADAANASLTLSYDLGGAKLKSITAYRWVHAQFGRDGDASAEVNYAGDFHNERARQFSQELQFTTSIFDRGSLLLGAYYYRERTKDLTRLVVADGLYDASGFAEFSTDVLELPPEFLDFNIDFDNRQTTTNFALFGNATVPLAERLTLELGGRYTHEKKAFYQAANRVYSNTPLLFGTPSYELEQSWDAFTPRVSLSYKLRDDVLAYASWSQGFRSGGFNGRPTSLEEIGSYDPEHLDAFEVGVKSQFGRILTLNLAVFRNQYRDQQLLISTVSENTGLIVVRTENAGKSRIQGIELEGTVRVSPRFRIDGSLGLLDAKYQKYVSVIAGVPTDVSGRKLKQAPEVTGSLGMSYTLPLGERMDATFRADATYRSANFIDVENTPELRAPDHAILNLSTTLRLPVDGLSLRLAVDNVTNRRIIVAGYDARTSFGFLEGYFNEPRRYWATLSFRR

SEQ ID NO: 14808 - protein, 277 aa, Rhodopseudomonas palustris
MKKFLLAVASVVLGTASVQAADLAAHYTKAPMMAPAYNWTGFYVGGNVGGQWGSSDPSTSTVFSPTGYFAASSVPAINTVGAQGINSSSVTGGFTAGYNWQVNHAVLGLEGDINYFGFKGSATGSALYPCCAPTGFTVSSSVSADWLATIRGRIGFLAAPTWLLYATGGAAIAEVKGNFNFTDTFAGATESSAIRDTRLGWTAGVGTEYAFGGGWSLKAEYLYVDLGRASATSTNLAAFVPAIAFPSNVYTHSVDLKSNIVRVGVNYKFGGPVVARY

SEQ ID NO: 14809 - protein, 169 aa, Rhodopseudomonas palustris
MGIPQNQGAIYTNVGDLDNQGITAYLGYAIADVSARLSYNQSRPELNGTPLSDEDSTLGTSIGDTWALDLIYQPMESLEFGWNARFVERLTDVANPTVHPEKPGYGVHDVYAYWMPIADEELSLTLSVKNVFDKYYFDHASYMAYIGSPVAQGYASPGRDFRFNVTYAF

SEQ ID NO: 14810 - protein, 261 aa, Rhodopseudomonas palustris
MKRMCTSLMLAGSLLAGGQAMADGLLQWQNNSLTYLYGKDFQVNPRIQQTVTFEHADAWKYGDNFLFVDKIFYNGKDDGGVGSNTYYGEISPRLSFGKIFDQKLAFGPVTDVLLAMTYEFGEGDTESYLIGPGFDLAIPGFDYFQLNFYQRHTEGSRAGDNVWQITPVWSYTIPVGDSNILIDGFMDWVVDNDSNSKGDYHANLHFNPQIKYDLGKALSIGEKQLYVGVEYDYWSDKYGIKDSQYFKTDQSTTSFLVKFHF

SEQ ID NO: 14811 - protein, 1098 aa, Rhodopseudomonas palustris
MFGKVLNVLVAALMCSVLYPVAAQTTAGRISGTVTDSTNAAVPGVKLTVRNTETQDTRIVTTDANGYYVAPELAIGAYMVEVAQTGFKPQEQTGIKISADSRLTVDFHLQVGDVRQSVEVVAAAAEMLNATSGEIAHVIDQEQVDNLTLNGRSYAEFLTLIPGAVVTNPDQFGTLTSLSATSQSINGHRTNQNSLTVDGVGNLDNGSNGSLINNVSPDFLQEVKIQTSNFSAEYGRSAGAAFNIGTKYGTNTFHGGAFEYLRNDAVDARNFFSPNLTELRYNDWGYYLGGAIKKNKLFFFAGQDWKKIRQQSAPSRTTLPTTDQIAGNFGTRVIYYPGTKNPFPNNIIPASMITSDGRAIMNVYKSVIPQASIFTNTPISNNATFENPNPLDYREDLGRVDYHINDKHTLFGRWIDDYNSILVANGPGGNIPITPEIRDRPGKSVLLSETWVISPSVVNEGHVGASWNSQHYWNQGDTWDRGVQGFTFQKVYNSVGPYPNGIPDVTLQNFATFNGPSKTLISPTAEIEFKDTLTLIRRSHTIQAGVMVIRNRKDQNGRSAYNGAITFNTTGNPNTTGYALSDALLSNFQIYTEAAYDPMGKYRYTEPAGFISDSWKISRKLSLDLGLRYEYMMAMYSTVDNLSLFDPSRFDPSQAVKMTSTGAVVPNSGNIYNGLVRVANGINPSQAYLVPNANSPAVLGVPAGAPRGMYSSPGTWSPRIGFAYALNEKTVLRGGFGLFYDRIQGNPTFYTLNNPPYVGSTEFDYGNLSKITGGVTVSNPWGTIQTMNPHFRPPYAEEFSLSVQRELPLHLFFETSYVGSLGRRLLLEPDINQPSFATIASLPSTTNENSIRPYSGYSTIQQFISAGTSNYHSLQTHLRRRAGQVTFMGAFTWSKNLGNTSSDTSNDLDYMNYHLMYGPVYSTSSAGSMDIEKVFVGTFVWRMPTLRNRSIFIRGAIGGWQLSGVTHLQSGPYMTVVGSTSILGTRMADYNGGAVKVADPGPNGWFSAAAFSAAPQGRWGTSGAGNAQAPGMQTYNISVQKMFNLREHITMRFRVDFVNAFNHTNFQAPSVTITNTSFGTITSAYPARAIQFGMKLAF

SEQ ID NO: 14812 - protein, 779 aa, Rhodopseudomonas palustris
MVGLNSRAYALLLSVSVVALTTAPASAQTATGSSTSSAQTQVKRDRAARTAQPAAPAADPRNANAQAGSSTQSLDAITVVATKNEEKAIDALAPASAITLQQIQQFPPSRLQDVFVATPGVSFQDRGDEPSTSINIRGLQDFGRVAVVVDGARQNYQRSGHGAQGSFFLDPELIGGIDIVRGPSANIYGSGAIGGVVSFRTKDIDDVVRAGERWGVDLSGSYGSNNARGLGSVFGGVRVDPSVDVFGGAVYRTQGNYKDGAGTEIGNTGNDLAAGLMKFTVRPADGHEVKIGGIFQDFNYDVGQFNRGPSQQALYQGSSVYSTSLQNYTGTLSWKYSQPDDTWFDWSVNLYGNRTNSDQTKTYHYSTSGSGYCGAGNYGNNISGCIGDKRGYNLDTIGIDANNTSRFEYGNWRTAVTYGVDVFNDKVTTWDSRGNSNITTPGGERTVSGGFIQVKNNYAQWLEVIGAARYDHYELNSNSSTASGSRLSPKVTLGLTPIAGFTPYVAYAEGYRAPSITETLIAGAHATGGGPALFTCADGTSGLFCLIPNTALRPEVGKNKEVGINLKYNDVFISGDSFRGKINAFRNDVDNYIELLGSTPQAYRTVFMGFPVSGVASKYYQYQNIPHARIEGVEVETSYDAGMWFVGVSAAVIRGTNPDTGLGLVSVPARKVVTTGGLRLLDRQLTIAAQWASYAANTNLPTGYLPGTSYDLVNLNIAYRPTADVTLNFSIDNLLNNYYRPYAIPGSSSDGTTQNDILWTSPGPGVVYKGGIKVHFGGA

SEQ ID NO: 14813 - protein, 678 aa, Rhodopseudomonas palustris
MGAGNDILLTNANISSTDKGAFIDGGDGDDIIKFATTGSASFSASTIKNFESAEQVDGTWDYDGDYKTAGVKTITISGGTMHLTDSDASIFEDVVMTGGTILADISDKTSAPLTADSFEYKPSNAKMPPQLIVQAGSTTDPEGTYVILDVPETSQSEMNELAANSTLIYDDEVGEFSGIGEENGIEGTANFDVYMVEGSLNVQVDAKSAPEIDKDLNNIDPSDPDLGLDDDEQELVEIIQDGGPGADLIDSLLPDVIENIELPIISYGTLGKLFVSGFGPRNIDGAGRGMATYNNLLTDVVFERLPLRQFDPVVVEKTVVEQEEVIEESAPPVRGLWNKSGEVSDQQAQQALDQAIAQAEVTGETTIESLEASGFIEDTSLTAQYARRDGVRAWFRGFGGDDHDSYNDNFYNPYYVNAGGGVLGVDVSVTDNFQIGAFANYGNINLIQQNTLAGGGSWNSDGWGGGVKADYWTDNFYVQGLFSATGFSGNQKREIIEITDQLGDDTASGDKSATSYGLAFRLGAPFEAGKFVLEPQFTTTWSFNNEHQFTESGAGQLNLTYKERSTTYVQTDLAMKFSYPINTGETSQLVPSLRVGWLGDWSGNLSDQTLGYRFTNKEANIKSANEDTNGVLVEGGLDYTIANVNSSSYKVYFRGGIEAWGGARGTDYRASGGFEWQF

SEQ ID NO: 14814 - protein, 716 aa, Rhodopseudomonas palustris
MRKELRVRVGTHQAMSLKWTALVMASLFGTAANAAHEHMEHLPEIEVTAHAHDRNSDLHKRMVNSADTASLLQDYTGVYSYQAGGISALPNIRGMNDNRIRILVDGAELTAACANSMNAPLTYISPAAVANISVLAGITPVSMGGDSIAGTITVDSAKPIYAANADAWLYKGSFSTVYRSNNNGLSTALNATAASDNLSLSFTSTMDRGQSYRDGNGDKVLASQFERHIQTLTIGAKGENEDFVLRLSHQEVPHQGFPNQRMDLIDNKADSINASYSRHFAWGDLDTRLYWQEVSHEMGFFSSEKPGQMPMKTRGKDMGYQIKASIPLSDVHTLRVGNEFHRQTLDDYWPPVAGSMMMGPRTFVNINDGRRDRAGIFAEVESQWNSRWSSMLGARIDHVRSTVGEVQAYSTMGMNAADHAAAQRFNGSSRSASDNHLDMTASGKYEFSDTTSLEFGYARKTRSPSLYERYSWGTGSMARNMIGWFGDVNGYIGNPDLKPEKANTISATLDWHDAEKASWQARVTPYFTYVQDYIGVERDARAGVPNNAPRTHLVFDNQDARFYGINMEGAKQLWQDTAWGQGRAKASLAWTRGERINGESLYQIMPLNARVSLEQKKGAWSNGVDVQFVDAKTRVDDVRLEPETGGYTLVDLRSSYQWSKARLDFSVTNLFDRYYALPTGGVNFAQWVADGRQASVPMGPVAGMGRSINLGLTLDF

SEQ ID NO: 14815 - protein, 853 aa, Rhodopseudomonas palustris
MQGVIMNQVQWSVLLMGIVSLLCAPRAWAETNPNQLNRTNILESGNLERTKAGDLLPVATTVDEWITQIAQASIIEIKEARINLTEAGLELTLATTGRLSTPTTSVVGNALIVDIPNAILALPDSDGLQQENPTEEIALVSVTALPDNIVRIAITGVNVPPTVEVNATDQSLVLGLSPGKGVADEEDGNDAIQVVVTGEQDEGYAVDDATTATLTDTPLRDIPQSIQVVPQQVLEDRQIIRASEALQNVSGVQRGNTVGGTSEIFNIRGFQQFGGTLRDGFKFRDNFSIPDTANLQRIEVLKGPASVLYGNLDPGGVINYITKQPLSEPFYEVAMQAGNFGLVRPTIDLSGPLNSQRTALYRLNAAYEGGGNFRDFDTEVARFFISPVVTWQISDQTDLRFEWDYLYDRRPFDRGIVAFGTGIADIPFDRVLGELDDFDARTNFSAGYRLEHRFSDNWKLRNRFRFSYLDQAAEQTELVRLDETTGNLSRQFSRNEQQIRNYELQTDLIGKFSTGPIQHTLLFGVDLSWQSAPFIFRGGVAAPTINIFNPVYGTVARPSINDFPDVFSSEGQTNTLGIFLQDQVTLTDNLKLLMGGRFDTIDQSSSSNGESDERYDQAFSPRLGIVYQPIEPVSLYASFSRSFQPNFGTRFDGSLLEPVFGTQYEVGVRGEFLDGRLIANLAAYEITVSNLAVTDPENPNFSIPSGEQRSKGVEFDIAGEILPGWNIIASYAYTDARVTKDDNLEPGNLLEGVPFNSASLWSTYEIQAGDLQGLGFGLGLFYVGERQGDLNNSFQIPSYLRTDISVFYRRNNWRAAINVNNLFNIDYIEATQRRTRVDPAAPLTVRGTISVEF

SEQ ID NO: 14816 - protein, 212 aa, Rhodopseudomonas palustris
MKKILLATVALAALAAPAAAADLAARPTYTKAPVLAPVQTWTGFYIGAFGGYANEDASTAALKGGFAGGTVGYNWQQGPLVFGLEADAAWADINATVGIPGVFGLTDRIESTGTVRGRIGYAFDTVLLYGTGGYAWGNNKLSATVGGVAGSETKFLSGWAAGAGVEWMFAPKWSLKGEYLYKSLESSTYFGGAVPLGTLNLHTFQVGVNYHF

SEQ ID NO: 14817 - protein, 256 aa, Rhodopseudomonas palustris
MKKLLVAAAGMMAVGLSAPASAADLAARPYTKAPPPIVAPIYDWTGFYIGANGGWGQSRGCVDFVTLAGTVAGGCASRSGGLVGGQIGYRWQTNQFVLGLEAQGDWADIKNTRVSLIDPLLSTTGKTDGIGLFTAQLGWAWNASLLYVKGGAAVTHNRLDVFNNLTGVGLDSASHTRWGGALGVGWEYGFAPNWSVGVEYDHLWMGNDNRTFAGAGVLSPGGVTLLGDRVSQDVDMVTVRLNYRFGGFGAPIAARY

SEQ ID NO: 14818 - protein, 355 aa, Rhodopseudomonas palustris
MAAAQSSVQLYGIVDAAVRSTSNHGKTQMVGGGMSQSRWGINIKEDLGDGLSAIANLEDRFLADTGNTAAVNYFQQAWIGMRSKDLGQLTMGRQFNVLLDVVALTYASFPYGPFMEVYKPEIGFAMGTRTNNMLKYTADLGAWRAGLQYSFDEGNTVAKKGSSVELTGGFAMRTAGGYLRYEANGLAIGGAYLNTKMPGSTEFAAYTLGGSYRSGPWYFSTGYAMNKRKNTLAVEDARLINAYWGTEINGGFLPGDSDKRQLLQLGVGYQITPQFNFGMHYYHAKQSGSSSGAFNNKANFIVAVADYAFSKRTDAYMGVDYTRVSGGPGSYIEKTAAGDLVRNRAGITIGLRHRF

SEQ ID NO: 14819 - protein, 1090 aa, Burkholderia xenovorans
MKKKHYLLFLLASLFLLTDVVWAQTSATVSGVVIDENGETLPGVSVVEVGTTNGVLTDLNGHYTLKTTSAKPSVSFSYIGYQTTTLLLNGRTKLDVQMKVETKVLDEVVVVGYGVQKKVNLTGSVTSINFADQTEGRPIMSVSSVLSGLAAGMNVTQASGQPGSDGATIRVRGNGTFNTNSPLVLVDGIEWSMDNVNPNDIESISVLKDAASTAIYGTRAANGVILITTKSGKGKPQISYSYSGVVQMPYNNLSFVSDYARYMGLVNEACDNVNTKGIFSQESIDRWRAASADPNGLNEYGVPNYVAYPNTDWFDEVFDTGYSQEHNLSVSGSSEKVKYMLSSGYLDNQGVMNRWNLDSSTQKINFRTNLEAKIVKWMTVGTRLYGQKQDYGMANISNGFKYLYQTTPGVYPGEPNYWGRAALASEESSNANNIFGQMAGATGFNTVWRLNASVYGIITPYKGLNIEGTFNYSPTFTDKSSYSRQNGYWDYVTDQRVSESALENASITNTSARTWRQSAEILVRYNTTIKKDHDLGALLGYSAQEYYSKSFAVSRKGATDWTLNELSTYETLVSSSSSSPAKWGLLSYFGRVNYGYKGRYLFEANLRADASSRFGVNQRWGYFPSFSGGWRISEESFMQGASDYLSNLKLRVSWGKTGNNSTGNYDWQANYATGNVVIDGEGTKGLVRKKLSNDKLHWESTATTDIGLDFGFFNHRLTGEIDYYNKYTSDILYHPELYLSMGVVGSAPENLGEVRNRGVEFTLNWNDRIGKDFEYRVGMNFSFNANKVMKFKGELQKYWTYDAQGNKVSYVNNFSDVSESGFGGYICEGRQLGETYMYKVYRGSGEGYTGGAVDIHAGPKDGMIRTKEDMVWVQAMIDSGYSFGGMKTVAKDQLWYGDILYADSNGDMNYGDTNDRDFSGHTSVPKFNLGFNCAFSYKNIDFSMLWSGAFGHYLNWNTDYYNSTLVSHGYGIIEHIADNHYFFDPSNPDDPRTNQWGKYPRLTYGTTYNNRIQSDWNEYKGDYFKLKNIQIGYTLPQRISSKFFVNKLRAFVSMDNILTITSYPGLDPEIGTAIGYPLMRQISFGGQITF

SEQ ID NO: 14820 - protein, 514 aa, Burkholderia xenovorans
MLHKFPISKLTLALLTLPLASLTHAAGLDRSGQDVTAFLQDGTYAEAVYTYVDADVSGVDNSGNKTGDIAEGYDFFRYGVKTDVNDRFSVGVLYDEPWGASAKYRGDNNFTGVANMTGAGAIQQIAQQAIANTENKIETVQGLQSSQNPQGLDAVVYDTALAGLNSTLDSYKELAAAPSLEKYNGIINQTNETLTNTEATLGSLGQLLSPEVLATAQQLLQSNKSDAATSENARDAVANLLSIDGATNVEVRSNNLSVIGGAKFGDNNEFQVYGGPVAQRLKADVRLKGDAYKQAAGYTAHISPDIDYGYLIGFSYSKPEIALKAALTYRSEIEHSLTVAESFPALAIVGQNPEAFSNFKVKTPDSFNFDFQTGINPTTLATAKIRYVPWSDFSIVPPLYNKASNLPLVNYSDDQWQVELGLGKRLADNLAVSGSVGWDSGAGDPTSSLGPIEGYYSVGLGAKYDLTKNWAVSAGGKYLWFGDAKGSLPSREVVSNFKDNDGYIVGVKLSYQDK

SEQ ID NO: 14821 - protein, 1881 aa, Burkholderia xenovorans
MGLKSNNKVVDQTIIPALFGCFIFSSQALALDSTWTGTISTSWGTAGNWSSGIPGLPVGVATDKATFTGTTPFTTVANNNVVRTLATLEFSAGATQYTITNLTAGGAFTLSGQGIVNNSANTQIITNTQSFTFTNLADAGTNVLFNNNAGGTLTFLGNSTATNTTIANAGALNISGLTASEISIGSLSGTAGTINLGSKKLKTGGLNTSTTVASVISGVGGVLEKEGSGTLTLTGANTYTGGTIISGGTLQIGAGGTVGSIAGNILNNAALIFNRSNALTYAGVISGTGTLTKLGAGVLTLTGNHTFSGDTTISAGTLSIGSGGTTGSIVGNIIDNSALIFNRSDNLTYAGVISGSGTLTKQGSGVLSLTGTNLYTGTTTITAGTLSIGDGGILGSVAGNITNSATLRFNRADNLSYGGVISGTGALQKQGAGTLTLSGNNTYSGTTTISGGTLLLTGNKSGAGTTTVNATTNLQIGNGGVTGLIAGNITNNGTVAFNRSDAITYVGVISGSGVLQQLGSGVLTLIGANTFTGGTTISSGTLQIGAGGTVGSIAGNILNNAALIFNRSNALTYAGVISGTGTLTKLGAGVLTLTGNHTFSGDTTISAGTLSIGSGGTTGSIVGNIIDNSALIFNRSDNLTYAGVISGSGTLTKQGSGVLSLTGTNLYTGTTTITAGTLSIGDGGILGSVAGNITNSATLRFNRADNLSYGGVISGTGALQKQGAGTLTLSGNNTYSGTTTISGGTLLLTGNKSGAGTTTVNATTNLQIGNGGVTGLIAGNITNNGTVAFNRSDAITYVGVISGSGVLQQLGSGVLTLIGANTFTGGTTISSGTLQIGAGGTVGSIAGNILNNAALIFNRSNALTYAGVISGTGTLTKLGAGVLTLTGNHTFSGDTTISAGTLSIGSGGTTGSIVGNIIDNSALIFNRSDNLTYAGVISGSGTLTKQGSGVLSLTGTNLYTGQTLFNQGTISIIQDANLGAGGALTFNGGVLQTTADLTSNRTATLNSGNGTFFTDAGTTLTYNGQITGIGQLRKNGDGTMILGSTLNNYSGGTLILDGTLQATTATLPGNVIVNSGAYLEFHQNFDGTYNGVISGAGDVIKDGSGNVTLTGIQTYSGQTTINQGGIQGTTTSINNQSVNTTAVNTALIFNQNFDGTYSGILSGLGSLLKFGTGTVTLTGANTYSGGTFIDAGAFSISSAANIGGSASPLVFFSGALITTATMILDNTTHLGLLGGTFVTNPATTLTMNGQVMGVGSLTKEGSGTLILNNASNNYTGGTIVQEGILQAGVSGGLSNHSHYTINGGQLDLNGYALSMGLLTGLGGTVDVTATSLILEQSLDSTYAGSFLGDTTAIIEKNGSGQLTLTGNSSSYQGAMNIDQGTLVMNGQMNGHLNIGNSGTLKGVGAVNDLSVYGTIAPGNSIGTLTVNGNYIQNPGSFYELEFNPSGNTDLISVLGTATINGGTVRLLPDQPPYTPGTKYTILEAQGGVSGTYSDLTNPNLPYLFFDLSYDANHVYLEVFRSGIDFSALAITPNQIATANAIETIRPSNPLYIAIVNLDTAEEAQSAFNLLSGEIHASIIGSVVEESRYLRDAIFQHLTDENPNNNDGVWLRTYNAKTTRDTDNNAATLDGNSSGFFIGVDKKITSNVKIGSVFGYGTRQDSVPHRLSNANLQQFDFTLYSEYVHQQLYLRYGYGHFWYSASTHRTVELPTLVNYLRSDYSLYSNQFFAEMGLKGLYKNTPVDPVAQVAFIEAGNNQFNERGGISALSGSANHMKTPITTLGFRSKTTLFNSDKLDVNSNGMLGWQHAYSDTVPGSIMGFASSANFLIGGTPIAKDSALVNTGLEFKNPQYDSLKMNLFYQGVFADNVSNNSILVSLNWGFN

SEQ ID NO: 14822 - protein, 357 aa, Burkholderia xenovorans
MNRLGATTWPIAIGLALAGPAFAQSSVALYGIVDQSVRYTTHASAANDSAVQMANGAITNSRWGMKGAEDLGDGLKAIFRLENGFEPQSGQADGARLFGRYAYVGLSGRLGTVELGRQTTEGFNLFGDLDPLTIGNYTANMWPYFLTQGYANNVVSYANTLGGLAVGASYGLGGVAGAMSRNAYWGVRSAYTHGALTVGAVYQQTRDADGRAQQMWGAAGRYAVGPATLFAGYLGGKDATGAIDRDYLNAPGRTVAYGSFADHPRYDAIGYAGVAYRVDPALMLTGAFYYDAIRNVNGVGGNGGKRRAGVLEAEYALSKATQLYASADYNQVCGGAATEMPGRGNQTGVALGLRHMF

SEQ ID NO: 14823 - protein, 1121 aa, Burkholderia xenovorans
MKKSIFLSFIIVFNGYALSDQELIGSKEAYKLTITGDGINVGVIDSAINGEHPSLKGKVLEQTFSTVNGKTYTPDYSVDTHGSHVAGIIGAKYIDENKPHGVAYNAKLYGVQIFGNNKGSGSFNAPNVYDYFKDKDVKIINNSWNSTTYPVVSMTQTGLYLDAYKNKSSNELFEQIQQNSTAKQLNQLTKENKTLVVFAAGNEGIISPGIMALSPLYNEELRSFLAVGSVDSSQITKNQDGKLVVNGRGLSGFSNGLLGAENFSLVAPGSNIKNVNAAYMQKSSFGRVDKDLYRTQSGTSMAAPMVSGAAALVAQRFPFLNGKQIADVLLSTANKDYIAPKLTVKETKLKVVEYLGKRPILMEKTFHTIFYIDTDIPKKADGSVDKEQVKRDLSQAGYSRFYTPITEYHGVDESKYASIQKVSKESLFGQGILDVTKAMKGLATLDANRLNNSDVSNTYAGQNEAYYTIDTQGYEAIFSNNISQKKWDGSLHKKDAINLPTNLANLNVGFIKEGSGKLILTGNNSYEGVTIIKKGSLALNNKSENEKARIAGNVKVLEGGLFSGNGEVGKNLENKGIVRPGNEDLSDLIIEGKYTQEGQNSKLQLDFGSHKNSKLIANSYEIKGGKLEYIPLPNFFTSGHYVSIDLGDLGTCLSSFGAVEVVSNNAVDFVAVLDSDKTSINKDKMPQPAPQPQPTPQPDITNPQPPVTQPSPITPPPTTTPPTTTPPPNHIIVKPVIKKDAYESANSTMGRSLRSIRSMHNLQDRYKDYFAFLDNTDTKTMEKTLESLEANSYMQSASGLYYQQHILAQRNIMNALNPSFTSGNLMASLEKDPLLTASIESDVFMDLGLLDKMDKRYIWNLSPNYKKINGDNFDGRSTGLNLTIGGELNENSLLSFGLDVSDTRLDFENANLKNKYFNFSFNHILDLQNFKILSSASLARASNDMTRTIIGQNGSLSSNYDNLLSSLQLGLAKDFQVFNNLTLTPLAYFNYNFIKQDAFSENGNLVFAKSYDAINHHTTSLAGGLNLSYLFDREAMQTKLGSFFIYEYKLSGKTIENNVRFKDFPNQDFVQYHRLNSNLITWGLTSYFIYPNSFFYGFNVVNEFASDQYNINVLGQFGFYF

SEQ ID NO: 14824 - protein, 784 aa, Burkholderia xenovorans
MVHSNLVVRLMATACIAGWMIPAMAQPMDQDRAATAETDGLGDIVVTAQKREERLQDVPIAISAIGADFLRSRDIGSIDQIGTIAPNVKVERSPTNKTVSQIAMRGSVTVNPSVLFEPAVGLYVDGVYIAKAQGSIFDIADLERVEVLRGPQGTLYGRNTLAGAINLVTRKPSGELRGSIEASYGNYDMKRVKGTIDLPAFGIFSIKLSGQAQKRDGFIDVVPNPYPQAFLARPSSVDDTNDLNQRSLFAQVRVRPADSLTIDYAYDYSRYRQRPDFAQLHSFNRNGLPQDIFDPNSPGYAGAGAFFPLDLYVRAQRQSSASLDADQLYERLRTDGHSLTLAWDLGTAELKSISAHRRTRWSDALDLDGSPLPVGATQRFTRYRSFSQELQLTGGLADGRLKYVVGGYYFRDKGETLGPQSFFAGATSFQADYGQHTRAAAAYAQVDFDLTDRLVLTGGIRYNHERKDVSRLLVSGPGTPAELTLIDIGYGDVPDAVYNSFSPAASLRFDLTERVNVYARYARGFKSGGFNGETTELVAATTACPSGAIELCQPYRPEKVDSYEVGLKSRLLDNRLQLNIAAFWDEHRDIQLSVFRGSGALSLSVLNAASSRIRGVELEFTARPSSAFTVSGSFALLDAKYKRFIDGGVDVSDNRAFPHAPRYTASVSTDWRVIEGDWGRLNLLADLNFVDSYYTYPYALAAPPSTTQVAGNSEAPSRAIVNARAILADLPIGGMKGEISLWARNLFQQRSPSNFIDFGPSFGGMTLAFYPDPRTFGATFGLRF

SEQ ID NO: 14825 - protein, 705 aa, Burkholderia xenovorans
MKRIYLTFVFAGAVCFQVAAQNADEDRILSADSLITMDGRLDSLYRSLPEVMVVGERPVVKAMQGKLVYDLPRLIQNFAVDNAYDAIKELPGVSEMNDNLTLGGKSVTVVLDGKVTTMTQEQLNTLLKSIPAGRIEKAEVMYSAPARYQVRGAMINICLKQGDSGKSTLQGEFFSDYRQKHYEYLTERASLLYSGHKFSADFLYSYSHGRNYFLTDKEALHALSDGTIHPISTNESQRSRSNRHNLRLAGDYVFAANHQLSVTYNAQFVNGFNLSTVDGTQISNARTRMTDQLHNARLDYHMPFGWKAGVEYTYYHSPSSQLLHSRMGSDELDFRVKDSQRINRWKLFLSGEHDLGNGWGMNYGAVYTTSLDNSHQYYHDPETDEIISGNSNMKSRRREQTLNFYAGFNKAFGDKLSLDASLAAEQFHTTVWNEWSLYPTFNINYAPAPGNVWQLSLSSDKSYPDYWATQDAVSYMGGGYSEIHGNPYLKPEINYQLQLTYVLNSKYMFNAWYSHTKDNATQTLYQSPERLVEIYKYFNFDFEQQAGVQAVVPFAIGRWLKSRFTLTGVYDRQKDSDFWDIPFDRKAYYAMLNMNHTVTLFSHPDIKLIVSGMIRSKAIQGIYDLPASGNLDIALRYGFANGKALLTLRCNDLFETGQISPRIYYAMQNVTNHYSAFREFGVSFTYKFGGYKEKKREGVDTSRFK

SEQ ID NO: 14826 - protein, 684 aa, Burkholderia xenovorans
MKLSYLSLAIASLLSGQVLSGQVLAAEVQELAVTEVKATKTKQNTVTSEKLDNRQVNDIKGALSELAGVSVSNGVRYSQKTYLRGMEEHSANVTIDGARQDGQMFHHAGNQMVDPSMLKAVSVELGASSVLSGYGANVGAISYVTKDPKDLLALDQKFGFKVATAADTATEFQQVSASGYGRLTDQLSLLGMMSWNESGDIETPDRKPIVNKHSELKSGLVKAVYDVDDNQQLAVSLQRFEDAGHRALSGEKPGATSVEEALGFNGYERDTYTVNYRNDSANPLLDLAVDAYYNQKKMVRGEQTGDFEIRDNAGKWQKQGIEFIPERDYSYKTLGLNIRNTMDINDIPWTVGIETFKSEQAIDAATGLITRNDGTKTTVVRAVNNGPEARLIGGYIQGEFNLGALQIIPGVRFDSYKLGGAYDNSFSQLSPKLNLFWQASETLGLKAGYGRIFKGPGLPETLMISSDMTASPDAKAETGNNLEFGVSYDFAPLVNLDSANIYANIYQYNIDNYYHPTKNNSLVRGISDLTKKGIEAGMTVQHQDLKAYVNYSYNTGEKAFDDYTTDDYYSGTHLVKLGLDYQLTDEMTLGWDSIFASSASLDDRSVANGAVITEPVEKAGYGVSNIWASYDVEQLNGLSLKLAVDNLFDKAYQDHNSFGMYWGNAGYNDNEVGRNFKFAVSYQY

SEQ ID NO: 14827 - protein, 776 aa, Burkholderia xenovorans
MKLVTRMENFFMKNSKVFYRSALATAIVMALSAPAFATDSTVSTDPVTLNTEKTTLDQDVVINGDNKITAVTIETSDSDKDLNVTFGGHDITAASTVNQDFVEGVKVSGNKNVVINATDSTITAQGEGTYVRTAMVIDSTGDVVVNGGNFVAKNEKGSATGISLEATTGNNLTLNGTTINAQGNKSYSNGSTAIFAQKGNLLQGFDGDATDNITLADSNIINGGIETIVTAGNKTGIHTVNLNIKDGSVIGAANNKQTIYASASAQGAGSATQNLNLSVADSTIYSDVLALSESENSASTTTNVNMNVARSYWEGNAYTFNSGDKAGSDLDINLSDSSVWKGKVSGAGDASVSLQNGSVWNVTGSSTVDALAVKDSTVNITKATVNTGTFASQNGTLIVDASSENTLDISGKASGDLRVYSAGSLDLINEQTAFISTGKDSTLKATGTTEGGLYQYDLTQGADGNFYFVKNTHKASNASSVIQAMAAAPANVANLQADTLSARQDAVRLSENDKGGVWIQYFGGKQKHTTAGNASYDLDVNGVMLGGDTRFMTEDGSWLAGVAMSSAKGDMTTMQSKGDTEGYSFHAYLSRQYNNGIFIDTAAQFGHYSNTADVRLMNGGGTIKADFNTNGFGAMVKGGYTWKDGNGLFIQPYAKLSALTLEGVDYQLNGVDVHSDSYNSVLGEAGTRVGYDFAVGNATVKPYLNLAALNEFSDGNKVRLGDESVNASIDGAAFRVGAGVQADITKNMGAYASLDYTKGDDIENPLQGVVGINVTW

SEQ ID NO: 14828 - protein, 213 aa, Burkholderia xenovorans
MKKSYLSGLIAASLLSVVSASAFAHQAGDIIVRAGAVVVAPNESSPVVADVAEFGVSNNTQLGLNFGYMLTDNWAIELLAATPFTHDVSLGVLGKIAETKHLPPTLVAQYYFGNANSAFRPYVGVGVNYTNFFDTEFTNDLDGALTDLSLSTSVGWAAQVGFDYSFNKNWMLNASVWYADISTDVKFNLGDTPVVVETDIDPWVYMVSVGYKF

SEQ ID NO: 14829 - protein, 754 aa, Burkholderia xenovorans
MKKFLNAIIVLIAFHSSYSIAQEVEETVVITSAFIDTAEINNPLYIIDGEDFAESATTSLGDFIDEYLGVSIADYGAAVGQPIIRGMSGPRVKILKNGMVNRDVSGLGVDHLNDLDLNDIQQLEIVKGPSSLLYANGTIGGIINVVDDCISALNYELPELKVGYETQSVNDGNSEFINFKSMVGGFNVNFGYKNTEFGNYDIPNGAIMHEEEHHDEDDHDEDHHDEDMHEENLGYLNNSDYAVEATKFGISKVGDWGYVGFSVDNLESVYGIPFHGDEHGDEHGDEHGDEHDDDHEDEHGDEHGGEHGEERIFSTTDSESFTIKGSYNVNGNLVNKIDFTYRDSDYTLTEAHEEEHGEHGEEHDDDHGDEHGDEHAPTVFSNQAVEYTAIFDISNANSTQKVVVNIVDEDNSIVGEEAFMNPANSEEFTIGYYLSKDLGLNSLDLGMRLDQIERSGSVTDEDHGDVDYYNIDDSTNSFAVTLGRDLSDTLNVSLGYASVERLPSAIELFMNGPHMATGRFEVGNPNLNSETSNNFDVTFNFDNGDFYGYASFYVTDIDNYIALIDEEDDHHDEDEHHEDEDEHHDEDEHHDEDGHDDHGHGNLIHANYMQEDAEFDGYEIEFGKDFSLGSGELSLSFGRDVVNAKFSDGHYVPRINPARNIYSLSYKQEDLTFKLVLKDVEKQNDFGEGETATDSYQMLNTRLTKSFSMGNSDLKVTLFANNLLDEVARNHASFVKEEVPLPGRNYGLKFNFDF

SEQ ID NO: 14830 - protein, 450 aa, Burkholderia xenovorans
MTQRSIGIVPAAATIAGVLIIGATAAQAAGFAIREQSSAAQGTSFAGVSAGGDNVSSIFYNPATLTLYDGINMSGQFSWIIPDVEFGESSASTITGAPITGGNSGNIGPQALVPAFYASWQVSPDWFLGLAVTAPFGLVTSADSGWIGRYHGLGSRLRTYNVEPMVAWKANEWLSIGGGVQVQYSDARLTSAIDLGTIGTSQGLPGGNPGDPSQDGFAAVEGDDWSYGYSLGVLLTPRPDTRIGIGYRSSMDVDLEGDAEFALSTYGELLSLLSGALTPTGGSASITLPEMVTLGVKHDITPTWTLGAEVAWTRWSRFDELVVEFDNPAQPDELTRENWEDSYFLALGATYKAREDLRLRAGVAFDEGVVPSSDFRTPRIPDADRYWFSVGAGYDLTESMTIDTAYTHIYSPKANVRLDATDPGHEGRGDLNGTFTSSADILTASLSMKF

SEQ ID NO: 14831 - protein, 697 aa, Burkholderia xenovorans
MIRIPLIAARTLFTLPGLCAAALVGPAYPALAQSSEQAASRLEQVIVSASREPETGLNLALPWARIDEEALELTGAVHINQIMQRAPGAWISRGNGQESLIALRSPVLTGSGGCGAFYTAWDGISLRAPGFCNVNQLFDVNSEQAGAIEVIRGPGTAVYGANAVHGVINTLTADPRRGPENAYAIEAGPDDYYRVRGEFRARHGDHAVGAYFNGVSDGGYKDNAGFDQQKLTLRHDFSGEQWKVTNALETTNLNQETSGFVAGFEAYKDPDLKKVNPNPEAYRDSFALRAYSRWERDTRLGQLDITPYFRRTTMEFLQHFLPWQATEKNGQESLGLRVALSDGNERFRWSTGVDIDATRGWLREVQDDDFSPNQPAGIHYDYEVDALSAALYAQGDWQLTSRWGLAAGLRLEQNSYDYNNQTEDGSACAPEASACRFFRPADREDDFNNGSVNLGLTYALSDSHRVYLRGAQGFRPPQAAELYRLQSGQEVADLDSETITSVDLGMRGNFGALSYDASLYAMRKEDVIFQNADRQNVSGAKTRHEGLEFSLYWTGESGWYAGVDGNVARHRYDSAANLLGSRLDIEGNDIDTAPRHFGSARFGRDLTINNRDVRAELEWVHMGSYYLEPDNQHEYEGHELLNLRVALDLNKDFSTTLRVTNLLDEDYAERADFGFGSYRYFVGQPRGVFLEFAYRPQ

SEQ ID NO: 14832 - protein, 923 aa, Burkholderia xenovorans
MTSFQTPFKRNIMSASVIAAVSMGAQAQTTQPNEIILEDVIVTGIRASLTGAMDIKRNATGVVDAISAEDIGKFPDTNLAESLQRITGVAIDRSNNEGNQVTVRGFGPSFNLVMLNGRQMPNSSALSSTAVSRSFNFREIAAESVSRVEVYKTGKAHVPSGGLGATINLQTAKPFDFDGFTLLGSTKGIIESNASGGNNVTPEVSGMVSQIFGDDSFGILASFSHAQRDFHVDRIGTANGWSQSYPAQSNPDTSAINTNLNPSLTTWRVATVDLDNADYERTRQNGQIVLQYFPDDDFSASVDYTMSRFEENGQMNRMSFWFDDVETGKADANGTIINPARSNDELNFWAWEYGFTTENDSFGLNIDWAATETIKLVLDAHSSKSHSNPGAQPAERIANLKNPFGDAAPVHISADFSGKLPTVAYDDSALVGGAYSRENIEADLYQERGNEVENTVDQIQFSGEWVNPNESVLRQINFGFASITNSVDTLSIHSSNFSLGNGAVDISDLDLTFSPGDIGYEFVPNYSANQFLNLVEEQGLKNPATLDENGIEESISALYLSLDLETDIRDMLLRTNIGVRYETTTVNTYSKGKPVIGFNWVSPLELAKIVADEAVTRTADADYNHVLPNLDISLDIVEDVIARLSYSTTIARSNIDAMYPNVTYYSHQPNGPFTASQGNAALLPFDSANLDFSLEWYYADGSYISGGYFSKNVDNFLAAGQELQTIIGPEGPLTNPSANPRPGCPAGSVSEPVEACTSQPSDPEIIWGIATPKNTDESLVDGWELNVQHMFGQSGFGAILNYTTVDSNDRYDVYAIENGLALQGLSDTANLVAFYEKNGLQLRVAYNWRDKFLLASGPEPTFTAAYSQVDFNASYDINENLTVFIEGLNLTDEATHRYGRWENQLKDYEQYGQRYALGIRAKL

SEQ ID NO: 14833 - protein, 186 aa, Burkholderia xenovorans
MKKAAVALLAGFVALSSSVSSAFAAKPYLSGRFAVSMLSDSEITPLSYDTGYMLAGAVGLDNGPYRIEAELGRQNSGVSKSLRSLVMTTYMGNLSFDLDLPVAPLKPFISAGVGLANVKEDDGIGGNVDDMVFAWQIGAGAGFDVAPLVTLEVQYRYLVANDPELAEHKKYTIDNHNVLLGLRAGF

SEQ ID NO: 14834 - protein, 757 aa, Burkholderia xenovorans
MNKICKFSIICTALLSLSNAAQNESEDLTFDTLEVSAKSVSNAEKSFATPGAVSSRDDVKSKTQSIDSIVRAMPGSYTQVDQSQGSVSVNIRGLTGLGRVNTMVDGVTQTYFGTSSDSGGFHNFTGNLGTSAFGALIDQNFLVGIDIERGTFSGPNTGLMGSANFRTIGVDDVITEGKPFGFLGRYSYGSNKVGPSYMGAIAARHRFENGTSLGFVFGYSGKKTSQNYTVGGGGKISDKQPDLDGDGVPDVPPSLDTDDLVQKPKSYLFKTEYAHEDSSAILSYRNLNNYLAKRKINNDSYQLNYRYDPSSDLVDVKFLAAYNRSKQNYDKGASISWGTLKNGMKFYNKSSQFDLSDTMKFNPASELFITTSAGINLLTNKYTKQTGDSDYKTLTTNYAVPTGEQKAVSYYLNNAFSYDIFEFDANFNLQKWQTKGRKGKCALSNPLCSQKEAGEFKTDDTYLNASLMASAKLHDLFSPFVSYSRTSRPLNVQELFASGTVYEDINTALRPEKTQTWQIGFNSYKHGLFADDDVFGLKAVYYRSKVKDFIYDRLLMFDTPDTTMFLARLNDKAKFRGFELELTYDIGYFYTNLSYTRQKTTYLPSDSSALDWTNGPASGQSQFSELPKDYATLDIGTRLFGEKLTFGSLIKYTGKAKRIYPKAEFTPSPNNQNPLFKKLQTQELPKIPTVIDLYASYEPIKNLTLKFEVQNLTDKNYMDALYTYNSSYSSQVFNDDIVLFNNSARGRTFLMSFEYRY

SEQ ID NO: 14835 - protein, 381 aa, Burkholderia xenovorans
MRKQAFALAALAAASVTAHAQSSVTLYGVIDGSIEYVNRVASSAATPNQGGSRFGMPSVGGLSASRWGLRGVEDLGGGNQALFVLESGFQWDTGALQSAPLFNRQSYLGIQNATVGKFSFGRQYTSFFDGMANFAPLRFAATYEPGIWWMGLNYREDNMVKYTGQFGPFQAVAHFSFGTGVAVQNATILLANGGAGEVPGHFSDNTGYGGSLMYLSNGLGFSLAADEWRPAAVTGQPGKMTKLGAAALYNTGPLKFTAGYRYNKGEFSNGGTLLRDDYWWAGVNYQATPALGLSLAYYFANVKQASAAANTPTSNPPNMHQVSFIADYNFSKRTDVYLSAGWAHNGGLSFDGAATAYAFKYPTMTGQQNMIGVTVGIRQIF

SEQ ID NO: 14836 - protein, 823 aa, Burkholderia xenovorans
MKPIRYLFFFGFLLFANFIIAQTGTVRGIILDANNQPIDAVNIKTSVGTGTQTNKNGFFKIVVPANENVTLTMTHIAHKRIQFTVKLKNGEDYEIFPIMSTTTEQIDIVVIESGKRKAVEGIQTVSAETVRLIPGANPGVENLLMSFPGINNNNELSTQYSVRGGNYDENLVYVNEIEVYRPFLIRSGQQEGLSFVNTDLVQNVDFSAGGFQAKFGDKLSSVLDITYKRPVRFGGRVNLSLLGGSASIETSSKDSKFSTISGIRFRDNSLLVNSKQTETNFRPRFVDFQTYVTYKFSDKFHLNFLGNVAFNDYDYEPLTRQTNFGTLQDPIALLVFYEGQEEDRYRTYFGALKANYFLNDDVTLKFIASAYHTTEQEHFDIFAQYRLGEVNTNIGDQDLGNVEFSEGIGSQLNHGRNDLDALIFNVEHKGTYEIEGDDNQIDWGIKYTHEDIRDRLIEWEVIDSAGFSIRPPLPQFSNNQPYDAFEGPLEPFQSVRARNNTQIDRVSGFAQWSKQSMLGEHEIYTNIGVRAHSWTINGDGIESKTQAVVSPRAQFAIKPNWKQDMLFRLSGGFYHQPPFYRELRGFDGVVNPNVKAQQSIHVVLGNDYSFKLWDRPFKLTSEAYYKNLSDVNAYTLENVRIRYRADNVAKAYAYGFDMRLNGEFVPGTESWVSFGYLKTEENINNRGYISRPTDQRLKFAVLFQDYMRKIPNLKLYLNLTYNTGLPGGSPSYADPYLFQSKLPDYKRADVGFSYVLVDKDKQFDSGWLSAFKELNVGFEIFNVFDVQNSITNTWVRDVYTKRQFGIPNFLTGRVFNVKMGMRF

SEQ ID NO: 14837 - protein, 352 aa, Burkholderia xenovorans
MEMKKSTLAIAVSIIASASVHAAEVYNKNDNKLDVYGKVKAMHYMSDYGSKDGDQSYVRFGFKGETQINDQLTGYGRWEAEFAGNKAESDSSQQKTRLAFAGLKLKDIGSFDYGRNLGVLYDVEAWTDMFPEFGGDSSAQTDNFMTKRASGLATYRNTDFFGIVDGLDLTLQYQGKNEDRDMKKQNGDGFGASLSYDFGGSDFAVSGAYTHSDRTNEQNQQRRGIGDKAEAWATGLKYDANDIYIATFYAETRNMTPVSGGFANKTQNFEAVIQYQFDFGLRPSLGYVLSKGKDIEGVGSEDLVNYIDVGATYYFNKNMSAFVDYKINQLDSDNTLGINDDDIVAVGLTYQF

SEQ ID NO: 14838 - protein, 356 aa, Burkholderia xenovorans
MKSRTWTMCAALLGAAASTSSFAQSSVTLYGDLDAALLYTNRSLDSATGGNAGRQFALTDTGMTPTNFGITGTEDLGGGLHARFKLESGFNITDGAFGHSNGNFFGRQAWVGIDGGFGETKVGLQFSPFVLAILGSDPRNVSHFGAALVPYVDNVLVTGLFNPNAISYTSPTIAGLTASAMFGFGGKAGDFQAGRQYSGSLTYTNGGFMLNAALYDGNGGTSPTPVASTVAFVGRTIGTAYTFGPVTGKASFTSYKVAGSFSNNVYSAGLDYRVTPALDLNTGAWYTTDRNDSHNHSLLAAIGADYSLSKRTGLYAQVGVVNNHGAMNTGLGITGGALYGLPGTTVGVNAGIHHVF

SEQ ID NO: 14839 - protein, 952 aa, Burkholderia xenovorans
MKSQLNLKKALITALFVIIGSAVFAQTGKISGKVSDKKTGETLIGVTVKIKGTSKGTSTDVEGGYVIGALTPGKYTIEASYVGYASKNITDIDVKANKATVVDLVLEESTGQKLNEVVIQGSFKQESVNALYAQQKNSAAISDGISSEIIKRSPDRNTGEVLKRVSGASVQDNKFVIVRGLSDRYNTALLNNSPLPSSEADRKAFSFDVIPSNLIDNVVINKTATPDLPGDFSGGAVQIKTKDFPNTKTLELSYGVGYNSISTFSDFYGQKKSGLEFLGFGSSSRDLPSNFPSSRERFVNSSLSERVNYSKGFENNWGVSNLGKALPTQNLQLIFGNSYQLKNDGKFGLIVSATYRNSYAISKEKRNDYNEVDFSTGRGTSLFEYNDEYFNYNSSLAALANFSYIKGNTKISLKNIFNQSFEDNYLRRSGIYDLAAAQQVSQMEVNEKSLINTVLEGDHVISNKSKAKLNWNLAYTSMTNDQPDLRRIIYAKALADIDNDNVPYEAGVPRGATSSSAGRFYSDLNEHIYSGALNYSLPFNWLDKSQLFKIGFVKQYKERGVKARVLGYINNVSDNSLFTLPQDQIFAPENIAADRFYIDDITNPQNQYDGTADLNAGYLMMNNVFFNKLKATYGLRVENYIEKLDTRDNSGPVNIDNNYLDFLPSLNLTYELTEKTNLRLSYSNTVARAQFRELAPFTFYDFVTGTVKVGNPDLKRTSINNVDLRYEFYPAAGQLLSVSAFYKKLSNAIENGILSGSTAASKSLTYINAPDANIAGVELEVRHNLSFLNQSSDLFKAFTISGNLALIKSEVSFGSNEITIKDKRPLQGQSPYIINTSLQYASEKSGWQGSVLFNRTGRRLAIVGFGRYTEGSFKADYPDVYEAPRNILDFQVSKKLIKNKAELKLNVSNILDSDANFYQDLDDNKKYAFSQDQLINSVAYGRTFSLSFGYKF

SEQ ID NO: 14840 - protein, 779 aa, Burkholderia xenovorans
MKYRIVVLTAILFTACNLLHAQVQTGKLSGVIIDANNEETLVGANIYVESLKKGTSTDKNGEFSIEVPAGHYRIVISYMGYRTRQEEVRISELKTKKLVIRLEPETQSLGEVVVTAKSEARQLREQAMPMSVISMQQLQGTVSNVQDVLSKTVGVTIRNTGGVGSSSRVSVRGLEGKRIGFFIDGSPMNDNSDFIDINDIPVDMIDRIEIYKGVVPARFGGSSVGGAVNIVIREYPPKYLDASYSIESFNTHKLSLVTKRNIATKGLEFGGGGFYTYSDNNYKMESPFEEGLIIKRNHDKFKKLAVAGSLKARKWWFDLVEFEPVFIHTFKEIQGIEYNIEKAHTYSDAFIFANKLEKENFLTEGLDMESNLAYAYTVFHMVDTAAYRYNWDGTTYPAVSEYGGEIGKWASNARNEKHTITHKLHLNYVINNNHSINLNSLFSFASGHPKDDLKNKVVGYKTNFRSTMASWIAGLGYDFRTDNDIFLNSLNVKYYMYGMNTHMSSIMSSEAEKVDMLKRDFGISNALRYRFTPDFMGKLSVGYDVRLPAESELLGDGYTVAPSGNLLPERNTSVNLGFLLDRTGKDASNLQVEVNTFYGYLENMIRFTGGYLQSQYQNFGKMRTLGVEVEVKADLTHWLYGYCNMTYQDLRDVRKFEPNTHITNPTKGSRMPNIPYLLANAGLEYHKENLFGGKGQNTRIFTDGSFVEEYFYDFEQSRFQERRIPRTFSANIGIEHSFMNGRFIISARMNNLTDARMMSEFNRPLPGRNWGVRLRYVLK

SEQ ID NO: 14841 - protein, 122 aa, Burkholderia xenovorans
MPALDQWANDYNLFADQVGDLGNLWEGSGLPGRLDNVIYYSTPEFSGFNIAATYKSEEGVDNSSDEIIKGNYVNDNLKVGLAYASIGQGGMSSNDHIAVAFTLGDDFGDFTLGGGYQNESDI

SEQ ID NO: 14842 - protein, 311 aa, Burkholderia xenovorans
MKSTALFYGALCVSSFASVVNAASIYADEGTSLAIGGRVEARAEHRDSDISDLSRARVNISGETLIGDGISGIGYFEQEFKASENKTRYLYAGIKAALGEGEAQVVYGKTAGAMSLVTDMTDIQAAYGAIAADKFKVGKRIANSIATFYTNDSGTSLGINYSGKHAIKQDTFKQGFSVGASQAIGDTGLTLATGYADQTMIKKGKEKEKSQFDVGMGYQIKQFYLGALYTNQKLGGKDADGYDVVAAYKINSIYKATLGFGELHVEGGDDTRAVNGDITAKWNKHFRTYAAVNYDTVIDNTQAMLGARYDF

SEQ ID NO: 14843 - protein, 234 aa, Burkholderia xenovorans
MKIRLACLAALSMLAVAAHAQTSVVRYGIADAGVEYTAGAAATGTGSRYVMREYAAALSDSRWGLHHGSEPGIGLKAFMAVENGSYPDVGSTNLANRASIGAAYSLGPARAIAGYRWSYDSFNTVGLRTNLYWLGVQYQVTSAIQVGGAAYYNDAQSGAGDPYSFMLTGSYAYSKRTDVFTTLGFARSRNSPAMGLTGFGPSLNPYATALSGPTEQIGARDNQFGAVIGLRHRF

SEQ ID NO: 14844 - protein, 204 aa, Burkholderia xenovorans
MSCAWQQEKFLCQFDGIPAYMEQAWSYGASALDVALYDRVDVVRGATGLLTGSGNPSASINLVRKHAVSRDFTGTVSVGGGDFNKTRGVADVTVPLRPEGTARARVVGVYRDGESDMERYSLRKKIGSAIVDFSTREVIGIGHRHLARDVCVFCVPDSERIAAIAQEVRRLFFCANTASRVHAVFALRQRAVSTEQPPCGTVVI

SEQ ID NO: 14845 - protein, 799 aa, Burkholderia xenovorans
MKSYLARKAVINGAMLAAVLSGPAAFADETDTERQMRLNEIVVTAAGFEQKLVDAPASISIVTVEELKERPYMTLIDAVRDLEGVDVGETSDKTGQRTISMRGMGSDYTLVLINGKRQNNHGDIYPNNFGGNQFNHIPPLDTIEQIEVIRGPASTLYGSDALGGVINIITKKVADRWTGSGTISRSIQEDSAFGDDTTVDLFASGPLVPGKLNLSGRGSWYKRDASNPAYEPVTDPDGNIVNRSLGFGGGGKTVDNTNISYGFTLAWVPTANQTITFDYDGSKQDYDNKIKINDEGEEEYPVGTVDNINSIFTAGNYCLGAAGRNEEACLEGGGTWARRANPRVGYSPTQEFTRDSWSLTHDGEWGFGNSFVSLAYFATNNNGRTLPFSVAERELLLEIVDGTGEYAGLTEDERRNIAETTFLPRPKRTLESAQYTLDAKLDMPFEFAGKHTVVVGGQVIQGELTDGVFGLEDGTAGEAQEHNMFSLFAEDTWEIVEPFSLTGGVRYDNHDVFGDQVSPRIYGVYTISPSLTLKGGVSTGFKTPKTTQLYDGVVGFGGQGTSPFFGNPDLEPETSTSAEIAVYWQHSNGHNFNATVFRNEFSDKIASQPCGIGLELSCSSTGEYADLGYATSSKTVNIDEVVIEGAELAGRYEILDNLSFRANYTYTDSEQKSGAQAGQPLNNTAKHMANATLDWSITDRFSTQLSVEARSKRYRGVSSTTGDHLYYKDYELFNLGAQYRVNDFVTLSGRVNNLLDEDFTSYQYEFLDNGDGTYELSTQDNYNIKDKARSFWVSMNVRF

SEQ ID NO: 14846 - protein, 502 aa, Burkholderia xenovorans
MPLTSYRGPAVSSIRIVRSRRFLLASAALTSFTVADLPAALAQQVREPLPPVEVSPAQSRKPAKPAARDAQSARRAAARRPVVASAAPKPAVPAAGAPTPLNSNAVAESASRLGLTVRETPATVEVISAETMREQGYRTVSEVAQGAVGVTSGDAPGEPAGFSMRGFTNSQINTLYNGIKIGPQNMTSRIMDTANLEAVEFLKGPASLISGEGAAGGSINLVTKQPHTGAIRNEADFSYDSLNSFRAHYGSGGSTNVQGLDYRFDISRSSLNGFVDDTNTKTLDVSGQLNYRISDSLKVWGAIEYREDRGKAYWGAPLVPIAFSGSHATTGIVSGTYFNRTDLGAVTIDDRTFNTNYNVLDNRNVAQEVWLRGGFELKLAPDLTLKSQAYGYGAERSWFNNEIEAFDSTKNQVYRERFYVAHSQRLVGNITDLIWDTNIAGFDNRLVTTLSSSYLTSSGQARRNSRTTMFRWSISIVAITDCSRPSSRPRASTTRRCRSRTG

SEQ ID NO: 14847 - protein, 454 aa, Burkholderia xenovorans
MMPSTKTKRLPLIAVICGTALLSPSLTIAGAGDGASNYGLGPMNVGSALAFSPFTSNSWSVYYNPAAMARSEEGELSIVAQYGDQELRGKSLGGSAPLDRENDVLSDSSSELLLIGFKSRIAGISSTKRPIYFGLNVGTDEYTSNLLPYQANTSQEGQFLRYESQPLYLAFGGAVSNIIRGVDVGASARLTLEAKAKLETVSDLGGNTDSENLSLEASPSLSPALGINIRSGEMFCGSSECMPFGMDKLEVALFWRDESSYEVSVDANVVVPGVIPEPGLSLALSTIDTYQPEVLGAALLLPVGKFELTAGIEQHKWSALEREFASDTIRDQANLAFDDITIPRIGVSYQWSESMKLFAGAALEDSPLKSNRSQDVNYLDTDKKIFGLGASYRLANAPVLHMPLELAFAYQYQMLDEADFELTSINSPSNPNSYETLRADGEIQVFSSSLSLKF

SEQ ID NO: 14848 - protein, 889 aa, Burkholderia xenovorans
MRRDIMKYSTTLLPSAIAMSLAFAAQAQDSAGAQATDLDAVQVVGIRASLEKSLDTKRNNTGISEAITAEDIGKFPSTNVAEALSQIPGVTLDRRFGQGERVSIDGTDPSLNLSFLDRHPLAQAIWLYGEQPSRGFDYTLLAPQILGRAEILKSSEARLTEGSLGGTVLMHTRQPLDLKVNEVAASIGYSDSDQASQDKPNAALLYSWKNAAETFGIAVSAQHYEERVDRRGMEVFGYVPARTFANAAGGVPADADVPNSINAAWFQQDRERDSAVVNLQLTPSDALEFNLSGLYINENFDNYNQSMYSFLTWNPGTVAAVDQLGGVRNGVVTSGHSSANANANANASPLGGTVIYDNNVRESEVTTKGLDLRGAFRGDVWGLNGQVGQSKSENTDLSQYFIEPFYNGGFSWDTRRGIRFDDPAAARDPANWGSAGGWFGNNGIFSTESKDTYGQLDFNLQFDGVFNQLLFGVRHGKHDERFELNVYGGVTPGKLADVGTIGLTDLQDFYPDHGQHVQAGRNNVLNWIRNSPIDDNAPDPASYLNNSWALEQTNNAAYAQLNFSGGGLRGNLGVRYVDSKTEGSGFVYSGTPSLANADSLWQTRTRKEDFLLPSLTLSYDTSDDWVFRFAAAKVIAWAPYNQMVNNTFLNDTTLTGSGGNAELSPYESWNFNLSAEYYFAQQAVVAWSLFYKKINNYIDTSASVERQYNALRDTAPQSWAQLVGSNGCTADGYCDYSIQRPRNAGDGKVKGFNISFQQPFGDSGFGLTANYTYAAGENNTGDALPYQSRNSIAFSPYYEKGPLNARLTYNWRDSYLAGGYVAGAAPASVDDYAELCASVGYAFSPNWSLQVDAQNLLDEQYLQYLGDKDHLTGRYRSGRRYMASLHLKF

SEQ ID NO: 14849 - protein, 495 aa, Burkholderia xenovorans
MNKKIQYCPNFKMLIVGALTATPILSFLSSKAYAGGTAFDATSISSMGSANAGMAAEAGDASVLFANPAALTRLKRAEVVLGAAFVGINTSYTSGQTPDGSPTNSGTTGSAGQEFNRKSGYDSTALAPNLFVAIPITKKLVVGFGGAASHALIVRYDENFPGRNQGRDIDFKVSRANLGFGYKLTPTLSIGANGSYERYFQSLKLKLNYRDAVDGLLNNGSTLLDGLNAAGLAPPIPEEADLSLRMFGWAFNAQAGALWEPTINTRIGISYRPKTEFTGMRGKLKIQETAEGAEFREFLNGGLIGVSGPLLGVNGPQAAGDLLPEQRIKQDITLPDELRLSIFHHASPKLDLMASYTRQDFSVTNLKFVRESNGRVLQEIQQNYVAANSYRVGLNYKAFKRLVLKAGYAVENSVIDDDTRITLLPDSDRQYFGLGAQLELRRDTTLNFSYMKFDLEPGATGANGQVSPAEVRGGDFQGTTKLDIDFFGVSITERF

SEQ ID NO: 14850 - protein, 831 aa, Burkholderia xenovorans
MRVEGLFHLSLFLFVLNLNKHKFVSNKLLMKPRLLLLLFILPLTLSAQNTLSGVVKDANGYIVPQTEIVLTGGGISQKAKANLQGVYSFQNLPSGTFTLEIVSGDFIAFDQVTIKEANLRHDIKLDNAKDYELDEVAIRAESIKTKMEKQGFAVNVVNTEEAAQRNIQTNELLNTTVGVKIRQNGGLGSQVQYSLNGLSGSAVRIFIDGIPISTFGSSFNLNSIPPAMIEQIEVYKGVVPGHLSDDALGGAINIVLDKSAGTNLNASVSYGSFNTFQASVNGLYRFDKSGFTVKASGFHNYSDNDYEVSGRSVVVTGLGGVQTPITARRFNDAYRSTGGVVQVGYTDVSWADQFYVGFTGSDDYNEVQHGAFMTIMPYKGRFYESDAALANLTYQKKDLFTEGFDVNINGYYGSRNRQLSDTVAAAYSWNGERAIDFRGNEYEYTWGSQQEGGPTLAKISRNVASIRTGLSYAFNDNHKVLLNHMYSGIDREDSDELRSVLENTFVGTRDLHKNIVSLTYEVNAFNDRLKASLFGKYYQQKTISKDPAIVTNEAGNRVIVDEVVSSNKEFEGYGFAASYGITPEVFLLASAEKAIRLPNETEIFGNDGDNVVANASINPEQSNNYNLGFRFGAFTFNKHRVTLSTNVFTRNIKDRIGLPIENSLNVDDELIVYVNQGSGTSQGFDAQVNYVYNDKLSANFNISKFDLEIENRGTEVAVPNTPFLTMNGNLRYSLDNLFQKKSRLDLFYTLYYTGEFSYLVPQGSNTVGDDFFKVPEQLAQDFGMSYTFPKKRFVLSFDVKNIFDKPLYDNLSVQKPGRAFYLKLNYSINKF

SEQ ID NO: 14851 - protein, 434 aa, Burkholderia xenovorans
MKAKWLPIAAAVTAALASQAAFAVDFHGYFRSGVGVSSDGDMQTLSKQKVGRLGNEDDTYGEVQLGQEVFNKDGKTFYVDSMFAMIPNGSNDWEGTGSVCNFDEKQCSGDSEFALRQFNVQAKGLLGFAPEATLWAGKRYYQRHDIHISDFYYWNISGAGAGIEGVQAGPGKISFAWVRNDRGWDGKDGWTKFEGMDVNTLDLRYAGIPLWQDASLEVGVDYAIANPTDAQKDSSNVQYKNAKDGVMLTAELTQGIFGGFNKTVLQLQYGTEGYSKTMAFYGDGSWYGAEAKDGADGFRIINHGVIPMGNSWEMGHQLVYGVGNDMWDGNDKWETMSVVARPMYKWDDFNKTIFEGGYFKDKNKSTNGSSLEDSGYKLTLSQTWSAGSSFWARPEIRVFTSYAALDDNDMAGTPYNSKTSKDTWNFGVQAEAWW

SEQ ID NO: 14852 - protein, 147 aa, Burkholderia xenovorans
ADHDMKKGDIAVVWDPNWTWWEIGGWHFAFVAEGHLSYWRYTGDRAINSSIWEVGATPIIRFIKSAGYVRPFVELGAGVRFLSHPTISQNYSMSTSFQFADMVGVGAQFGNRQQYQAGFRFQHVSNAGIKDPNPGINFSQLYVQYNF

SEQ ID NO: 14853 - protein, 237 aa, Burkholderia xenovorans
MKKALYLGAVAFSVAFSMASANEPKIDFNPPNYVEETPSKEFIPELNKLGSLFGQGERPLFADRRAMKPNDLITIIVSEKASANYSSSKDYKSASGGNSTPPRLTYNGLDERKKKEAEYLDDKNNYNFTKSSNNTNFKGGGSQKKSEDLEIVLSARIIKVLENGNYFIYGNKEVLVDGEKQILKVSGVIRPYDIERNNTIQSKFLADAKIEYTNLGHLSDSNKKKFAADAMETQMPY

SEQ ID NO: 14854 - protein, 663 aa, Burkholderia xenovorans
MRSYLLISASIILPGLASPSVAQALSGNAETASSISDADGDSAEIVVTASRRSDSVKNTPIAVTAIGGDALRENQIANLADLASSTPNIQISTSFNNANIAIRGVGNSQFAAGSDAGVAVHSDGVYLGQSVLALATMNDVERVEILRGPQGTLFGRNATGGAINIIPKRPTEDLHYGVEASFGLDPAMVRSSAYVSGSVVEGLRGRLSLSQNYNKGYTKNLVASSGSSAVPSRLDDADSASIRAQLEAGTGAFVTRLSLEYMKDKGAGPSIWLTGTPSGVLPPVVANTPLGNLDKRQVYNNYGYKNNEAKFATLISTLDIGQGQIKATASYGETRIETLTDGDGTAVDHTSTYALNNAKQTFGELIYASDPARPLGLILGANYFHERSSQAFSIPISTLPPPLDVLGPVVYDAGASSLKSTSYAAFGQAQYKISDAFRVFAGLRYSRDRKAIENYSNFGVSPAAGRESWSRTTYELGASLKVNANVTGYAKYGTGYKGGGYSAAANAIAFNPETNTNMEIGLKGNYLGGALQANLAGFHMKYKNLQVNQAVGAVVLVTNAARATINGFEAELKIRPVQAFRVDLNASWLDARFDDFFSRDDSRPTFLPDTKIINGIPVQGIDLEDNRLPTAPKYAVSAGAYYDISIDSGLVTVGGRYDWKSRC

SEQ ID NO: 14855 - protein, 660 aa, Burkholderia xenovorans
MKLSQLCIAISLAFAVQAHANDYSLQRSQPADTSRWQCSECSSDGTWSGEVSAGVGYLNNDGSSRFYNWNPPVYGTNSDNKHFNASLNADIEQYEDDAFYNRIVVEDLGLQRFLLQWEMGQYDGLRVLGSYSETPYFWNQSSLSAYHPREDALVSGDLSKYENSVTRETFKLELKYTPHTPWKPYASMKHERKEGTTSLYSSTIPGYANAPGFIPKAVEHETLNTQVGVSYMEDLWLVDIAYRGSFFRNDKSALYYGSTTNPYANHLAYEPDNDFHQFAVTGNYRLNQQTFSGRLLWSQTSSEGGLNPFPQSPVNSNTFHGETNTWQMSADYHNKLSRDTAFAISADYSDKDDNSDRNTIIGSTREKYDHTKTKLEATLKYRVTSDVKVNTGYHFRQDERSYADRKRTDEQRVFVGAQYRPNRPWQLGGKVSYSFRDGSDWQDDSSDSPNLRQYYLADKERIELRGHGSYDMTDDVQLLAELWYGNDDYAKPDIGLSEGEDYGYDLSLNFNLLDGLSGHVFYNQQIIRSEQQQANSDVVGWNRYTTKLKDDITTIGFGVSKEQLLDDKLSISFDYSYSQADGKSSTTSGGYQYPDNEANSYRFEVIADYEVSENQNVQLNLRYEDYSEEDYLFNNETETMGDVLQSYEGLYGGVYWKYRF

SEQ ID NO: 14856 - protein, 421 aa, Burkholderia xenovorans
MRKIVAMAVICLTAASGLTSAYAAQLADDEAGLRIRLKNELRRADKPSAGAGRDIYAWVQGGLLDFNSGYYSNIIGVEGGAYYVYKLGARADMSTRWYLDGDKSFGFALGAVKIKPSENSLLKLGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQVTWNAPWGSVFGSGGYLRHAMNGAVVDTDIGYPFSLSLDRNREGMQSWQLGVNYRLTPQFTLTFAPIVTRGYESSKRDVRIEGAGILGGMNYRVSEGPLQGMNFFLAADKGREKRDGSALGDRLNYWDVKMSIQYDFMLK

SEQ ID NO: 14857 - protein, 378 aa, Burkholderia xenovorans
MLRRGTVTLPDAGGERRYGGRFTTHRTPTGRFITMRSLKSLLAAAVVVGALAPVAAQAQWYVGLDAGAQLLQDSKNSGSGVSGLKSESDVGWLTQGVVGYAFGQWRAEGELSYRSSGVSKVGGATGSGDTSALAPMFNGVYEFLPQSKWHPFVGLGIGAARLDNGTVKKNGANAYSGDDWQFAYQGFAGVGYDLTDNVELKAQYRYFSTLDYESKAASNNAKIDSEYRDHGLMLGFVYKFNAPKAAPAPAPVPVAAPAPAPAPRAPAQVQKNYIVFFDFDKAQITPEAARVLQQAAGAAKTAGAARIDLSAHTDLSGSAKYNQALSEKRGAAVKAQLEQLGIPASQIVVVAKGKTSPMVPTPDGVREPQNRRVEIILP

SEQ ID NO: 14858 - protein, 730 aa, Burkholderia xenovorans
MSGHVFLKTASLFALMLSAAPALAAPALAAPALAADEQDQPSDGGLGEIVVTAQKRAEPLQKTPISIVALTADDIAKKGIADLTDLRSQVPALQVTPHPNSATTARVFLRGVGNNDDQITVDPSVAIYLDGIYVARGQGLAAEIAEIERIEVLRGPQGSLYGRNATGGAINYIARQPRLGEFHARQSLAYGNYDQFRSRTSVNVPVGETLAVELAYLHSSKDGFVRNLGTGVERFGDQRRDAYRAAVLWQPAPSFELRYAYDRSDIADTPAFMVSAPYYPRMAVRPTAGSPAVRDLAANDVTAQGHSLVASWNASDEVTIRSLTGYRKLANFTNQNYLTGVAGPFPVFVTTFDQNQRQWSEELQVVGSALDRQLEYTLGAYFFDEKAFSYDTTVPTGRATTLRTATVRNRAWALYGQMTWRPEALAGVYLTGGLRWSRDSRKATLDQTSVALNGTRTVRPQGRGDNSFTDVSPSVILGYDVNRDVNVYAKWSRGYKTGGYNLRASTIERFAEGYGPERLDSFEFGLKSSWLDNRLRANVAVFRANYRDIQVNIQSDPENPAVTDIFNAGEARIQGIELDLTAKPSRALTVNANYAFLDAGYRRITDQITGANIASRFNFVEAPRHTLTVGAEWTLPETPLGVPSASVDYYMQSRKFSSTTDARYIVGDYGLLNARLSLSEIPVGFGKWRLSAYARNLTDTKYYIANFSAGLPAAFFGEPRTYGIELNFEY

SEQ ID NO: 14859 - protein, 473 aa, Burkholderia xenovorans
MKKTTSRFAMACCALLCAPYSAFATNGMNLEGYGAISHALGGTGSAYNTGNSGVSNNPATLALRKSKSTQLGFGLRGLHPDVSLQANGISQSSAGDAYYMPSLSWMHKGSAVTWGVAMLAQGGMGTEYGKGSPLFSMGKPLSGVGMVPMSGEEIRTEVGVGRVMFPIAWNVSENTTIGASFDVVWAGMDLMMDMDGAHFASMMGSGNVNGTMATTLGTMMAPGGGVTDVNYVRYNFSNNNAFWGEASGYGTGFKLGITHRLSKVVTVGGSFQSKTAMSDLKATKAELSFAGVDGTGSTFTQKVNGTIKVRNFEWPTTIAAGVALYPSDRWMVAADVKHLGWASVMRSFSTSFEADNTAANGGFAGQELEVAMKQDWDDQTVFGFGVQYRASDRLVLRSGASFSSNPVPNAYLNPMFPATTENHYTAGFGYRLSDAATIALAGAWVPKVSARNGDGVEVHHSQTNWSLNYTQAL

SEQ ID NO: 14860 - protein, 772 aa, Burkholderia xenovorans
MHTLNTHKRLLALTVGMALSAPAAFAAENVWESIEVTAQKRNENISDVGIAITAFSGEQLEALGLESSTELIAFTPGVSLAGDIGGQRAIFNIRGVVQNDYADLAEAPVAVYVDGGYLASTQAQTFGLFDVARIEILKGPQGTLFGRNATGGLVNTITAKPTADTEGYAEFTAARFEQYRFEGAISGEIADGIYGRFSGFTNQQGEILENIYEDGAAPDTRLGSVGGGEDGYNDDTKAFRAQLMFDIGEEGTLLLSGNWSDTTKSEGPYQVVNTTEVKDAAGNVIDVIFAADDPLGCDTIQAGVCVDGNFNGDPFRPVQGGDFNGNFDPDGSGNKVNKDFAFDDQNKIKSKGLAATLDYAFESFDFFAMSDYKEFKRTVGLDSDQTASPELIFQSNSTIEQLSQEFRFSGETADLKWVGGLYYLSIDTDYSQGLAGSPTTFFLGGEENNTLVSLETDSYSVFGQVDYSLTDDLVLVGGLRYTRENKDFLGNVYQNENTNDRIIEIDTSTASLEVMDEQNDQNLWSAKLQLEYSVGNSLYYAGINRGVKAGSFNAPLLGGFSFYEPEELTSYEAGLKHSFMQGSGVFNANVFYYDYSDYQSFSWVNNAGVVTNEEASFSGVELEVFLTPADSVDVMVNFSYTDAVVEDLEVASGYFADTTPPFTPEFQASAMLRYNWDAFNGNMAAQLSASYQSETFHNARNFTAHEIDSYATADTRLTWVDGQDKWSLAAYVDNLFDSDHELIGFDVTGFYGTSQISYAKPRTYGVTVRRNF

SEQ ID NO: 14861 - protein, 274 aa, Burkholderia xenovorans
MKKLIAACVVAGASTGAFAQQAGDVVATLGWLHVMPQDSTNGLTTNVVNSPINGPLRLPGSFTSPGTSLTVNNADTVGLTFTYFFTDHIAVTSVLGIPPEFALTGHGVIKPPGPSGSLGSVDLGNPANQPAVKNARQWSPTIILNYYFNSPTAKFRPFVGIGVAYSWFSNIELNGNFAKDINDNLGSVLAAGAGKPGPTSVEGKASSSFTPVYNVGASYAFAKNWALTATLSYMPLKTYSSLVIKAADGTTLATTRTKLKADPLITFVGISYKF

SEQ ID NO: 14862 - protein, 340 aa, Burkholderia xenovorans
MQTQRLVSFAALALLGSSATFAQSSVTLYGRVNTSIERTSLLGQHWTGVNDNASRFGLKGVEDLGGGLKAGFQLESGFDSSTGEAAQTFFGRQSEVNLSGSFGKIRLGNWIPESYYAVADYGVQDQPNHDTGSFSNRLYQSVAFGHANKIGYRTPEFGGFWAEASVSAHEKVAQIAPSGLPAGSKYVYDLAANWERGPLAFGAGYAKLGDNWDAGLRGHYTVGAIQVAGYYQRNDYEVLGTRNSAGLAAQYAFGASEVVANYIWAGKWSNVADSSAQQLILGYNYHLSKRTKVYAAYTLIKNKSGATYGYRAGRLSAVEGFTPILGGDPRSVGVGVRHNF

SEQ ID NO: 14863 - protein, 856 aa, Burkholderia xenovorans
MYCCAMRLAISLGRKFRGLGAEIAVRRPSRNRPRTYGVGSRPGAVTNRSHECRKPDTEASPWRRHALLAEPLADVSQRRDKGDASMKNHLLLGAAASALLIVAAPAFAADTTADAAPIATNAAPADNSVVDAVVIIGQGQSRQVQTLSNEAIGLQAAGTSALKAIDMLPGVTFQSADAFGSYEWSTRISIRGFNQNQLGFTLDGVPLGDMSYGNHNGLHISRAIASENIGRVELAQGAGALGVASTSNLGGTLQFFSRDPSEAMGGEINATAGSDNMHRLFGRFDTGAIKQLGGLRGYVSVADQKSDKWKGGGEQKQRQYDAKLVMPLGERGDLTGFYHRSERREQDYQDLSFDMIKRLGRDWDNTQPNWGLAVAAARAYNTPGATLPAPFMTVDDAYYAGAGVRNDDLYGAKLNLDLTDKVTFNATAYQHKNEGQGLWYTPYVVSPGFGTAGSNAAPLSIRTTEYDIDRGGLTAGLSIDLGAHRVSGGLWREVNNFNQARRFYAETAAAPSRNPLDFQENPFFTQWQYAFETKTTTGHIEDEWTLSDALKVNFGFKAIKVENTVKTIVGNPLAGTIESKDNFLPQVGFVYKATPDFEVFGGYTENMGAYVSAATSGPFASQNQARVDYITQTLDPESSKTFELGGRYRTERFQGVAAVYHVTFDNRLLAVAQGSSIQGNAPVLSNVGSVETKGVELAGTYRLSDAWSLYGAYTYNDSQYENDVVAQDGTVRARTKGKTVVNTPKNIFKGEIAFDQAGFFAKLGVAYTGERYYTYENIGGLAPSTTVADLTLGYRFEGEGWAKGTQIQINVTNLTDEDYISTIGSGGLVNSDPTGTAQTVLTAPPRQVYLSIKKSF

SEQ ID NO: 14864 - protein, 357 aa, Burkholderia xenovorans
MKHIIAAGLTAICATTGAWAQSSVTLYGSLDAGVAYISNVGGHSKWMEEQGNMQPDRWGLKGVEDLGGGLKTIFQLENGFYTNTGAFAKAGVLFNRQAFVGLSSDSIGTVTLGHQTPFSFDVLGPLSTAYLAASWYAFHPGNIDELADTGVVPFDNSVKFRSASFSGFQVGAMMGLGNTTNFSTGKTLSFALSYANGPFKAGATYANEHDRTPSIVTTGITNFQGVAAATYTADKVENMGAGASYQFGKLLVHGLYTRVKLESGSHSNTYQSYDVGANYQFTPFNTVAGGAATTTLAGHRWTQFEIGDIYALSKSTQLYVNALYERAGSNTDAAFFTAGVSSGRNQTIILTGIHHSF

SEQ ID NO: 14865 - protein, 734 aa, Burkholderia xenovorans
MFNHLTRGGGSALYGALAATVAVLLPYDVFAQSVPGTALPPVMITAPTPHRLQSRQAVRSAPRPVPVARQARVPSQAAAPAAVPGSLTVATAQQALQEIQQTPGGVALVTADAYRNSTVSNTIKDVLDYVPGVFAQPKWGDDTRLSIRGSGLSRNFHLRGVQLYMDGIPISTADGYGDFQEIDPTAYKYVEVFKGGNALRLGANSLGGAINFVTPSGRDPFINGVSVDAGAFGFRRLQANTGGSNGPWDGFVTASTQRSDGFRDHSSGQSTRLSGNIGYQFSPDFETRFYLNANHVRQRIPGAVSKFSALTSPQTAYVNNVAGDWQRNIDTVRIGNKTTMRFDDTTVEFGLFGTDRHLMHPIFQWLDYHYKDYGAFVRAVDDRVIGGYRNRLVAGVNVLNGRIDNQQFANLAGQKGALLSSSIDRSRNTSVYIEDSFYFLPNVAAIAGTQFLYATRDRQDRFLSDGDQSGRTEFSLWSPKGGLLWQIDPTWQAFANVSRSAEVPSYGESANGPGIPNIPFTSIRPQRATTYEIGTRARRPDATWELTYYRAQIENELLCLFSAFGNCNVTNADRTMHQGIEAGAGAAIFRNLFERGDRPDRLWLNVAYTFNDFRFVNDPVFGNNLLPGAPRHYVRGELLYKHPNGFYAGPNIEWVPQGYYADSANTLSTDAYAIYGMKAGFDDGGRYSGYIEARNIGNKAYIASASILDRANANSPLFEPGFGRAVYAGFKVRW

SEQ ID NO: 14866 - protein, 824 aa, Burkholderia xenovorans
MKEKLFALFWVLFFALPLYAQADKTGSYSIKGQVLDSLSNESVPYATLRIALAKTPDKPVKLLACDVDGKFQAPLSSAGKYIISMQSIGKAPAEKTFTISDKQRNLDLGKLYMQEDNQRLGEVTVTAQKPLVKAEIDKLTYSLEDDPEAQTNNTLEMLRKVPMVTVDGDDQIQLKGSTNFKIYMNGKPSNLLSNNPAEVLKSMPANSVKNIEVITDPGAKYDAEGIGGIINIITTKNALQGYTGTVRVNGSSLGRVGGGGYISLKAGKFGLTANYNYNYNREPWNESTSIREDLENDEQHFLTQNGRRKNNGPFQFGSLEGSYEIDSLNLLTVGANLFHGKMTNRSEYTVNMQDINRNPVYDYNRNSDATETFGSTDVSVDYQHSTHKKDELLTISYRFSHSPNDNKDYTELKNVVNYNPWLGYPQNNINKASTNEHTGQVDYTTPTWKDQTLEVGAKYIFRQSRSNTDRTAFNDSLNIWEDITSKDSHFRHTQHIYSAYLGYSMKFDKFGVKAGVRAEGTALDVKYEMAPDMNFDTHYFDVVPNATVSYQLSMAQQLRLGYNMRIQRPGIWYLNPYVNNADPQNISFGNPNLDSEKSNNINLNYSMFAQKFSINASATYTFVNNSIEQYTFIDPENPGVFQTTYGNIGKKQSTGLFVYANWNPVPLFRIYMNGGMDYTDLKSEKNDMANSGFSGRIFAGTQFNFPLDFRVNIQGGYFSPWIQLQGKGSPFYFTGISVNKDFLKKKLSVQLSFQNPFWKRMKMENTTSDDTFFRREINYRTMRMLMVSVSYRFGTLKDAIKKVKRGISNDDMKSGGSGGGEQQM

SEQ ID NO: 14867 - protein, 215 aa, Burkholderia xenovorans
MKKVVIGLFLIAFAFNVNAQEDTKKDDFNKWQVRLRLITIAPNESATIETIGGDIDISTAVVPELDFTYFFTKNWSAELILGTAKHDVKAVSTAAGDIELGDVWILPPTLTLQYHFLTEDGFRPYLGAGLNYTLFYSADEGPTADDVSYDNSVAFAFQAGLDYDLNEKWFLNVDAKYLTLSTDATVDATTALGATVGADVDINPLIIGVGIGMRF

SEQ ID NO: 14868 - protein, 701 aa, Burkholderia xenovorans
MRKSLFVAGILSLSFLAQAEEVLKLDKVQFTATKSEREEKETPASTATITKEELKFERGFNLSESLSEVSGVNAETKNGGYDVRLIIRGGGLNAPYGIRQINILLDGVPITDPDGMTRLDFVNPQLIDQIEIVKGPNSTLYGANAIGGVVNFITKPVWTVQGLKLKTGFGNYNTQLYNLLYGNNYKGKLFYYVDITRRSTDSWREWNEFKSTQASFKIGYLFDDKSSIETYFNYSKADLQLPNSLTKQQFDTDPSKQYKENVWIHSGRYSEIYFFNTKYQNQLTDSFTIKPIFYIQKWSHYHPVTGFINDGGAKVFGTDFITELKHSLFGINSTLISGFQIQHDKYDADKYTYGYVMCSTGPCNPRPNIDVIKYTLSDQKGRLAETDHNKILKYGFYAQETLIPTKNLLIDIGLRWDAVKFDLNQQNYIDYNYSLTNARYIISNSNTQINRTFRFISPKIGFSYAVAPITNIYASFSAGFQTPQWSQLTYNPNLKNTKAYQYEIGTKTVKSDEYSFNTAFFFIDSRDEITQVLDGSRTSFANAGKVNKKGVEIDGRFKVYDGLYIGGSYTYSDFIYKEYIEVKRVGSSFRAYDRSNNRLEYIPKHKYTLYVYYFHPSGFKAKIDTNTWGQYYTNAANTGKYKGYEFLTNLFLGYEKKNLELGFSVYNLTDKKYAVEVKEDSSTPYVPGAPRTYFVYGSYKF

SEQ ID NO: 14869 - protein, 395 aa, Burkholderia xenovorans
MKRIGLSTLSLALLGVAGVAHAQSSVTLYGVLDESIQYVNNATPKGGALVQTFAGNLQGNRFGLKGTEDLGGGLKAIFQLENGFDINTGKLGQGGLMFGRQAYVGLTGDAWGTFTAGRQYDPLVDLIQPLTGDNYFGSTFATPGDVDNNDNSFRVNNALKYVSPVWAGFQVEGMYALGGVAGSTGSGQTWSGAATYATGPFSLAAGYLRADNASTTLPVRTGWNSSTVPGATFDTNFPNNAGINQAYTNAKSISIASAAAQYVTGPFTANLSYSNARYKPDAQSTFTSTQVFNVGRAYVGYQVTPAALLGVGYAYTHGSGDARATYNQVSLGADYSLSKRTDFYAVGAWQHASGEQRVPGVGGGLVSSTASIGSYGNQSSTDNQVMVSVGIRHKF

SEQ ID NO: 14870 - protein, 408 aa, Burkholderia xenovorans
MKKSLLSLVILSGSTGFAYAQSNVTLYGLIDSGLNYTNNVQTAKTSRGLVGGHQIAMIEGGSAGLQGSRWGLRGSEDLGSGLKAIFVLESGFYSNNGVANQGGALFGRQAYVGLSNPIGSVTLGRQYDPVVDLYGPFLAAPQWGGYMSSHPSDLDNALNTRRINNSIKFRSASYRGLTVEAMMNLGGTPGSFSSNWIWGAGAAYANGPFSIGAGYLNIRNPNTSFFGANPNAGPATTNNLGSFGSATSPESNPVFAGYASANRLEIAGVGAGVTLGGLNVNLAYSNTRFGDMGSASGPNPLGYKGTAAFNNAEINAKYQFTPSLLAGIAYDYTRNGGAGGKGGANYNLFSAGVDYFLSKRTDVYTIAVYEKASGTDSLGQSAVAQITGLTPSTTNKQVSLRVGIRHKF

SEQ ID NO: 14871 - protein, 394 aa, Burkholderia xenovorans
MQNSAELHDLTAPMRNHAPATMLTLVATLAAVALSNVYAQGVPGPSLQFYGLIDAAVGRFEGAAAGVNARDRGTAKVDGGVMSTSHWGIRGTEDLGSGLTASFDLSAFVRNDTGAFGRNDAIPAPVNVAADPMFSRAAWIGLAHATWGRVRLGNVTSLMFINSVSSNAFGDSTVISPLNLTTMIGSPMTGGTGWANSLVYDSPVWRGVSASLAHGFSEGQGGSNNALRVAYAQGPAAVSLAMQSVKRDPLTFADGTSPNNTRTWQLAASYNFNAVKFFAHLGGIRNRGTAMQPLDISYRLWELSAAVPVGSGQLLAGWASRRTGDAVVPVPATAAGGNLVRKVLTVGYDHQLSKRTDAYLVLMRDQTRTQTTGAPSQVLESRGTSVALGVRHRF

SEQ ID NO: 14872 - protein, 758 aa, Burkholderia xenovorans
MAQTTLKPIVLSILLINTPLLAQAHETEQSVGLETVTVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSKTGSIGLSWVGEKGFIGAAYSDRRDQYGLPAHSHEYDDCHADIIWQKSLINKRYLQLYPHLLTEEDVDYDNPGLSCGFHDDDNAHAHTHNGKPWIDLRNKRYELRAEWKQPLPGFEALRVHLNRNDYHHDEKAGDAVENFFNNKTQNARIELRHQPIGRLKGSWGVQYLQQKSSALSAISEAVKQPMLLDNKVQHYSFFGVEQAEWDNFTLEGGVRVEKQKASIQYDKALIDRENYYKQPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 14873 - protein, 462 aa, Burkholderia xenovorans
MKKTLGLGALISALGTSMPLQAMPYDTPDTWGGDLESRARLTGNWGGARDDMAKKGVVLDMDVYWMPQKITSGGRDSASGDWGNAILTLNVDTQKLGLWPGGFFKLQTVTSFGDTLLKETGAIVPANLSWMLPTITPDTGVQEITYTQFLSQHFGVFLGKINAIAPTNVLHGDYTTGFQNTGINMPLALAMVPLSAYGIGALYLPSHDVTLAGMVLDANGTIKNDNLSNAFDDGIMALASADLKIRPWGLPGHQNLTVAWSNKDRTSLVQDPSNIAGLLLTAHFPRLGNPGPILSEILDAHPVAAKIPPDPLNKESETWAAVYSFEQFVWQPAGDPKRGIGTFFSVGVSDGKANPIRYSYSLGLVGKGVVPGRPNDDFGLGWARTEFSDHFVPYLRDRFNLGLDHEDVVELYYKASITPWLSITPSLQVVSQGLNKVFNASAPGFEDLDTAYIAGVRVGVRF

SEQ ID NO: 14874 - protein, 685 aa, Burkholderia xenovorans
MTLATAALLSLGAILPAAAEEREPDPDSAGQEIVVLGTRAARTERTLSADPATERMSQSSRALERDLLTAAGTYRLSDALELISGVSNQNNRGGVMDNFAIRGFLGTPDGGAEYYVDGFLANRGMAPPRDPATTERIELLKGPMGALFGDADPGGRVNLVSKTPGAIASGTATLTYGSFNTRRVEVDVNQPITTTLAARLVAAGEDSDGWRDFVTLKRRVVAPSLTWRPSDSAQLTYVGEITRFDTPFDRGMPAIGGNANALPRSRYFGEPANGVTRFRNERHQLTGEVALGGGWALNGGVAWRTGSLRGFSADQSRLVNGTTLWRQRRQRGYTVDDLSARMELAGRVGRHQLSFGAKGYLLDYHELLLRRSPSAAAPYAIDVFAPVYGGTALPLLPFTDNREKRWAATFYVQDLWEVADRVTLSGGVRYDPYRQRIHNVRTGAVGRAVDDPVHFRVGAQYRLDTRFALHANWGENFVLNSGTGRDGSGFAPEAGKGYELGASVRLPGVALSASWFSIEKRNILTNDPVDPNFNAPVGRLRSHGIEFDGSARLGRHWQLVANYAWTHARTLDRSFATDRVLDVPAHAGTLFVLGSFLDADGRGPSISGGLAYVGDRAGAIDGSGLILPSYVKAKAAAEYALSRRMTLRLEADNLFDARYAMSSYSSLWVYPGAPRTVRASLRVGY

SEQ ID NO: 14875 - protein, 399 aa, Burkholderia xenovorans
MKRIALSTLSLALLGATGVAHAQSSVTLYGLIDESVQYVHNANPANNNLWQLAAGNLQGSRWGLKGSEDLGGGLKAIFQLESGFNPNNGKMGSYGTGTKLFGRQAYVGLTQDAYGTLTLGRQYDPLVDLVQPLTGDNFFGSTFTTPGDVDNNDNSSRTNNAIKYVSPVWGGFQFEGMYALGGVAGATGAGQSWAGAATWSGGPFSVAAGYFRMQNANTLTSRGVAPGNQGGTWNAGVTSDGTFDGSNINGAYASAKQIDITSAAAQYVTGPFTFNVRYSFAQYKPDAFSGFTEQEKYHVAGAYAGYQLTPAMLLGLGYTYTHGAGDTSANYHQVSLGGDYFLSKRTDLYLVGAYQHASGHQRDAATGGIVNAGASVGSYGYQAGSSSQEIISLGIRHKF

SEQ ID NO: 14876 - protein, 361 aa, Burkholderia xenovorans
MKLRSALLAATVLAAPVAAKAQPVTGLYVSGGVGVNLQQNQTVNAGGIFSGAGFNTRSEPGVTGQVSVGYGLGNGLRAELEGFYSWNDLRSIKSSGPTSSSGKNEKAGAFVNLLYDFDLGLPVYPYVGVGAGYVWNHNVINSVGAGGNDALHYDKSTDNFGYQGIAGLSYPLPVPGLSLTAEYRFMGLLDPQPAAGGAVYGLTNGAVTSQARGNMKFGNDFNHQILIGVRYAFGVTPPPPPPAPIVAPKPTAARTYLVFFDWDRADLTARAREIVAEAARASTQVQATRIEVNGYTDKSGTPQYNQRLSVRRAQSVAAELVKDGVPRNVIFIHGFGETHPLVPTAQGVREPQNRRVEIILH

SEQ ID NO: 14877 - protein, 327 aa, Burkholderia xenovorans
MKKTLFAFSMLASMAGATYGQSSVTVYGVVDLGLKIENAGNGTVTGIDSGNQSVSRVGFKGTEDLGNGLKANFVLEAGFNADSGSQSDATRFFNRQSYVSLAGGFGEVKLGRVQTMVFTNSAVFDPFADTLAGDSVRIFNYGGNRIDNTVNYSFAAKNGINGQAAYSFGEVAGNTSASRTVAGAIGYASGPLATVLTYQDTKDVTGNDSAKTTLIGGNYNFGLLQPFIAYAVNKGFGTLDTRDALLGLKINLTSADTIMTSYMQKRDKVIDNADAKQIAIGYTHNLSVRTNLYTSWARLSNDDNAAYRVTSAGKTDKLFNIGIRHKF

SEQ ID NO: 14878 - protein, 1085 aa, Burkholderia xenovorans
MKNRTHPWGIFDYSNKFKLQMRLTFFFLFIMIVQVQANSYSQNAKVTLQLEEKSIEEVLKKIETLSEFKFLYNSKEIDFERKISVNYVKEPISRVLRNIFLDTGITFQVINKQIILKSDLNKVTSYNVEQRNKKVFQQVITGTVTDDNGMPLPGVNITVEGTTIGATTNFDGNYSIEAPSNESVLLFKFLGMKTARKTVGDQTVLNVVMKTDSQSLDEVIVTATGTKKRVEIGNAISQLQVSDDVKERPINNVSDLIQGQASGVQIYNSGGSTGMGSRIRIRGSNSASLSNEPVIYVDGVLINNQSNSISFETGGQSPSRFNDINPEDIESIEIIKGPSAATLYGSIAANGVILVTTKKGKFGKARWSAYLESGLVQDIGDYPKNYQALDAAGNPGFNFEAAEGEFTPSIINSFQPLNDPDTSPFRTGNSYGVGLSVSGGTEKINYYVSGNFGDNEGVLPVSNIRRTNFRANLGTDITDELKINITTGYTNSDLELPLNDNFSLALMSQGLSGNATRDVNNGWGEFTPEELFTIDTRQRINRYTTGLNTNWTPNDNLTFRLAGGLDFTSRWDSQFFPTGEAPAFLNYDEGAKFSNRFNEFVYTLDAVGSYEANIWKNISSRSSIGFQYLQNLTQGTLASGFQIVAGSRSIAGAAVTESSEQTVESRTVGVFVEEQVGFDEKLYITGALRADRGSAFGASFDAVIYPKVSASWLITKESFFETGDWLNSLRLRGAWGASGVQPGTNDALRFFTPIAATVDGGQNVTGVTFGSVGNANLKPERSSEIELGLDASFFTNRINLELTYFNKETDDALIFRQLPLSLGVGEGRFENLGSVKNTGVEVALDLRILETETTYFNLNFIASFIDNELVRLGDGIQPVIFGVQRHVEGYPLGGYWDEQYTFNDANGDGLIAIDEVQVGELTYLGTPFATTDISVTPELGLFRERIILQGLLNYRGGQKLYNNTASWRNGNNNTRELNDPSSSLEGQARAIASKFYGTDAGYIEDASFLRLRELSLTYNFSRELIKNIGFSNLSFTVSGQNLGLWTDYSGLDPEISSAGQNNFVTEEFLSQPPVRSWKARLNLTF

SEQ ID NO: 14879 - protein, 1107 aa, Burkholderia xenovorans
MFNFKSEPMKDLKLKRKQFRCMRLVYPMAFLCLFSSPSWAIDSSAMAHGVEQSKGIVVKGTVIDEDNLPVIGANIMVKGTSLGTITDMDGNFTLTVPYEDAVLTVSFIGYTTKDVPLKGQRQVNVTLVEDSKTLQEVVVIGYGSQKKTTLTGSVASVNVKELSQSPSANITNALAGRLPGLTVTQFGGGEPGKDVASFAVRGLSSYNSGAQSPIVIVDGVERSLSNLDPNEIETFSILKDASATAVYGIRGANGVVIVTTKRGVSQSKPTVEFKAQVGLAEPVSYPDYLGSADYARLYNQALKNDNPGWETDPAVQSKLFSDEMINNWARAKGDNTDGLGYNIDLFDYAFRPAIQQNYTLSLRGGSERARYFAMIGYFNQDGNYRYSDLNDAYSTNGGFKRYNLRTSLDIDITKNFYVSVNLGGQITDMNESGGGSGNIIFTANTTPPIYPVVLERNGHPSNETYYTDHPNGLLFGDSQYTKNILGEIAYMGYKTTHKINFQGNFVIGHKLDFITKGLKVEGMFSYDIEETHAIDRSIPRKVANNEEYGGYATFYPSEGLGIYATPDRVRYSGAYTPAISNFTVDNTKQNSYQASMAIARVYMQAKLDYQRSFGGHNVSGMFTMHRSQRTIGNEVAYRYQGFAARATYDYENKYLFEANVGINGSENFSKAHRYGVFPSFSIGWVPTEERFMSGTKGWLDHLKLRGSVGWVGNDQGIGRFLYVQYYNGTNASSWNTGTNYNQSMGGGLQEGDLANPDLTWERGIKYNAGIDMNMLNNRLSLSIDAFYEKRWDIITNTGGSDVVGIPDIFGKTSSYVNAGTVINRGFDLELGWNDRIGRNFNYYIRFNAGFARNKILDMMEIDRAVPWMQRTGHRVGEYFVYEVDHFVKDQAEADKLNAMNDGAGFQPWGTLSPGDVVYKDLNNDGKIDDQHDMKAMGNPKTPELQFGIPLGLSYKGWDLSVLFQGAALTSLQLSGPAVWDFPVMGAQGNNMGKVKAMHLDSWTPDNPDASYPALHLGNHPNNKNASSSLFLYDASYLRLKNIEIGYSLPQKLIQKAHLQQVRFYVQGMNLLTFDKLGDVNMDPETGNGNGSWYPIQRIYNFGVNVTF

SEQ ID NO: 14880 - protein, 945 aa, Burkholderia xenovorans
MKLSLTNFNGNNFRLNKLTIALAGSLALLTAPLSWADSVIEGRVTDASNKVYFQGAQVQIKELDLTVISERDGSFRFAKLPEGEYTLIIKYIGSDDLEQKISVVDGEVLSKNFVIGAANSDQKELDNIIVYGQRAGQASAINRQKNANKLVSVISSDGIGQLPDQNAAEALQRMPGIFIERDQGEGRFVGIRGIDPNLNNVTINGLNVPSPEAGVRSVALDVIPSELISSLEVSKTVTPDMDASAIGGSIEVKSLSAFDRNDRSYSFTAQASHNELVSETSPKLSGSYTDIYTLAGGSQLGVAGAVSWFKREFGSHNVETDGGWSVFDYEDAATGEDVEAFGAEEIEQRAYSIERERLGAALNFDLYTSATDKYYLRTLYSKFSDDEYRLRNQFKYDKGQIDLTSNTQNSAQFSDAKMERDTKDRYEAQKIFSIITGGENQIGDWLVEYSAGYSKASEAEPDRIDSTFVAKDLTFGYLSSGPIPQLTFDAASQDLNNFALDEVVYENNLTQDEEVTLALDFSKDFVWQNNNGQIKFGGKYRTREKFNRVDAAIYDGGFTDAAGVDTSAQAFNTGPVDYNLGDFGPGLSQHQLSDYVLTNINDFELNSLKSDIESQGSSYTSNEDVLALYAMVSFDINDWYIVAGVRYEDTSFSTKGSKVDLIVDESDGSETVNISPWQGAKDYDDFFPSLNVRYNISDKLISRFAYTQTIARPTFSDTAANQLIETEVSEDNGQIITERKAVVGNPDLEPYEANNLDLSLEYYPGHIGVLSAGLFYKDIDNYILKEEVQDNGQWDGFEEVIQPKNGGNAALTGLELAWTKTFDSGVLLGANGTFVDADEKLPNQADTVGNLMFGFENNDISLRLSSTYKSENFKFTDNDADVYQDAHMQLDFSAKYYLNNTTQIYFNAININDEPYYLYHGDTQYNYQFEEYGRSYELGITITSF

SEQ ID NO: 14881 - protein, 199 aa, Burkholderia xenovorans
MKRICRIVAMFCSAVFLLAPFASRAWAEDAGPFYAGILSSYVIATDLRSEGAVFPEEVKIDKSWALGAKKGYVVPAARWLGAEVEYAFLEKHDIDEPEADFRDKTHNVMANFLLRYPRGRIYPFAGVGIGFSWAEINANVLEESDNALAWQLITGINYEILPNWSADLAYRYLNSRYENENVDAKDENHAIVLGVNYHF

SEQ ID NO: 14882 - protein, 475 aa, Burkholderia xenovorans
MNKKKFNAAVCGFGLVLATSQLSPAGAQEMELYVDTVTKQVYTEPGKNRVMMGTFQQIKKGSGQRAQRGSSRQAQQGSGQTVAHRTVTQDNDLPVVKSREKKEWYDKLKIRGYTQFRSASTVGGDKDAVSYWPDKSVGENSSFLIRRARVILYGDVSDNLYVYLQPDFASTPSGSSTGHFGQLRDAYADIAFDQKKEFRVRVGQSKIPFSFENLQSSQNRLALDRNDGLNSCCRDERDIGAFFYWAPAHIRERFKDLVSNNLKGSGDYGVFAFGVYNGQGANRVEQNNDMHMVVRFTYPYMFGNGQIFEAGVQAVHGRFVTSTGPINGVTPIMDAPAKGFKDQRVGVHAVLYPQPFGFQAEWNWGRGPQLNDTQTMLTESSLSGGYVLANYRLNAGQWGMLFPFVKWQHFEGGQKFERNAPHNYVNDWEFGVEWQVTKEIELTAVYHMMNRTDLANAPYERYKADVLRFQLQWNY

SEQ ID NO: 14883 - protein, 328 aa, Burkholderia xenovorans
MKKIISLVSLASVLFAFDASKIEITPTFNYTTPEGNLDLKNYGGVGLRFGYHYDDLWIDQAELGLEYYDNAKYNNPNDNTHTNTSVSRFYVNAIKGIDLANHVYLYGLLGTGYEYLSHGAYENKSGMFAQYGAGFKFALGEDLALRLEARDQIKFNNGEHNLISSVGLSFYFGNKAPKTPNVETKQIEEKPQVKQIDKTCSEPRKGALLDHIGCEKTIALEGHFGFDQTNINPEFAQKIQEVGKILEENPQYYTILEGHTDSTGSKTYNQKLSLERAKAVAKELEKTGVAKEKIVTKGYGFEKPKASNDTKEGRAQNRRVEAKFFIKE

SEQ ID NO: 14884 - protein, 332 aa, Burkholderia xenovorans
MSGFDRRIIILIFLFLSAHSISSEEGKTSFSFSVSPSLIAGSGFEYVFSTDSHIRSKLDWPLLPAGGLTADTEFKLKNGLYFSFISSFIIPAYSGQIFDYDYLNPYDSSMLTHFSEHKAYVKKGLDLNLNIGFMKLLVEYKTSSNKKIRVSCAPSIGIRYILNAWDAMDGYTKYPPDTNPPSPVLPDTPTISVAGLGISYKQSFILPSVGVLFRFELPREWKIDLSTQLCPSAIGFAEDFHYKREDGGLKFVDVFTKKNLSFYLYLSAEKRLSKHFSFFSSIDYTSITAYHGKLFTYYLKSGILKSSSSTGSVGAALYSTRINLGFIFHIVK

SEQ ID NO: 14885 - protein, 1050 aa, Burkholderia xenovorans
MKKQLLFTFTLVLLVVFELTAQSRTVSGKVTDVNTGEGLPGVNVVVKGTTQGTATNIDGSFTLSIPQDAILVFSYVGMETQEVATNGKTNFDIKMSETSLSEVVVTASGIEKKKKALGYAVSTIDGSKIQEKPESDIGRILRGKVAGMDVTQTSGMSGAGTNIVMRGYTSISGSNQPLFVVDGVPFDSQTNTQGNFQDGQTQSSRFLDLDPNNIESVNVLKGLSATVLYGDRGRNGVILITTNTGSSRKAARKAEITLTQSVFATQIASLPDYQDNYGGGFYQNFGFFFSNWGPEFSEINTVAHPYSKFSDASLRAAFPEFQGKQYEYKAYNSVPRFFRTGVTASTSLSIRGGGPKTSYSVSYGYYDDKGFTPGNNLIRNNFSFGGRTTLANNITVGATLNYTTTKYETPPTASSQGSNPVSPSIFGNIFYTPISVDLMGLPYQNPITGGSVYYRSGNDIQNPRWTLENAFASQVVDRFFGQINATYKFNDHLNLMYRIGIDQYTEQNAGGQHKGGVVTGFQNGFYNTYSIVNRIINHDLILSYNKSLTEDIELDAILGFNARRDALDRQGVFSVNQSVFGIFRHFNFDTQTSNQFTRDENRLGAYLQANFSYKNYLFLNLVGRNDWANTLETKNQSIFYPGVSLAVDLTSAISALQESTILSYLKLRVGYGSSANFPTAYSTRNTLGLSTRAFQQNDGTLIQSNSVANRLANPDLKPERLSELEVGVETQLFKNKVGLEVSLFQKRTTNLLNQTQLLDPAGGYTVQATNAGEIKVEGIELEASIKVLSVGGFRWDVSGVLTAMKNTVVSLAPGQDQVIIAGFTNRGNLARPGQPFGALFGTKVQRTNGQYTVASDGTYVIDPTAGVIGNPQPDFTSSLTNTLSWNGITLSFEWQYQGGGNILSLTAATLLARGMTEGTNFDRRQTFILPGVLASDAAKQNNIQIAATDMYFNVLGLGADEFKVFDATHLRLNEVSLSYTLPKALIEKTPFGMVQFTLSGYNLWYNAFNFPKGTNVDPNSLGTGVGNGRGIEFLASPSAKRFGGSLKLTF

SEQ ID NO: 14886 - protein, 486 aa, Burkholderia xenovorans
MKKSMISCLCFVLLLHFLLVSKVAAEVFCESCLQVRVERPLVVRGGSHEPGLDTKFYVIKLSENLFRGYSSGGGDAYAITGPEAWSMGWPANKVLSKGAAGSYSECGVWINSPVKIGDVYVAAVHQEQKCDYINGGQAHKSMGVSFSYDGLSWVNPITVLTSPEAPKMGTQSGEGDCSLVRAPDEGYLYMYCFRPGRWDNIVARAPEASYMFPSSWRKLYKGNWSEPAIGGMADSLGAIGSSVGYWRAGRKVIALDLDPWFGGIKLSLSSDYKNFFTLKDPLVPFVKNDWDRNLIGKSTDLIAYVGVVNLFGGGNRVDNSGWGITYTYIPHGGTLKEKYLVFQGVNMKVVSEPKQASVGLALTRWEHRSGKYRVTTLPVVRQSEYTERNRIAYLLTRPVVGIETLEVEECVNRQDPDDYLVTDAGGCDGSGHDRIATIGWVYKYPQKNTVPIYRCYSPLGENHFLSSNAGCDDLGSLEWKLGYGLK

SEQ ID NO: 14887 - protein, 981 aa, Burkholderia xenovorans
MNRQVDAVAVVIDLPSVRCSGAAWPCAVAHEGGPFPVSAQGFPMSPSRTVVLAQRLALQSTTLATALMFALAVTAMPAAAQQRSDDADDATQTLDQVNVTGTHLRRVDAETASPVVVIDRQRIEDSGQSTLGQLLQRLPMMAGFQTGPALNSNFSHGRALVSLRNLGPERTLVLVNGHRMAGPASSVASAPGVDVNAIPAAMVERVEVLTDGASSVYGSDAIGGVVNVILKDRYDGFAATVDYAQSSHGDANRRTLGLEWGKTWDRGGLILGLSRNSMNPVFNRDRSYAAKAVKYLDGQVGEIRGANTRAFLTDGRVLTPVGGVAPGPVGEDAFRPYNRATDSYNVYDTQYLITPIQRTNASLHGSFDVTQAVQAYVDVFWTRSKTVSRLDAYDLEMQDAVNNYYNPFGDQLDAYYVRSPQANTRVYTSTMFQTNIVAGLRGRLADSSWQWDAAAGYANYKDTLVRNGFSVTSKLNNAVGASFLDNDGVVKCGAPGAVIAGCTPINVFNPNDPATIAALRGTQLAVDLIDKSQMRFVEISANGDLFKLPAGAVQAAVGLVYRTNKFVQGTTSDVAAADADGNCDYNDGCILKQGRDEAVREAYAELLVPLLKDVPFAEVLNLNLGSRYSTYDAWGNTTNSKVAIEWRPIANLLVRATGSQVFRAPALGDLYGSPYNTVFDTTADFQDPCTGFTGAPNPACANVPNDGSFTNTAQFNVVTSGANNVGFKLKPERGRSYNVGLVYDPDRVRGLSLNVDSWRVVLDDMLSGVGVQQVVNDCFDGSESAFCPLIQRDTAGQLTRVSVPFAYNSGKVDTRGYDAGIHYTLANTAWGAFAAEVDATFFSSYRFAGDAHNYVGENSSWGNMPRWRAVANLAWDKGPWHASWNTRYLGRTVNGSQYENFCADTNADGSCAYFRIGSVVYHDASLSRKIASLHSTLAVGVDNLGDRKPPRFYRYSNAANTEASTYDTLGRYFWSRLRVEF

SEQ ID NO: 14888 - protein, 401 aa, Burkholderia xenovorans
MKKALATSALGLFALGAHAQSSVTLYGIVDTGIGYQSSSAALGSNSGGRSVVKMNNGIWAGSRFGLKGSEDLGGGTKAIFQLEQGFNSATGAQSVNGLGFSRQAWIGVTNPTYGTLTAGRQYTSYYTLLSPYSPTTWLTGAYGAHPGDLDSLDTIYRANNSLVYTSPKMYGVTVSGSYSLGGVPGSFNAGSTWSAAVQYLNGPFGIAAGFQRINNSTPGGGLWGPESTTSNNGATSGPGLSGITNGYRTAQAQQRFAVTGGYAFSSQWDVSFSYSNVQYIPGVNSGFRHQATFNTGGAVVHFKPIGALDLAAGYSYTRATESNGISSAASYHQFNLSQYYSLSKRTGLYAVEAYQRANGKTIGNNGVSIINATADIGDGQNSAPSSSRSQVAGGVGIIHRF

SEQ ID NO: 14889 - protein, 760 aa, Burkholderia xenovorans
MRQYVPSAVSSPRLIVSAIGVALSASSVYAADPATSSAITLDATSVNGKAEQASTDYKVEKASSQKYTAPLVDTPRSVTVIPQQVIKDTNALSLQDALRTVPGITFGAGEGGNPQGDRPFIRGFDAQGDTYLDGVRDTGAQTREIFAIESVEVAKGPNSAIGGRGAAGGTINLVSKRAHLGNSLDGAWTWGSDQTQRYTFDGNYQFSDTAAGRLNLMTHESNVAGRDKVNYDRWGIAPSLAFGLGTPTRVNLDYYHLESDDLPDSGIPYSIPTGGSSARTSAHPSKPIDGGDSDNFYGLTGRDFRKTRVDIATIAVEHDLSDSLTIKNTLRHGNSMQDYILTQPDDSAGNVNNNGVWRRANTRVGNTATTTNQTDLFGEFFVGGFKNSFSTGVEFSKEDSDRQSYTVSPNSKLTCTGPGNGGSCTSLSDPNPDDAWDGTISRNYAGTKTSSKTRAIYAFDTLELTPEWLLNMGLRYDHFDTKFRTYDASGATVVNKNGVPTKGRDTSEFFTGQLGLVWKPAENGSIYVSYATSATPPGAMLGEGTEGNPLSGTTDRGGNILASDMEPEETTNYEIGTKWDLLDERLSLAAALFRTEKENARVQVDTTTYENVGETRVQGIELSASGKLTDKWQVFAGYTYLQARQIDGGPLGKANDGNQLPNTPNNSASLWTTYSITPKLTVGGGAFYVDDVYGNVANTTMVDSYVRYDAMAAYKLTKNVDLQLNVQNLTNEVYYDKAFSTHFANQAAGRTALLTTSVHF

SEQ ID NO: 14890 - protein, 750 aa, Burkholderia xenovorans
MRRSVGASLIGKVVLAGPMVLAGASMVLAGASTVLAGASTLLLAGAARAQEGTIALDTISVEGQGAAGAGLPGARRPETATGPVEGYVATRSATATKTDTPLIRTPQSISVIGAAQLQAQKAQTLSEAVRYAPGVFANPFGPDTRLDWFILRGFSATESGLFRDGLQLFQTSFANYRIDPFGAERIEVLRGPAATLFGGSPVGGLINVVSKRPPLDPLHSLEFGGGSFNQAYAAFDLGGPADAEGHWFYRLTGRLQNSDAPVRFAPEDRVFLAPALTYKPDGATTFTLLTSVQRDVTGGAGQFLPYLGTVRPQALGLRIPRPLNVSDPLIDGYTRNQANLGYLFEHRIDDVWTVRQNFRYSLTDVRDQRYVGNGYEAGDATQTQLSRYGFLTTPKAGLVTVDTQAEARFADGLFAHDLLLGIDYKRYDLNDYQASAFPAPTLAILAPRYGQLAGQPVPYLVANQLLQQVGLYAQDQIRLTERLTFLVGGRQDVVTSDLTNRLTPSASVRGDDRAFTGRLGLIYNFDNGFAPYVTWGTSFNPTPGANGQTGAPYRPDRGDQIEVGAKFEPPGWNTLFTLAAFDLQRANVLTPDPSNPFNNLQIGAVRSRGIEASVVASLAEGLNLVGAFTTYDLRTVKGTVLDLGRVPVGIPETFGSLWLDYTIPSGDWKGFGFGGGLRSVGRSYADVANTLRVPDSVLLDAAIHYERDGWRAAVNIQNAADRRFVSSCSSATACFYGEQRRIVASVSYRW

SEQ ID NO: 14891 - protein, 360 aa, Burkholderia xenovorans
MKKTAITLVVAGLAAASIAQAAPQENTFYAGVKAGQASFHDGISKNSFIADILGLDNYGYNRNSFTYGVFGGYQILNRDNLGLAVELGYDDFGRVKFKEPSPGKTSIKHTNHGAHLSFKGSYEVLNGLDVYGKAGVALVRSDYKFYDANGARKRANSRHSLRTSGLFAVGAEYAVLPELAVRLEYQWLTRVGKLRTQETHNSSVDYNPWIGSINAGVSYRFGQGAAPVVAAPEVVSKTFNLNSDVNFAFGKANLKPQAQAALDGIYGEIAQVNSAKVAVAGYTDRIGSDAFNVKLSQQRAETVANYFVAKGVSADAISATGYGKANPVTGATCDQVKGRKALIACLAPDRREEIAVNGTK

SEQ ID NO: 14892 - protein, 762 aa, Burkholderia xenovorans
MNMHYSRSKLAQMITLALVAPFVAAPLGAFAQEVAPDTETEFNKEAIELIEVTSRYRKETLNKIPISVTTFNADDIEKGGLQNINDIAVSAVGMSMEKTFGRQSDIPVIRGVSWIPGFGSQKASYFIDGVYFGGSIQSLPLDLIERVEIVKGPQSAQYGRRTFSGAINFITRKPADELSGYVNLTLGQNGNQKLAAGVSSKLNDMFAFRASVSADSYDGDWNNTKEDGPDVGGEKTKSGMLGLYFTPSKNTDISLNYIYNENDDETQPFGFQGAEENNCFLDTRPYYCGEALTDQPISIGGGGFLDNDDYGLRNTSEHISFKLNHHFDFGTVSLISGWNSYDGETGLDQTYNGDEQSFSFGFFSGGPYFTSADSWYTLDSSGSDEYSHEIRFSSSAFDDRLYWSVGAYIWHSEAEPSAVDNFAEELDNTAFMAMGTYEFTDDFRLSAEIRRSSDEVTTEAYDTLIQNEQFADVSNEFDSTTTRFIAEYDVNDDTLVYLTRSEGNSPGGFNTSTLLPDDLVVIDEEDMVMYELGVKSTMFDGSLYVSAAAYTMDWTKQQLTDSYDEVEGPPVSYTSNAGSTEIKGIEIQGKWVINEHFNLDFGLSRTDAQFEELFDSNQCRFFAPGGASSFCVGDNLREFGDLKGNTPPQVPKNEATLALNYSTQINDGMELFSRLDFAYDSTRYAHVHNLIETGSRKLLHLKTGVQLENIRLTAWVNNVTDDDTPTYVFRYVDVQSFAYGARAFPVAPSRGREFGITASYKF

SEQ ID NO: 14893 - protein, 392 aa, Burkholderia xenovorans
MNKKILTAATFAVFASAAHAQSSVTLYGLIDAGISYVNNSKTSTGHASLTKYDDGVAQGSRWGLRGTEDLGNGLKALFMLENGFNSGNGTAGQGGAMFGRQAYVGLSQNNIGSLTFGRQYSFSTDYLGSNYSTGGLTVAGNYAYHINDVDQLTSSRINNSVKFSSANFSGLTFGAMYGFSNTAGGFAGTPGTGTTAAPVAGSSRAYSFGANYANGPFGLGVAYTDIRYPGQASPAFSTSLANVTFPTVGTGQIQDLRTVGAGGRYVFGPATLWALYTNTRLAPISGGSTTFAAYEAGAKYAVTPAITAGAGYTYMHLSGANVGHWNQVNLSGDYALSKRTDVYVLGIYQIASGNNNGTKLQAQIGSSSSYFSTSGVGADNQLAFRVGLRHKF

SEQ ID NO: 14894 - protein, 1115 aa, Burkholderia xenovorans
MRKLYLAIAFSVICGTLWSQAVSTSQVSGTVQDSSGAAVPTANVTFRQIETGQVRSVLTGNDGTYLISNLPIGPYRMEVAREGFATFVQTGIVLNVNTNPTLNATLKVGGVNEQVMVQSEALAVETHSSGVGQVISHQEVAELPLNAREPTQLILLAGNATTQGTVANDLNSNKNFPTITLSVAGGNGNQISFSLDGGTANNPFNGLNQPLPFPDALQEFKVETSSVGAQTGQHASASVTVATRSGTNSLHGNLFEYTRNYLFNGRSATALVRDSLKQNQFGGTIGGAIIKNRLFFFGGEQSTIKKSNPANSQGYSMTPAMLNGDFSVIASTQCQPKQITLAAPFVNNVIPKSLMDPIALNIAKLLPTDQVNQCGLVNYATGGNQQQYQIPIKIDYTINAKHSMFGRYMLSNNDTPLFYDASNPLFTGSTTGQKNKIHSVVLGETWVVSPKVISSAHIAMNRGVNPRFIPAFKTPADFGIPISAFIPAQMNLSVTNGFTLAGGASNPGYFNTLDYSASEDITIIKGKHQTQLGGQYIRAYMHAQNTRGVNGNLNFTGQYSTVGGTASLGYADFVTGQLNAFGQGRPFYDNDKSDYYGLYVQDAWRVSSHLSINLGVRFEPYLPQRNTDGYVEAFSMSNFLAGKTGTPPVSSPVLTPPAGLIFPGDQGYPPNNQYNNRANHWLPRIGVVWDPFGDGKTSIRASYGLLYDTPHLFFYTRVSNNPPWGATLTRSGGPFPLSNPWAGYPGGDPYKQNTGTAKSYGFFPTSGVYAVSDPNLGSPQINTWNLSIQRQVGKWLISGSYLGNHTAHLWSSRELNPQIYIPGNCTAGQYGLTAPGPCSSTSANNTAARRLLTLANPTWGPWYSTIAYLDAGATSSYNGMILSAQHRMSNNFSMLANWTYSHCLADPSTTELTGPSYVDPNNRSADRSNCSSDHRQQVNISGVLTTPTVHNRLLGLLTNGWQAAPIFHWSTGNLTTVTYGTDVALTGAGNQRAQQILPNVYTANRSITNYLNINAFLSPAAAPAGVYASTRPFTVSGPNVMNIDLAFSRNFRIRERHTMQFRAEAFNLPNSVMFGPPTGALNSANFGRLTPQIQSSAPGSTSTARIMQFAIKYAF

SEQ ID NO: 14895 - protein, 250 aa, Burkholderia xenovorans
MKKPLFALPLVLAVCAAAGARAEPTDLGAGFSLSGNAAMVSDYLFRGYSQTDFRPAIQLGFDLTHTSGLYLGNWNSNVSDFVFTDGNLEMDFYGGWKGEAGGGVGLDVGVLHYYYPGSSSPKGGNYNNTDLYLGVSYANYSLKYSYTPGDFFSTPDTKGTWYLDGTATFDLGDGWGLVGHLGYQKLKKAQDMDGDALGHYVDYKLGVTKDLSGWVLGLAAVGATRDNWLPTKNGHPSGRLGAVLSVARTF

SEQ ID NO: 14896 - protein, 639 aa, Burkholderia xenovorans
MKKISTSLVASFFLATNLFSTDTLETITVTSSLIKSDELNAPFATEIYTKNDIDNSKSKDIYDFLSSQTSVNVAPSFGNKFSQLIDLRGYGINDGYQNIVVLVNGRRLNNVDMVPQLLSAIPLESIERIEILKGTGSVAYGDGANAGVINIITDKKNSNYVKTYFGNNGTKNGVISFGYGNEYFIANAYIDYTSSDGSIEDTNNDKDENYNKNKNFSVIFTPTESLELNLSRTYSNMNINYANPISLDQYNNNPNKTSSFSEQYFSSYVTNGGFKYDFNENFWIDTTYSDEDKFSKFITWNNESKYDYKSFASKINYKNDKATVAIGVDGFDGDRISSSDITNKTNKAAFVSTEYRIIDDLTLSAGFRRENVEYEYNPESGANLKQDDYINAYDFGTNYRLNDTSSIFANYNRSFQAPDIDRFFYKDWSNNVSFNGFIEPTKVHNYTIGYNNIQKNNKLKISLFRSELKNEIYYEPTSYKNTNIDESHKYGIEIFDKFNINENLYTSINYSYIIAKIDKENEANGAYDGKKLPGVSKHNATVNLGYEINKINTVLSHTYRSSTYAANDFENNFNEKQEHYHSTDLAVSYTYQNIELFGKVQNIFDRKNGLWVANNWGSSDTVYPINFETTFFAGMKVNF

SEQ ID NO: 14897 - protein, 695 aa, Burkholderia xenovorans
MNMNVLKHLSVLVFAAVMFCRSVSAQDIAASDIPTLNVTGNRDDGQGFLSPNKIIAGDELQGKLSGTLGATLSNELGISATGYGAGASRPVIRGLDGARVQILQNGLAAGDVSSISADHAVASPMQNTHQIEILRGAAALQYGSGSSGGLVNVVNDRIVTSMPDTLSGAVNTSYETVNQNKTANIELDAPAGPLALHVDSAISNSNNYRIPGFAEQGGPNANWAINPGNPVNIPYSGKLPFSYSDENSLGVGASYIRSDGYTGLSMERLNHNYGIPTSEGGFIQQSQNRYDLAHQTNDPFDGFSSVKISAANTNYQHTEFTNNGVASTQWNNTATEARLELAHKALLGSKGVIGAQITGATLNATDLTTNNYAIVPQTKSNSTALFVVEEGRYGPLKTSLGARYNYASQNPNSSTQFPSQSSQEFTPNTYGPPTIQNRQFNLMSYSAGGMLDITSGYGLGLAYTVSQRAPSPQELYSYGPHDSTATFDIGNSNLGTETSHNLELSLQKTVGLMRGKASIYRNQFSNYIYGFYTGSYSQANENFSVVQASQANANIQGAEGEITYNWSQTGVGGRVFGDVSQGTFTSGGNLPLQPAPRLGTELAYQRNGWLTSATYIYSFQQNRLASWEIGPTPSYNLLNANLSYTERIGKVNWTAYMALKNLLNEDIRYATSPMSVRLYAPQPGRSLMVGLRAAF

SEQ ID NO: 14898 - protein, 397 aa, Burkholderia xenovorans
MRKKRLYVIVVTGGLMVPLVAQADSSNVVIYGKLYPQIGQAKTTGATRPGAPVSTLTGAPGGNNIASHTEINASNSRLGFRGSEDLGNGYKAHFQIEQRVSIDSNTGLSSARNSFVGLSGDFGLVKLGIHDSVYKSLGDGMNFLGISSGNFVSNSNILSKPAFGISKPGSFHLRPPNTILYESPKFAGFQVHAQYATDEGKTDERDPHLQSYGVIFGRGGLYVAVAHEIHTDYFGGSRNAPAALSNFTAAPDANSKDTGTRATLRYKFGNSRIEGNYAMLKYKETDGLPNRFKEYKQNAWSLGFDHRFGNWLAAISYARASADSCSLVGGAACSTSGLDGDMWSLGGSYSLSKRTSLFAMATRLTNGRSARFNNMENGSADTGADITQAALGISHSF

SEQ ID NO: 14899 - protein, 849 aa, Burkholderia xenovorans
MVALGVSAPAMAQDETEGTIAPVAEDTIVVTGARGKPRTVKESPVPIDVFDSEDLEDVSFTDANDILRNLVPSYSLSRQPISDGASFIRPASMRGLPTDKTLVLVNSKRRHRAALVSIGGSGTQGPDVATIPAIALENIEVLRDGAAAQYGSDAIAGVINFILKEDREGFKLTSQIGEFYAGDGEEWIVSANAGLPLGPDGFLNVSVEVSDAEKTDRSEQYCESWWCVEEQAAIDPVYAAGVESLFGGENVQPWGRPEAEALRTFFNAALPLGGGTELYSFGNYSESEATGNFFYRYPGNGVIEDVRLEDGSIYNPTEIYPGGFTPLFSGKVLDYSLVLGLKGESDKFAWDLSARNGQSEIQYSLANTLNPSMGPMSPTRFEPGNLINEETQIQADFSYLMEVGLASEMVFGFGLSYLEESYEIEEGEPASYETGPYVQSDPYDFCLEDMSGPTAAGAGIADLDCTDADDPVYRQVVDGSNGFPGYSPEFSGIYERDSYAVYLDLSTDITEKLFVQGAVRFEDYSDFDSELIYKVAARYALSDAVGIRGSFGTGFRAPTPGQQGTTNVSTRLPNGIPVATALSPPSSPLAQALGATPLEPETSTNYTAGVTATIGAFDVTLDFYRIELQDRVNAISTISIVDDCDEETGGIQTDCLGFRDNLIDAGAVGAETIDAAFYFTNAFDTITEGFDLVVTTDKDWGTYGSTDFTLSANYNETEFDGEVDELFNDESQYDFVNDEPNWRGVFTAKHEVGDISGLLRLNYWGPYDNSNGSTAPLTFQEFDPELFVDAELSLDVNDTTRFSVGARNLFDNYPDEGELGETCCGRIYRSDSVVDWQGGYYYAKATLTF

SEQ ID NO: 14900 - protein, 623 aa, Burkholderia xenovorans
MRTFTTSLIAALAILPGTAHAEEADADSIVVTATRTETKLSEVGKSISVIDAATIEQRQTVPLADLLRTLPGVTIQRNGGLGTITSVFIRGAQSDQTVALIDGIKLNDPSAPGGGFNFADLLTDNLERIEVLRGPQSVLWGSQAIGGVINLITREPTDRFEVRATGEYGRYETGRLSGAVSGKVGPTAISAGAGYLTTDGISVADSGTEKDGYHLFGAHLKTTTELTEQLSLDLRGFYTKSKVDLDGFPAPNYTLADTDEYQRQQQIVGYAGLNANLFDGRFRNRFAAAFTRIDRDSYDPAAAPVKNFDARGRNLRFEYQGIAELGLVRATFGAEHQEEKLRTISAYFGPPVTARAKANIDSAYLDLHARPIEGLNLGAGVRYDDHSQFGDATTASADLAYSPNGGSTTLRASYGEGFKAPSLYQLYGDYGFRDLRPEKAKGWDAGIAQKLISEAVELRATWFQRNTTNLIDFDLGTFTYANIARARARGVEAELRIAPTSELLFTANYSFTNARNRERTDPNFGRQLARRPRQTVNVTGDYRWPFGLTTGATITHVSRSFDDAANRNRLGDYVLVDLRAALPLTEAIELYGRIENLFDERYQTAAGYGQLGRAATAGVRFRY

SEQ ID NO: 14901 - protein, 568 aa, Burkholderia xenovorans
MNAKVNRLALGMGVMLAALAGQAQAQPPAPSENATINLIRLLVQQGVLKKEQADALVRQAEAEAQQAQQARQAVAPAAAVAAVPGEVRVPYIPQVVRDQIRDEVKAEVMTQAKAENWAQPNAFPDWASRISFDGDVRLRYESRSFGNGNSNQITDFAELNDDGPYDVNPNTSAGLPPLLNTREDRDSLLRLRARFGLKAALSESWSAGIRIGTGSDNNPVSTTQTLGGGFGKKDLWLDQGYLTWKPSERLSLTGGRIANPFLSTDLLYSNDLNFDGVAAIFNQPLSRDVALFGTVGAFPVEYSSDTASSNGFDKEDSDNKWLYGAQLGATWKINPQHSLTGALAYYRFDDIEGRRSSPCRPWAGDPECDTDGSRPTFMQKGNTVFLLRDIVPNPADPANTPNPQYVGLASEFNLLDLNLGWDAELPNDFKLRVAGNYVHNLGYDEGDMRKRAGGVAQIANNLGSDGDIKSGANAWMLQFTLGNALDMRDAGDWQVFAAYKYIQPDALPDGFNDSTFHLGGTNAKGYILGASYGFDKRVYGTARWLSSDEVYGAPFSIDVLQLEVNTRF

SEQ ID NO: 14902 - protein, 945 aa, Burkholderia xenovorans
MRFLTLKIMLCLLLSLIISRIEANTNNYSISGRISDERTGSPLPGASILIKGTYLWAVSDQKGEFTIQGIQEGKYQLEVSFLGYVPATVPVNVNNSIKGLKIQLKENTLALNDVIVTAQAPKSELNTTLNIGSNALEHLQISNVSDISALLPGGKTKVPDLTSNNIFSLRDGGSSAGNAAFGTAIEVDGVRIGNNSSFGNMTGIDTRSISVADIESVEVITGVPSAEYGDLNSGMVKIHTKKGKTPWNVLLSINPRTEQVSFSKGLDLGNDKGIVNISGEWIKATQKLNSPYTSYTRRGFSAGYSNTFRKVLRFDIGLTGNIGGMNTKDDPDAYTGEYTKVRDNVFRANTSLAWLLNKSWITNLKLDASVYYNDNKSHAHTPYSYASEQPAVHAEQEGYFIAGKLPYHFFADQIVDSKELDYAASLKYEWNRRFKNVTSNLKAGVQWKGTGNVGDGEYYQNPSLAPNGYRPRSYSAYPYMHNVSLYAEESLSVAVGSTMLRLMAGLRWENLFISGTQYDKLNTLSPRFNARWQLNENIAIRGGWGVTEKLPSYYVLYPRQEYRDIQTFGVSYNNNESAYVYYSQPYTLLHNEKLRWQKNQNAEIGVDINVARTRISLVGYFNRTKMPYKYTSTYTPFAYNVLQLPEGFELSANPQITVDNQTGMGYIRDDEDSYWTPLDVKVKDQTFVRSTSPDNGPDITRRGAEMIIDFPEITPLRTQFRVDAAYTYSKYIDNSLSYYYQNGWSHTTLANRSYQYVGIYANGDNSSTTANGKRTHSLDANITAITRIPKARLIISCKLEASLIKRSQNLSEYNGTSYAFNVSENSNEKTGGSIYDGNSYTAIYPVAYLDLNNEVHPFTAAEAENPDFAHLIRKSGNAYTFAADGYDPYFSANISITKEIGDHVSLSFNAINFTNSRAYVKSYATGTSAIFTPNFYYGLTCRIKL

SEQ ID NO: 14903 - protein, 211 aa, Burkholderia xenovorans
MKKITLALLAVASLVPTAASAHEAGDYIFRAGTATVRPNAGSDDVLGNGSFKVDNNTQLGLTFSYLITDNIGVELLAATPFNHKVGLAGVGTIADVKQLPPTLMAQYYFRDKQDKLRPYLGIGLNYTKFFDEKFNSTGSDIGLTNLSVKDSWGVAGQAGMDYMVSENWMLNMSVWWMNIESDVKFNLAGEEHSINTRLDPWVFMFGAGYRF

SEQ ID NO: 14904 - protein, 377 aa, Burkholderia xenovorans
MKKSLIVVAVAASFASVAHAQSSVTLYGLLDAGLTYTSNVNHNAKWAAGSGGINQSMFGLRGSEDLGGGLKAIFTLESGFNINNGKFANNNGMFNRQAFVGLSSAQFGTVTLGRQYDAAQDYLAPLTATGSWGGTYFAHPFNNDNLNTNGGYAVNNSVKYSSANYAGFTFGGTYGFSNQAGAFANNREYSVGAAYQWQGLHLGAAYAQQNNPGAGNTGASDGSYVNALAGNVGNFRQREFGVAGSYAFGPATVGLAWTQSRSDNFVGGQQSLRANNYEVNGKYNLTPALGLGVAYTFTDGKGYGVGANGGSESVRYHQIGVQADYSLSRRTDVYAQAVYQHAMGDGGVASIYSGDNTQLPSSSKNQTAATVGLRHRF

SEQ ID NO: 14905 - protein, 775 aa, Burkholderia xenovorans
MKKLNCRPLLTGTSALALAAVFAPLSFAQVEDQPAEAEAEQSDLKLNQIVVTATRRATDLQDTAVAVTSVDAEFMAEARVENIGDITAVSPSVTFRNTSNPATSANLQIRGIGTTGANRAFEGAVGVFVDGVYRTRPGAALQNFLDVGSLQVLRGPQGTLFGKNTSAGAILLESSTPVIGETGGDYSLSIGNYEAVTGQVTVNAPIGDKAALRLSGISANRSGFFENPNTGEDYNERRGMGLKGQFLYEPTDTLRLRIIADHSRSDENCCFGTVDAIPGPVQDVVDQIIRDRGQVPTSRRKDEYQSVLNIPPRQVVEDTGYTVKADWDVGPGKLSSVTALRQYKVDQMTDADFSGADLLTLKEKFKSNFFSQEFSYSGDHRFGAEGSADYVAGIFYSDEKINSNRTAWWGEDLQEVYSFTLPPTLVFDASAGLRSVEVIEGNNQSFAVFGQWDGRLNENWGLTAGLRWSQEEKQGQFENLYYRPNPLDVYKVLGVQPAPHFNTSKTDEAFSGTLGVQYHVNEDAMLYASYNRGFKAGGVNLDANAAGGFRQNPDFFPGAVPGDPTYDPEYVNAYELGLKTEFWASRARANFSAFYNDMTDLQVARFVGTQFQVLNSATAEVYGAEVESAFELTEDFSLDAAVTWLSQAELGEDPTLGPVLSGRRFAIAPELSGSIALRMDKPVTDSLSLVGRVQTQYSGGYYTGNSDFSEQGGYALTNLNFGIKSVDGWTLEAWLLNAFDKRYVTNHFSTTLQSGDVNAYMSAPRTFGVTLRGSF

SEQ ID NO: 14906 - protein, 1004 aa, Burkholderia xenovorans
MYKTFTRFILVFFLALGMSSPHTLYAQGGKTVTGTVTDPGGMPLPGVTVQEKGTTNGVATDFDGNFSIDVASNDAVLVFSYVGMTSVEQTVGSQNAFTITMESNEESLDEVVLIGYGSQERKAVSTAVSKVETEDFNQGQVSSPVELIQGKVAGLQITRAGGNNPNGGTAIQLRGVTSITGSTSPLIVIDGIPGGNLDLLQQNDIESFDVLKDGAAAAIYGTRGTNGVILITTKKGKKGKSTFNYSSFVSRDYVNRKPDFLSAEQFRAAIADGIIGENNDLGASTDIFDALVNESNLTQYHNFVASGGNETSNYRASLYYKDSEGIALENSREQFGIRASFNQTGLDDKLTFSSSAVVNINDANLLGGGQFGIVTDWNPTAPIFAPFNTSEEGVLYNEGRYGYYQPENGYNPFSEYANRFNQRKQLTFSGDAKLSYEITKGLIASVFGSYQRNSWDDRYYRSTQDYQQYNSGSPYFGTGYAYKGSHLDFTQTVEPTITYSTEIAEHSFELLGGYSYQYSATENYSMDNSGFTTDGFEDWNFGAGNAITDIDLPRPNMSSFKEDNTLIAYFTRLSYNYLDRYFLQASVRHEGSSRFGANNKWASFPAISGAWLISDENFMEGASWVNNLKLRAGFGVTGNQGIPNYQSIVTLGTGGKYPVFLDGADGATYYQTYGPVKNPNPDLKWETKKEFNIGLDFGFWFNKLSGSIDYYTRRTEDLLLSYDVPQPPFVQGSIYTNVGNITNNGLELALSYRVFDEGDFKWNVDFVGSYQNNELTTLSNQIFSVSELFGGNIGNPGNLGSAIRNTEGGPIGNFYGKRFVGFTVDGKWLFHKADGTIGRASDMTEEDKAIIGNGLPKYYASLTNTFKYKNFDLTILLRGKFKYDILNTVDLFYGNPSLLPGNVLTSALGQYSNITEAPQYSDYYLENGNFIKLDNLTLGYNFNLGENSPFSALRLFGSARNLATFTGYTGRDPEVQDTGLYPGIDTRNFYPRTVTVTAGVNVNF

SEQ ID NO: 14907 - protein, 391 aa, Burkholderia xenovorans
MKRIATICAISGVLATSGSVHAQSSVTLYGLIDAGLMYTNNVSKSGSHGALVQATSGNINGSRFGMRGAEDLGGGLKAIFVLENGFNVQNGKLGQDGRMFGRQAYVGLSATQFGAVTLGRQYDSLVDFVAPLSATAGTFGDTGFAHPFDNDNLNHSVRINNAVKYTSVNYAGLTFGGMYAFSNNTSFAVNRAYSAGVSYAFGPLTAAAGYLQINGSTNTTSSSSGAVDIGESAANGSGGFNLGADVQRTVGAALNYKFGPAAVGFVYTHSQFQGTTSFGQTNVGNSGTMRFDNYELNAKYALTPAINLGIADTYTDGHVGNGSNTAYGSDPKWNQVNLQAVYLLSKRTDVYVEGMYQHVIGHNYVAFINTAGGASGTSNQVVATVGLRTRF

SEQ ID NO: 14908 - protein, 241 aa, Burkholderia xenovorans
MKLKQAVTGIAALACMTTAAHAQSAGSFYVTSGWFHLAPQSSSDPLKVTSIGGSPTNITEANTGAKLDSADTIGFTAGYFVTDHIATEFVIGVPPKFDLEGSGSLAQFGKLGQAKQWSPTLLFKYYFNAPTAAFRPYLGIGVSRVSFTDEKITNSAFEANVLHGPTTVTTDSSWEPVFNAGFTYAFTQHWFAGVSISYLPLSTTAKLNTAANTPVGTLNVQSETKIKLNPIVTYVNIGYRF

SEQ ID NO: 14909 - protein, 389 aa, Burkholderia xenovorans
MKKSLLALAALGAFAGVAHAQSSVTLYGIIDEGFNINTNSGGKHLYNLSSGVLQGSRFGLRGTEDLGGGLKAIFVLENGFDVNNGKLGQGGLMFGRQAYVGLSSQFGTVTLGRQYDSVVDYVGPLEAGDQWGGYIAAHPGDIDNFNNAYRTNNTVKYTSANYGGLTFGGTYSFGGIAGNVTSNQIWSLGAGYNNGPLVLGVGYLNARTPAAAGGLFNTGSTAAAPAAAVTSPIYAGFTSANTYQVIGAGGAYTFGAATIGATYSNIRFGNLGASYASPFKGQSATFNNAELNFKYQLTPALLVGAAYDYTRGAEINGNSRAQYHQGAVGVDYFLSKRTDVYVTGVYQHALGDTVTAGGAVVDATAGINGLSGSSNQNQFTARIGIRHKF

SEQ ID NO: 14910 - protein, 381 aa, Burkholderia xenovorans
MKKTLMVAALTGVCATAAHAQSSVTLYGLIDAGITYTNNQHGHSNWQETSGSVNGSRWGLRGSEDLGGGLKAIFTLENGFGINDGTLKQGGREFGRQAFVGLTSDQFGAVTLGRQYDSMVDYVGPLALTGTQYGGTQFAHPFDNDNLNNSFRVNNSVKYQSVNYGGFKFGALYGFSNQADGFANNRAYSAGASYNWGGLNVAAAYLQLNSNGATGAAAAFNSGGAVSSDNTFFAGRQQTWGAGANYAFGPATVGLVYSQTNLSSLAGIGAGASGQSGGIAFGNNSAHFQNFEANARYALTPAVSIAGSYTYTRASLAGTRPHWNQFNLQTAYALSKRTDVYLQGEYQQVNENAVVDADINGLGASGNNKQVAVTAGLRHRF

SEQ ID NO: 14911 - protein, 102 aa, Burkholderia xenovorans
QFVPAQNSKSAYTPAHLVSDGQGKITQVPAVAGKSGSDVYYAGLNYKNGGFFGNYALKYARHANEGRDAFFLFLLGSASDEAKGTDPLKNHQVHRLTGGYEE

SEQ ID NO: 14912 - protein, 428 aa, Burkholderia xenovorans
MKNWKTLLLGIAMIANTSFAAPQVVDKVAAVVNNGVVLESDVDGLMQSVKLNAAQARQQLPDDATLRHQIMERLIMDQIILQMGQKMGVKISDEQLDQAIANIAKQNNMTLDQMRSRLAYDGLNYNTYRNQIRKEMIISEVRNNEVRRRITILPQEVESLAQQVGNQNDASTELNLSHILIPLPENPTSDQVNEAESQARAIVDQARNGADFGKLAIAHSADQQALNGGQMGWGRIQELPGIFAQALSTAKKGDIVGPIRSGVGFHILKVNDLRGESKNISVTEVHARHILLKPSPIMTDEQARVKLEQIAADIKSGKTTFAAAAKEFSQDPGSANQGGDLGWATPDIFDPAFRDALTRLNKGQMSAPVHSSFGWHLIELLDTRNVDKTDAAQKDRAYRMLMNRKFSEEAASWMQEQRASAYVKILSN

SEQ ID NO: 14913 - protein, 805 aa, Burkholderia xenovorans
MNKFYFKIFCIACIAFCLALSQQGQAQTKKVYTQDELKKMPKDSVLKILAAMELEDLINLQFDDADLKKYLDQVLNVDIQTSDRVKTQKSDRVPATVITISDDLILKRGYISIWDVLKDLPDFKLEFGATQEAFNIATMRGLEGMSKFIILMDGIRISSPTNERVPLLANYPVHLAKQIEVVYGPASALYGADAFAGVINIITKKAEDINGAEALLATGMYGQYNGGLTIGKKLNDKISFTLSGHYSYDQQPNLSNFYNRNGEFDGLESLRTGVFNTAFGTRTISTDGLHPEYQMPLSTYAIHAAVQIGGLRISGFRNQSKTPTATAQTPDNGLYNASAFATNRITVGSAVYEKKFGKLTSTSMLIASRYDFQPESGFQNLFTNMQRTYKFAYGRMYKIEQLIQWSASDQLSVIGGATYENFFSYPKGHDMEEPSFNFFDPSGVFAGTITANRPAGLPVQIDQLRYANVGGFLQVEYSPIEKYPLLLTLGGRYDYNTRYDPVVNPRFGVVWQPAPKTTVKAMHGWAYLAPSPLQAYEQFGSFSTADGGATFSSSFFRLPNPKLQPQTIKSSELHLKTYLSESFSVSLTGHHSVADNLFTTSTDVNRPEISRFGGEYLGWPVSTIEVRVNEGRQTIYGGTLQLDYFKDFGMLLRGNPISGQVRAYIAASLIDGSVDPDAGGPQDAIQIAYIAPFSLKTGFDFTLGRLFLGVRAQHYNEQRVPNVTANDANIRQTLDGYTVLNLNLGYQFSHLVRFFVNIDNLTDARYRNIVVGAAPDTGTVGSSGEFAFGAPQNPLRVSGGLRLKF

SEQ ID NO: 14914 - protein, 208 aa, Burkholderia xenovorans
MKKTFATALFTVASAATLAPSAAQASNESTPPLNPRVSVELAVPIDYEITQTPSAEREDGPIGLGLRAGLPFAQHWTAEAAALALVDGEVDGSTPSMKWQMDIDTLALQFGVGGHYPLFKKIEGYAKAGAMYWESRTEATKIFPQFGGLSSSGKFKEQGFEPYYEVGFSYRLPSNLNLSIGYSRWTQSDIFPGTDLKSQNLVLRLNLP

SEQ ID NO: 14915 - protein, 879 aa, Burkholderia xenovorans
MKHSLRAYLMACAVGVSGLMMGPHAAAQEPAVTENEDEAASIQEKIVVTGARGRPRTIADSAVPIDVLSSDEIIDVPFTDANDILKTLVPSYSLARQPISDGGTFIRPASLRGMPTDKTLVLVNSKRRHRAALVSIGGSGTQGPDIATIPAIALKSVEVLRDGAAAQYGSDAIAGVINFILKDAPDGAMLTAEMGQYYEGDGFQTTFAANFGAALGEAGFFNLSGEASDQSSTHRGVQYCEDYFCLDPTDPRYSAPSDAYYEAMIANSQEFHGISDAQQWGQPNADAIRMFLNTGYELSPNASLYAFGNYSKSSADGTFFYRYPGNGTIEDLREADGSIYSPLEKFPGGFAPRFIGDVIDYSFVGGLKGEIWDGFTYDLSGRLGNSKVKYTLTNTINPSMGPDSPTEFQPGDLINEEIQFQADFGKEFELGLAEPVLFAFGLSYLDETYEIVQGAENSYAAGPYAVSDPWGLCTGEDEAAVPTAAGALVIANGSTLNCADSDDPVYQIVGVGANGFPGYSPEFSGEYARDSFAAYADVSADITDRLFLQGAVRFEDYSDFDSEVVGKVAGRFNLTDAIALRGSLGTGFRAPSPGQQGTTNVSTRLPDGVPVATGLFPAGGPIAAALGAEPLAPEKSVNYTLGATGSFDAFSLSIDYYRIDLEDRINAISTQTVSTNPGAGPSYDNYLSLVEAGVVGAETIGGVFYFQNLFDTKTEGVDVVATYALGWANGASTSLTGSVNYNKTEFDGDVPSVFNAESQYDFLEGTPKWRGVFTAKHETGPFSLLARANYYGSSTNSNNSGLNGALEYQEFDPVIQVDLEATYTFDEMYRISLGARNIFDQYPDESTLRGDSCCGRLYLSDSVVDWQGGYYYLKGVVEF

SEQ ID NO: 14916 - protein, 309 aa, Burkholderia xenovorans
MITRISITLFLIFISCVYFFITYISNDTHIEQVQPLKLETDNNESVIRSEEVTEKEILINDLKYQELESSPIKQPSILQVANQKNMWSRIADQAEPTKEKSKKLDFYVSANGGKVYHDNSETFVKGIQEIGKRVLTLVESHYGFIIKNIVANEIKSIQQFDGKIDFQWLNSISLGYYAGENGRVDFETMYSRANIENSNSPLVFDKSASIFAFLLNFYYNPSVQDIQFAPYIGLGIGPTVFRLKRISGSPQNSMPLNVPWFAYQIKLGVDYSIIPEVKTFLGYRYFSVPIPVADDISTHNIEIGLIFNF

SEQ ID NO: 14917 - protein, 186 aa, Burkholderia xenovorans
MMKKSLLVLAIGALCSLTASANFYVQGDLGVAKTKFSSYSEMNKTNIVPNVSVGYDLGAMRLALDYTHYGKFSGTSYFGVNQKEHVSTKIYGLGLSAFYDFNINSVLKPYVGMRLASNIFDIENKGSNFFRSEKTTKLGYGFIAGAQYGLMTNLFVNGGIEYNRLGRFSDTSVNQYGAKVGLRYDF

SEQ ID NO: 14918 - protein, 797 aa, Burkholderia xenovorans
MKRFLLPALLSALMIAEVHAESFTVSDIRVNGLQRVSAGSVFAALPLNVGETIDDQALVQATRSLFKTGFFQDIQLGRDGNVLVVTVVERPSISSIEIEGNKAISKEDLLKGLKQSGLAEGEIFQRATLEGVRNELQRQYVAQGRYSAEINAEVIPQPRNRVALKININEGTVAAISHINVVGNTVFSEEDLTDLFELKTTNWLSFFKNDDKYAREKLSGDLERLRSYYLDRGYINMDIASTQVSITPDKKHVYITVNINEGEKYTIRDVKLTGDLKVPEEEVKRLLLVQKGQVFSRKVMTTTSDLITRRLGNEGYTFANVNGVPEAHDDDKTVSVTFVVDPGKRAYVNRINFRGNTKTEDEVLRREMRQMEGGWASTYLIDQSKARLERLGYFKEVNVETPAVPGTDDQVDVNYSVEEQPSGSITASVGFAQSAGLILGGSISQNNFLGTGNKVSIGLTRSEYQTRYNFGFVDPYWTVDGVSLGYNAFYRKTDYDELDVDVASYSVNSLGAGMSIGYPISETSRLTYGLSVQRDQIDTGRYTVDEIYDFLDKEGDNFTNFKASIGWSESTLNKGVLATRGHSQSLTLETTLPGSDLSFYKIDYRGQVFAPLTDNYTMRFHTELGYGDGYGSTERLPFYENYYAGGFNSVRGFKDSTLGPRSTPSVARNPDGTPMKNQGPDSKGRYTDPDQDPEAFGGNILITGGAELLFPLPFVKDQRQLRTVLFWDVGSTFDTDCPTKTTTNCDGIKTDNLASSVGVGLTWITALGPLSFSLATPIKKPDNAETQVFQFSLGQTF

SEQ ID NO: 14919 - protein, 725 aa, Burkholderia xenovorans
MKTYSYLFLIISLFLSLTIMADEGLSLREIYVITDVVTPGEITSGESISSSRLNQQFKQDTSSLLEYFTGIDNAANGSMSSIPYMQGLNDDRIRISVDGVDLNSACTSHTDTDLSFIDINDVDFIKVFAGITPVSMGGDSIAGSIKIKTKKPTFSQDDQLIYSTNIKSFYKSNNDEQGVHFKSSVASGNAYFKYSGSYSQSNNYSSADDFKVANYGGSSDKSGIRDDEIASSGYQIENHQLSYGYQLDNHLLEIKFDYQSIPYQGFMNQRMDVVGQHTHKIHLYDTISYAWGKLELQAYHHQVETKMNFGKNKNFNYSGTPGMSMTHHGFTTGFNAVSDIYLNDKSTLRSGLETQFYEVDDSWDPTGGMMSPNVMKNINDGKRDRYSIFTELDLQWSKEWFTQSGIRLTQVEMDTNDVQGYNNMGYAADANSFNALNHKKDDTHLDLSLSAAYSPNLNQTHEFGYSIKNRSPTLQERYLWSNNAMAASMANWFGDGNGYVGDVNLDKETAHTFAYAAVFHDADKQLWNLHFKSYLTYIDDYIDAVSYTSRADGFRTLTLGNQNARLWGFDVKTSQYLGNIAKIGDFYFDSKLSHVKGVNTDANDDLYHVMPTNLKLIFSQKINHWNNGIYIQLVDSKKNVNDIRQEMKTSGYALVDFKSTYQKENLQLNLGIYNLFDRDYDHPLGGVYMGQGKTMNTTGMGLTYANAVNVPGMGRSIFTSIEYSF

SEQ ID NO: 14920 - protein, 750 aa, Burkholderia xenovorans
MKRYNKKLSYLALAIASALTTNIALAEEANESTSAQDNSGLERIEVTARKTVETLQNVPVAVTSIGAEQLEQNGISVMTEVQQFSPNTTLQSSRGTNSTLTAFIRGVGQEDPLWGYEPGVGIYVDDVYIARPQGAVLDILDVERIEVLRGPQGSLYGKNTIGGAIKYVTKKMSGDAEFDIKATFGNYARQDYKVAGAVPVVDDKLYVGFALASLSRDGYGEFLQSGLPGQDLENYNKDVFAGRVTVEFTPTDDWFFRFNYDNTQDDSNAKGGYRLLPSIVTDAPIPDSVYDSYTSLPTKNVVENEGWSLTAEYYINDYWSLKSVTAARENYSPTNIDFDNTPLQIFDVPAIYDDEQFSQEIQLNYNGDNLSFVSGLYYFDGESCGHYDAIIFQSLTAEKSGCNNSESYAVYAQGSYNLTEKLSFTLGARYTEEEKYANVNDDLRFSIEYPESNWIPGYTRGDLPVTEVLNGNKTWSRFTPKVGVEYQVDEDMMVFASYSQGFKSGTFNPRASTNEPAVNPEIVDSVELGIKSEWFNQLRVNATVFALEHKDRQYKSVVPNEDPTVLDSRLGNIGQSEAIGLELEVEYAATESLSFNFALGYIDSEFTEVLSWNGNGYDDISDIYTVANTPDTTANFGVTYDIETSVGTFVINSNYYYRDDYALVELDNRLTQDAYGLLNLGINWYSNEGDWTAALHWKNITDEEYMVGAYDFTGGQDEEGNWLPGFGGDTTLIAYYGDPTTISLTIGYQF

SEQ ID NO: 14921 - protein, 900 aa, Burkholderia xenovorans
MKQRALALAIRKMLWAELALSAAIAAPAFAQSQPAPTGSTAATTTSEAAPAATDTGNVTKMQRVEVTGSLIRTSDKVGNTEVQTITPKEIEQSGYTTVADFLRGTSANSGSSWGQTTMNSSAQGGGGIALRGLSEKYTLVLVDGQRVANYGKAVNFTDTFFDVNSIPLNMVDHIDIVKTGAVSVYGSDAIAGVVNIITKKNFQGLQIDGQLGKAQHPGDAQGNFGVLGGFGDLNADRFNVTAAASYYRDSGSSLADRSMTANQDFSQFPGGLAGPLGPNQQSYWTAPDGTQTALSPCPPGSVSANGGATCKSNPASATSLVPSTTRLNAKVHGTFKINDDVQAYADLWVSRNETVQNEGPAVLASTTNAFNPATGSALPLSRTVPGSNPYNPFGAPAQINYTFPNTVSADTVSTFWRATTGVKGSFTTQKFGDWDWSADYGHSQSTVDTTYRNALNVAGVENILQNGVYDFSNPSATPNGLNGVFQNDYEQAISKLDSVTAKTSTGNLFNLPGGPVGVGFGTEFRHESSLINSRTYSALGITAPANVQTVDGERNVAAVYYQIDIPIIRNLTFTQAGRYDHYSDFGGAFSPSFALRFQPVQALTTFASYSRGFRAPTLVENSQATYLAHQNLVDPNDPSGVPTKHFTTEQVNGNPNLGPERTKNYNIGFQLSPDSSTDIGAAFYKIHIDGVIGTNDPNAVINANDPSTVIRNADGTVAYIKEQFVNLGSLDTDGFDMNFRKSVGTKYGTFTLAGDWAYVWHFKLNSPGAPTQDFAGNNLALLQPFGASNPRWKGNTSLSWDYRKFTTTLTWQYTGPYTNAVADEFGDGGTLSVASYSQFNLMATYRGFKHWTIYGGINNIFDRKPPFDVEWQATPDITGYDQSLYTNIGRFFQVGATYRF

SEQ ID NO: 14922 - protein, 383 aa, Burkholderia xenovorans
MKKALLAAALMTAGVVAHAQSSVTLYGRLDAGIEYMTGVPQGSNAAGSATGSTNRWRAESGDWGTSLWGLKGVEDIGGGNKVLFQLEGSFNTMTGAGPGGGGLFNRWATVGLSNDAYGTFTMGRMLYISNGVWDFDPFGQSNWSSASLVRGRNWPQSSNNFAYQSPKIAGFDFYGQYALSNATSWNGNGTTAQGREAGAQVTYTNSLFQVRGLYDEIRNPANGVLYGPSASTVNPGNIGSGVFAASREYSALLNVFLGQFKIQAAYQAVRSAGAQNVLPGQPTTLDHEWGGVTWQATPAAALIAAVYHVNGNNGAGNATIYTVGGSYNLSKRTLLDIQVATTQNSKTANYGLNANNAGTSTSTDNPLPGHSQTGVYAGIQHSF

SEQ ID NO: 14923 - protein, 785 aa, Burkholderia xenovorans
MTKKLEVQLYSSISHLALSAGLAVSLAAIAQPASAQSSQTSSAIALDTINVQGEGGAPSSGEGAYNVTMASSPRQTAPLLDTPQTVTVVPQAVIRQTGARNLTEVLRTTPGISFEGGENGFGTSSNTFQMRGFDASGSLFIDNVRSNGSYTRDIFNVDRVEVFKGAAADNGRGNAGGYINMVTKLPSLQNFTQFDTFSGFSEYGNQPQKRGTVDLNYIVAPNTAVRFNALLEQSGIPGRDLAENKAWGVAPSVALGLGTDFRTFLAFEHLSRRDRPDWGVPGATVPGLVTYNPATMGVRRNAFYGLRSDFDNVDADRVLGRFEYDITRRITISNQTVWAQVDRTTRFTQPTGFTAPATAATSTTFYGRRNQTVSNITNMTIDVDTGPFNHKIATGLEFNHETSDANRFGSISSTTNPALLANLFDPNPDRAGPAPFNPTENNRASVSTAAAYFYDTIKLSEQWQITGGLRAEHYKVDINSRTVAGAPTGLGNFNDTRTTLNGKVGLVYKPVRNASIYGSFGVSHLPPGSYLSNEDISRTGDNAFPGLVQGADPVRFHNYELGSKVDFFNKRLMVAAALFRTEKVNAPITGIDPSIPGDVVGLKGYGKQIVQGVELSVTGALTENWNVFGGAAFMDSRREHSAYLDLVRRTANPGDFTANAGNGPWTSTNGDALAFTPRATANLWTTYHVPATNLTIGGGIRYVGTSYLGRPDTASRIIPNGRFGQLPAYTVVDLMASYELHKDVIVRFNIDNVADNRYAMSTNWSGVRALLGPSRNYRVSTSFRF

SEQ ID NO: 14924 - protein, 896 aa, Burkholderia xenovorans
MLSNSVIAKAIRFSLISGAATAALTAPAVFAATDDEKVERIEVTGSRIKRTDMETATPVTVLSADDMAKQGFTNIQDALESLTSTTSAMTTQSVHGFTPAASSISLRGAGPSRTLTLINGKRLNQYPKPANGTDNFVDTANLPMEAVQRIEILQTGGSAVYGADAVGGVINIILKKDFEGIALKYRHGDTFEGGGASDRIALSVGASSDRGNVSSFIEFTDNQQLKATDRENFGLHTDKVPHSEFSQYSSYGARIAGGSGARALTDAECTAGGFFWDAARNLCGYDRSKWRDLQPESTRFISSTNFNYELSDDISFVGRLDFAEAKSTTRIEPMAINDYNIKVDGNSLTVSNGDLSKTFADKTTALGGDFANATDGDYYYVRRLHEFSNRMGETKTRNYFFTAGLEGVVFEDYNWDASVNYGRTNVDVFRGGYATVAGMFDYITAGDNGNSLLKNMTADDVEAASYSPFEKAQSTQKNVQANITGSAFEMPEGDALFAFGAEYTEQDYQTESDSESAKGNILTTGGSSGAGDRSFWATYAELSIPVLDVLTVDAAVRYDRYSDFGGNLSPQIAIEYRPLEELLVRGSVSSVFRAPDMHRVYGDATNGFNQVIDFKQCQAMGGTPGQPHSDTKINEICNELHITTKTGANKDLEAETGYTASIGAVWGGESLNASLDLWEWKLDDMVSDISASKAAREYEQYENMLTRDADGTITHIDAVAQNLAFQKVRGIDLSAGYNWDLNNLGELKLNFKGTYILLSEGQLAPTDPVEDDIDNGGLPQYRANLVLGWFIDDFETTLGAYHTARMHGMQYKSFKESAENAGTEFDESAHEVASQTKWNLTAGYTITDDIKVKAGVVNLFDAGPNFDPTATSWPHYQRSIYNARGREWFLEGEVKF

SEQ ID NO: 14925 - protein, 306 aa, Burkholderia xenovorans
MRYQMNDNLVLRGSYSTSFREPSLSQLSTSLVSLQGLQDFNADGTRNGSTAFIRVAVAHNPELEPETSTNTNLGAIWTPNDQTSLSVDYWSIDYENVITIENAQGKIIADPTDPDIKRISGTLVGVTTEYQNAENVEAEGIDIEGSYSFDTAWGEASVGFNTARILGYEIPNGSGGMKDVVGLFNHDNFARSMPETKSVISAKLSNGDHNFAAYIRMISDYETTRALDALATSRGFSQDIDSFTTLDLRYSYDMEVSGYDVKLSAGINNATDEEAPIVYDAANFSYDPKHHDPRGQMVFLGIKVTM

SEQ ID NO: 14926 - protein, 370 aa, Burkholderia xenovorans
MKKPPLLPLAVTLCAAFGNTSAMAQAASNVTISGVVDAYVGTRQLAGGLSQTKVDSSGLTTSQVNFSGTEDLGGGNRAEFVLGMFFRPDDGSQGRFNGDPYFARSSYVGLGGNWGTLRLGRISTGAFLNYIRTNSYGDSSVFGPGFLHTWIAAIGQGKQFLSGGAPAGNRALTGALGTTDSAWNNSLTYVSPSLGGAVLQLQWAPSEADGVGSRLGASAFYSNGPLTLGLATEQIGANAVPASGPAAAVINHQATWQMTGAYAFGFGRVSAGLINTQRDYTVVVDDRVRTVQLGVTIPVGAGTVMAQVANSTQTPDVGNEMTRTTTSVGYSYAFSKRTDVYAVLMNDRFTGQPDGNSVGFWCAPPLLSIA

SEQ ID NO: 14927 - protein, 389 aa, Burkholderia xenovorans
MKTKWIAMAVLAGVGGTAHAQSSVTLYGIINQALSWSSNQGGHSAVQLTGNGEYGSRWGLKGAEDLGGGYRAIFTLENGFNPVNGALGQNNRMFGRQAFVGLSHPQYGTLTFGRQYDAIVGTLQTMTSNGAWGGVMFSHPYDNDNTDDFLRVNNSVKYTSPNIRGFTGIAMYAFSNAAGDFANNRMWSLGGIYTKGPFAIAAAYSLYDRAGVNTTPNVNTNGAITCCDAPITSKREQIAGIGASYALGAAKFSVMYSNVIYNNVGTTLTSGINYRINNYEANVRYTISPTLLVGAAYTYTSNKITGGPQGPTQVHWHQVNLLVDEFISKRTSVYAEVIWMRTGGGVFARPTGGPIPATPDGAPAAQIQTMLPSTSRNQAVASIGIVHKF

SEQ ID NO: 14928 - protein, 679 aa, Burkholderia xenovorans
MEKRTLAIFAVSCNLFLSTSLFAQQQRVDTARTYYIPEITVSDIHQTREVRSTAPLQIFSKDALKNLNALQVSDAVKHFAGVTVKDYGGIGGLKTISIRSLGAQHTAVGYDGITLTDCQTGQIDLGRFSLDNVDQLSLSNGQSDNIFQPARFFASAGILNIQTLTPRFEDGKHTNISASFKTGSWGLVNPSLLLEQRISRKWTVSANGEWMSSDGHYPYTLYYGNEEGDLSSREKRKNTDVQTFRAEAGLYGNFSDKEQWRLKAYYFQSSRGLPNATTFYYTHSSQRLWDKNTFIQSQYKKEFNRQWVFQTSAKWNWSYQRYLDPDYKGSTGEIENSYYQQEYYLSGSMLYRLLNNLSFSLSSDGSINTMNANLNDFAHPTRYSWLTAFAGKYVNNWLTLSASALATVIYEQADKGGSAGNHRKLSPYVSASFKPFDKEEFRIRIFYKDIFRLPSFNDLYYGETGNNKLKPENARQYNIGLTYSKDVCPFLPYLSATVDAYYNKITDKIIAYPTKNLAVWSMRNLGSVEIKGIDVTGNVSLQPCEKLRINLSGNYTYQQALDVTNPDPASEEGRTYKHQIAYTPRVSGSGQVGIETSWVNLSYSFLFSGKRYTQGENITENRMESYSDHSISVGRELTIRKINTSIHIEVLNIANNNYEIIKNFPMPGRSVRATFSIKY

SEQ ID NO: 14929 - protein, 373 aa, Burkholderia xenovorans
MKNVGRLAAVAVPAALASLGCQLAQAQSSVTLYGVVDESVRYLTHANKAGDSSIGLGTGGMTQSRWGLKGVEDLGGGWSTFFKLENRIYVNTGQSDPTLPFFNEAQVGVRSDSYGQIILGRQYNVVIEGVTVAGYGSNSWIPYDFSFQPEITMTGGIWTSNQVQYQARYNGFTFAAGYAFGGNAGNSYGSQIGAAAAYKPEGGPLSVGGAYEVSKDSVNGAAAKTWTFGGAYTWNLTRFSAGYIVNQNDAGFSNFANGPFTAPVLAALKYTDFARRRMIMGGITQQVSNKWHFAANVWRTLQDGKTAAQDGSAWQYQLVADYNLSRRTDVYLEGDYSLYRGDLIGAQLQGVNSVGLAQKSSQIGLMAGIRHQF

SEQ ID NO: 14930 - protein, 1117 aa, Burkholderia xenovorans
MRKSKLHLLPLSSKRVLVSTSLIMLLSGSAWAVSSQETVENGDAITAVPQQRRTVKGIVKDANGEPIIGANVIVKGNKTIGVITNLNGEFSLEVPSNATLQISYIGYLNKEVKVSGNQVSFNIQLEEDSKTLDEVVVVGYGTQKKANLTGAVSSVDFEEQTKSRPITTVSSALAGLSPGLQASSGSAMPGEDNTTLRVRGNGTMNNASPLIIIDGMEGSLNAINPQDIENISILKDAASCAIYGARAANGVILVTTKSGDRDKIQVNYSGRISFNSPTRMIETMSNYADYMELMNESCENVGSGTLFDQKYIDLWREKSKDPNGVNENGVPNYIAYPNTNWLKELYSGGMIHEHNLSVSGGSNKIRFLLSARYQDNEGIVDNTANKTYSVRANIEANPTQWLTLGTRTYASQMDREVGDFSNANTFLRQSTAGTYPEWNGSFGYPECPDERATANNPLYKLARNDGFKRYNRFNTTLFSKVKFFKDLSWDFNFNYNRYIYETRQWGVPAYQTRFSDGVIVDGITPPSQLSTSFGYESNYSYTLENLLNYHHTFAQKHDVSALLGYQEFYKNYYTVDAAKKGLIDESLNQFDEATEMTSTKGATQDYATRSVFGRVNYAYNSRYLFEANFRYDGSSRFHKDHRWGFFPSLSGAWRISEESFMENTRTWLDNLKVRASWGKLGNSEIGNYEYMSVYSTTNAVFGNALNSALYMGAIANSLLKWESTTSVNFGIDVNLLKNRLSISADLYQKKTDGILYRPTIPYVFGTMTAPRQNLAKVSNKGVELSLGWRDNIGGVSYSINGNFSYNKSNIDAYNGTYERTWVEDPNNKLTGGKWEDNIGKVSSGGTTPIVEGRMMNEYYLRNVYHGNGSYYNADGSVNPQGGPKTGMIRTEKDMAWVKDMIAAGYEFQPGKTVAKNKIWYGDYIYADSNNNGVYGDDNDYTFQKTSNKPKYNFGFQASAAWKGFDLSMVWAGAAGFSIYWGATTGYNAASTEWGSTIAQRVAENHYFYNPENPDDPRTNINAKYPRMAYIDGYVQNRHGNTTLWLYKGDYIKLKNLSLGYTLPKNWVSKIAMQNARVYVSAENLLTITGFEGQDPESATGMGYSPFRTIAIGANITF

SEQ ID NO: 14931 - protein, 146 aa, Burkholderia xenovorans
GDRHVKKLDLAFVWDPDLTWWQIGDWHFSLIGEAHVAWWHTNEGNVHDNIGEVGVTPIIRFIKGSGSIRPYAELGAGIRLLSSPRISSTFTLGSAFQFADMAGVGMQFGSHQQYQAGYRFQHVSNGGIKEPNPGINFHQLYLQYNF

SEQ ID NO: 14932 - protein, 395 aa, Burkholderia xenovorans
MKASINRSAILILSAASLGTTAAHAQSSVTLYGVVDDSLAYVNNQQGHSNIYMRDGNLYASKFGLRGDEDLGGGTHAIFDLQAGFNLNTGAQAAAGTLFNRQAFVGLRNASYGTVTAGRQYTPYFLFVGPYASSSWLTGATGAHPGDIDGLDTTIRVNNSVTYTSPTFAGLTASAMYAFGGIAGATGKGNTFSAALRYANGPIGIAAGYLRINSSGSSAGFLNPATASSGSFAVSVLNQGYLSAKAVEQVAAAGNYTLGDLTMGLNYSNVKYLPGNGSAFTDTAVFNTYGALAAYRFTPTFSVAGAFAYTLASKANGVASAARYQQYSLKESYSLSKRTTLYALQAYTHSSGQTLGAQGAGHIVDAAPIVGDSQQLTPSTTHGQFVGMAGIAVTF

SEQ ID NO: 14933 - protein, 317 aa, Escherichia coli
MRAKLLGIVLTTPIAISSFASTETISFTPDNINADISLGTLSGKTKERVYLAEEGGRKVSQLDWKFNNAAIIKGAINWDLMPQISIGAAGWTTLGSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKMPYIGLTGSYRYEDFELGGTFKYSGWVEASDNDEHYDPGKRITYRSKVKDQNYYSVAVNAGYYVTPNAKVYVEGAWNRVTNKKGNTSLYDHNDNTSDYSKNGAGIENYNFITTAGLKYTF

SEQ ID NO: 14934 - protein, 180 aa, Wolbachia endosymbiont
VRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVG

SEQ ID NO: 14935 - protein, 866 aa, Algoriphagus sp. KK10202C
MEAKLNARNEAAKGQNVLRSAAEREAERAARNIIMNTIKTGGFVPHVAINPEITGANDNFDGIRFFKPILREAPNENIRKEIERTLNKVKENNSPLTLARKVQILETIKANDWHYNKDDIINIPVNPNKALPPVQVKPINVNPTIGYKSGFTVGNNYKKKYFHVRDNIIKEIDVTDNLIEAGRTFELQGIRAFRDKDLTLDQLHEKEILLKNLKEDIRTEVINGVDIVKAVENIQVPRHQKRNNYILYYDNVVDKSEEKNEYKKYLTQAEINAIKDGRGMVLAYQEKALMIKNDMEFLTHQFQNGNLTQQQYDDKMANLVVDKYGEESEYIRSPFKPQPGVTQVTYNVYEEELIKDAKRRAVIAYIDNIERANLINDIRLTIERADGTIENITTDKFGTGIEANPIIPDLSPNPVPVARVITRQGNVEAKEVIVLPENEAVQMLQAQIAELLREKGDLRTLILKLRGLQEQGQNQVQLQAQNQNQGENRRQDQEQTGSSESFKEAEAEELDKEEKAKEEFIILEAQHVDEARIEALEVATMQVAVKEDEKVVATIFNSTQDIYTVSKGTVSSRINSFTGVAAGDEDERVLDKGFWISGTYGISKQGTQKGFIGYRGHTSGGTIGFDIGSDNDKDLVGIAYTRLDSKFKSNGGKLNTNVDSHIVALYGQKELPKNFMIQGMFAYNHNIVKSKINRLGTIANGKYKNNNYNFESLLSYNYLISNKVSFTPNIGIRYGYIKDGTYQESGAGIQHLSIASKKQNIWSSIVGGNVSLAPQKIGAVSITPTIMASVENYFNNKNKKLAAKIKWKDREVTEIVALPKQPKIGYNIGANILAEKGNISVLVEYNCHLQKKYKSHQGFVKLKVKL

SEQ ID NO: 14936 - protein, 693 aa, Pseudoalteromonas atlantica
MNTHEPTAVRLLGALLAAAVSVPAGAAEEGDEHASSTSLSPVRIEAGGDPLGRGVASEALQRRQASSSAEIFRGEASAGVGGGSRNAQRLYLRGVESNNLNVTVDGARQGRDLHQHRGGLTGLDPDLLRAADLDPRPAADQGPGALGGSVRFETVDAQDLLDPDEETGARLRAGYASADEAERGSATAFGRLGGDWGALAHIGAVNRDDYRVGGGDTMPYSGGRDRDYLARISRVPASGHQLRLGVQRNTFEGDHHYGSWGSDFGDPSETTRQDPVGQEQRRDTWTAEHRYRPADPHVDWQARVYRNDNRLERQDDNTTTRAVEQGGDLRNTFTLDAGPTRHRLTAGFDYYTEDGRSDPHGGGSRLSHQSRNFGAFVQNRMAWERLRLSAGLRYDDYVTDLQEETLQGDAVSPNFSAEYDLTAGWTAFAGYGEAVSGAGILPIGWLAYIDDEETNLNDGEPFEAEESRRREGGLRYQGRDLITARDRFDFEATLFETRIKNSVERDDPWGTPHQHNLPPDRRHDAFWDEDAPLVGGVRNRPDPVRLRGYELRAAWGVGPYDARLSFLSAEAVDDDGDPVGVIRRLGGGGGDRLVFDQRWAAHETLTLGYTLTWVGDHTDVPDDEPERDGYQLHDVQAEWQPWADDRLTLALAVNNLFDEQYAEHTSLAVEENDEWQIRDEPGRDVRVTGTLRF

SEQ ID NO: 14937 - protein, 218 aa, Pseudoalteromonas atlantica
MHKISLIGLATMSMLAFNTSAFALGAASSNSGASGKHWSVVGGAALVQPKNGKNAAQNTVKFGGDVAPTLSVTYYINDNVGFELWGITKKLSYTAKTDASGKIGNVTQKTPLALSAQYHFGQAQNVFRPFVGVGYSQAKSRFTALGSTDRVNLGNFRGAIGTIGLDMNVDSNWFARLDARYTRFSNSNSKAALSSSLGLDQNRRLDPWSVGFGIGARF

SEQ ID NO: 14938 - protein, 201 aa, Pseudoalteromonas atlantica
MTHTLKAILLSSALAIVAGPVVAQSQGDWTVAFGFGNVNPKSGNGTLAGGEADIGDDTRPIFTVEYFIANNIGLELLVATPFEHDISIDGIGDAGSTKHLPPTLSLNYHFPTNSAWKPYVGAGLNYTVFFEEDSGLGDLELDNSFGFSLQAGLDYMISDAGAIRLNVRWFDIDADAELNGSKIGTAEIDPVLVGVSYVHRF

SEQ ID NO: 14939 - protein, 1079 aa, Pseudoalteromonas atlantica
MKHHDDAPERSGVNRKTALILLAGLFFFLSVMPARAQTTTTLYGTISDRSGAIIPGAQVTATNVGTNQSRTAQTNQEGQYRFEFMPIGGYTLEVSATGFKKVAQKGIALDVNVNARVDAILDVGTMTEEVNVTAAAATVNTDNAQIGRTVENTEITTLPIVGRNVYTLLQLTPGVSSTSNSIVLGFPEQRTMINGGVDGGAGSVNYYLDGGTNMTGLRNTGNIAPNPDAVEEFRVVTNSYSAEYGRFAGGVINIITRSGSNDVHGSLFEFFRNNDLNAYPWLSLTTSPLHRNQFGGTVGGPIRKNKTFFFGTYSGLRQIQSSFLNSAIVPTALERAGNFSQSKILPKDPNNGNAPFPGGIIPANRLDPAAQNILNKYIPQANLANNFWQGTIPSPYDTNEGLTKIDQSFNDRHRLTGSYYYTAGSNAISPGGNIPWSTENFTWRQQNVNVSDTFTLNASTVNQFWVTYTRNFGGRLNTPQTSLGDLGSTFNVQGPPALPQITVSGYFTLSQAIAGPVAGTNFYSVRDQVSTTHGRHTLKFGGEISLNKDIQQTLLNNYGVFSFTNAKTGNALADFVAGLPVSMNQDAPITAMDNSWSGALFVQDDFRIHPRVTLNLGLRYELQQPPTDPFNRESTFKLGVQSTVLKGSQVPTGLLVPGDPGVGRGIVPMQWGHVSPRLGLAWDPAGNGKTSIRAGAGIFYGSVSGNEWNSTSNYNPFAVRQTFPNVGTLSNPYSNQPGGVSPFPFTYDPNNPRFILPASIYGIAPDFRWPYTYQFNFSVQRQLVKDLTVTAAYVGSFAHRLPFAIDLNYPYYNSTATTSNVNTRRPIQPGTLSQIYSVQSVMQGSYNALQTTVEKRFARHFSAKGFFTWAKSLEDVQLDNNTVNGGAQDYRALNLERGRSDNDRRKVAVGSFIWRMDYFRNVNPFLRAIINDWELSGIVTLQSGLPFTVTTGTDVNLDGSSNDRANLVGDPFLDPNRSRNDVSNAWFNVAAFAKGANGTDGTAARNLMTGPGSKNVDMGIFRNIKLMERFTLQVRGEFTNVFNLVNLSNPNASLNSTAIGTIRSAAAMRGVQLGLRLTF

SEQ ID NO: 14940 - protein, 984 aa, Pseudoalteromonas atlantica
MSTPLAAQTAPAPQSASTVPGSSQADPATLDTVQVSGIRGSLTSSMNVKRDAQGIVDGIVAEDIGKFPDTNLAESLQRISGVSIDRSLGEGSRVTVRGVGPDFNLVLLNGRQMPGASIEESNASNSRAFDFANLASESISGIEVFKTSRASTPTGGIGATINIKTARPLDNPGMHANVGLKGVHDASNENLPGRLQGDWLTPEISGIFSNTSADGRFGVSLSGSYQERDFGYSQVGVPNGWRAFRGDSTAYGTIPQPGAPGSENIVNRPGPNDIYSVPQNLNDRVVGVERQRTNGQLTLQYKPLDNITATLDYTYSENKIQQQRNEMSVWFNYGPSASSWTQGPVSGPITYSEIVNPPTSDLATAGSNAATRNQNKSLGFNVDWAVSDQFKLNVDIHRSTAEAGADSPYGSSNSLGVSGFYRGTSVVDFSKDFPVLQQQLGFGLNGLDPSRTLVTGSAFRNSYMKSEIDQAQVNGDFTFENYSQLTFGIGSTEVKNRSAFSNVQRNTWGGNGTAADYPDDLWIPSSFAQYFDAIDGSGNPQQFNQLYLFDFERVRQAAAHAAGDESLYRISPVFTTDRRVIEKSKNAYLQWNNSWDDLRVPISLAAGVRYEETKVQAQALVPVAVGIDWVANNELPIRLSDSAFAGGSGKYKYWLPSLDLSFKLREDLVLRGSYGETIGRPGWGDIQGGQTLNQIGRIEGGSGQEGNPGLKPLLSHNIDLSLEWYYGEESYASVGFFRKNIDNYVGVTTRNDTSLGLHTPVGGAYWNQALANGCATAELTCIRNYIFRNFSGQPGVVRGTDDTNGNATGTISGQPGDPVANFSITAPANQRSASLDGWEFNVQHMFGQSGFGVSANYTKVNSGLTYDNYVIGEQFALEGLSDSANLVGFYDKDKWQVRAAYNWRDEFLAARFDGSGLPNPVYTEAYGQLDLSIGYQWTETLSLSLEAINLTNEIQRQHGRQKNEIIYATQTGPRYMLGLRYTFW

SEQ ID NO: 14941 - protein, 368 aa, Pseudoalteromonas atlantica
MNVLRSGIVTMLLLAAFSVQAACTWPAWEQFKKDYISQEGRVIDPSDARKITTSEGQSYGMFSALAANDRAAFDNILDWTQNNLAQGSLKERLPAWLWGKKENSKWEVLDSNSASDGDVWMAWSLLEAGRLWKEQRYTDIGSALLKRIAREEVVTVPGLGSMLLPGKVGFAEDNSWRFNPSYLPPTLAQYFTRFGAPWTTLRETNQRLLLETAPKGFSPDWVRYEKDKGWQLKAEKTLISSYDAIRVYMWVGMMPDSDPQKARMLNRFKPMATFTEKNGYPPEKVDVATGKAQGKGPVGFSAAMLPFLQNRDAQAVQRQRVADNFPGSDAYYNYVLTLFGQGWDQHRFRFSTKGELLPDWGQECANSH

SEQ ID NO: 14942 - protein, 210 aa, Pseudoalteromonas atlantica
MKNTHCLLLLASLLPVTMSAQAEVFVAPFGGYSLGGGQFDVNQIDVNADQTGDKKNVKVEESSHYGLMLGIGTNDPGNIYLLYSHQASELKSGGLFTPDRLTSLDLDYIHLGGTLYFPRGDIRPYVTASAGITRMLPDAWSSETRFSMGVGGGVEYQVTPHFGLFADIRGYATFIDSDSSLFCNEDECLWHITSDVMWQAQANLGLKVSF

SEQ ID NO: 14943 - protein, 941 aa, Pseudoalteromonas atlantica
MYSKKALSSAILAVILAQSAIAQEEPQEQIEEIVVQGIRGSLSKALDIKRNNIQIVDSIVAEDIGKFPDNNVVEALQRVTGVQTTGRGSGEVSTVSIRGLTDVHTTVNGRDIFTGAGRSVALQDIPASLLSNVMVYKTRSADQVERGIAGSIDIKTHRPFNFDGEKIVLAGRAIYGDQDGKTDPNISALFSNRWETSAGEFGALLNLSYVKTNYRDDTMTAGAVFPYFSANPHFAYSPYEMIPNNYNAEGVGDGSLIWQAGLENGLPYAPGSTLNIGGEAVDYLLMRDAVFGTSFTGKRERPAASVSFQWAPNDELEILAEGFYTGYKNSSQNAMWFSNTLEHGDGNIDIPVIYDGTVVVKEHQGRNNGGFQSGDYSYGETDSYLYALGAKWEPSDKLTINSELVYQDSKYTTDFFAMRFARTAYGLDVDYNNKDGLPSLHFWDNPATPSLDESDMAAIGNWTASTIWDNGGGNSGDSTAFTLDVEWHVDNGFINSVKAGGRYEVRGAQEFTRGQDSSSVAGISLTDLMDQLVANGAKGDGSGLIFTVNDYFDGRADIFDSFITADGSYLLDNADAVRAVYGLEKENVYKTFDIEETSAALYLTSKFSLGDDISGELGVRYVSYEQDMQFWSETSAQSNQYNYSEGKGDASKVLPSLVVNWNVTDDVVARASYTQTLRMPNFADLNALQYWFDPVTSIPYGTGNGGNPDLQPTESTNYDLSLEWYFAEGSSLYGAWFKREIDGLVIAGRKTVTRTGDDGVTRPYVLSAPVNAANGELSGLEIGFVHFPDYLPNALDGLGIQASFTLLDSSQSTPEFDTDGNISRYVDSKMAGVSDSSYSVVLAYDKDAFEARLSYVWREEFYTGNEAAIFANPIQFWSRPERSLDFQLSYDVLDNLTLTFDATNLLDDVYQSYYGKGNQNLFNFGNAVYSKTYALGARYSF

SEQ ID NO: 14944 - protein, 638 aa, Pseudoalteromonas atlantica
MDKTLLAGAISLSLVTLPVQVLAFTPNVVGITVNDEVVIHGIQNVRDGGVINNGLVSDNAAITVTNGSSAGTANNTTVGDKGWLQITGALATGTIVNQGGLLDTKTAGTVIDSQINDGGHMTLGLNSQSKGYLNIAAGAELFVTNNDPYTSDVTTHNPALPANVMIENLNVAGLVEIGPSWKGTSIVPLPLSDVLGPVLVTRINNVTLQGGDINLMAYSAGGQFNRLEIENLSGQGNFAMTTQLASNTGDFITVSQQATGQFGITVQDSGKEPQSADNLALVHINRGDAQFRLLNTGGVVDLGVYQYGLYSQESNGSTDWYLATSTEELPGTTPNVTAPMLSSAAQGVLNMAAAPRHILNAELSTLRQRQGELKADAEGTVGVWARYLTDDSRLSDNKNIAFKNTLSGMEIGADKQLGLNRGNMLIGAFTSYSSSDVKSTHGANGDIRSYGGGVYLTYLDQSGFYVDTVLKANRFNNKMNTQETRGEYNQNALTTSVESGYQWPVYANLVLEPYGKVSYSRIGSADYTLSNGMVAEVAKADSVQGELGTVLAASYSINQMTIKPYIKLAITREFTKSNAVAINNIGFDNDFSGNVGKYGVGINATVANNTAIFAEVDYLNGSKIETPVTANIGFRLRF

SEQ ID NO: 14945 - protein, 714 aa, Pseudoalteromonas atlantica
MNSGLSRLGIALLAAMFAPALLAADLEKLDVAALPGDRVELKLQFDEPVAAPRGYTIEQPARIALDLPGVQNKLGTKNRELSVGNTRSVTVVEAKDRTRLIINLTALSSYTTRVEGNNLFVVVGNSPAGASVASAAPVKASPAPASYAQPIKPKPYVPAGRAIRNIDFQRGEKGEGNVVIDLSDPTLSPDIQEQGGKIRLDFAKTQLPDALRVRLDVKDFATPVQFVNASAQSDRTSITIEPSGLYDYLVYQTDNRLTVSIKPMTTEDAERRKKDNFAYTGEKLSLNFQDIDVRSVLQLIADFTDLNLVASDTVQGNITLRLQNVPWDQALDLVLKTKGLDKRKLGNVLLVAPADEIAARERQELEAQKQIAELAPLRRELIQVNYAKAADIAKLFQSVTSDGGQEGKEGGRGSITVDDRTNSIIAYQPQERLDELRRIVSQLDIPVRQVMIEARIVEANVGYDKSLGVRWGGAYHKGNWSGYGKDGNIGIKDEDGMNCGPIAGSCTFPTTGTSKSPSPFVDLGAKDATSGIGIGFITDNIILDLQLSAMEKTGNGEIVSQPKVVTSDKETAKILKGSEVPYQEASSSGATSTSFKEAALSLEVTPQITPDNRIIVEVKVTKDAPDYQNMLNGVPPINKNEVNAKILVNDGETIVIGGVFSNEQSKSVEKVPFLGELPYLGRLFRRDTVTDRKNELLVFLTPRIMNNQAIAIGR

SEQ ID NO: 14946 - protein, 367 aa, Pseudoalteromonas atlantica
MKKSVLSVLVVTALTSASAMAAHTFTNENGDSLTIDGRFEVRYQNKARNFDDNAGEYEARTDEFNSGSSRFGFKGVKQLENGWQGFGHAEWGYNSSSTANDIYSRLLYAGIEHEKWGKIAAGTKQWSTFYDVAWYTDLGRTYGSRGTGYYNLADWGIASGTGRAENSITYRNNLGGDWKYGFTYQTTRNDVALSGNATATLKNGMGASTSYSFENGLTLGLAYHQNELTDIKNASNINDGDIQRIALLGANYSLGGFYVGATYSEGSNWEVNDNAEFYDSRGAELYTYYHFENGLRPTLNVNYLTSTDDNGSGYERQTIIPGLEYHFTKNTFLLWAEYQFDQGNDQYVQDHYDNRDNQFSAGIRYYF

SEQ ID NO: 14947 - protein, 141 aa, Pseudoalteromonas atlantica
GEGGVNGFKLAHQYYPTGLQSLLGDTRFYFETSVNLWQYNHGDKTQSNVVLAMSPVLLFPAFSINNTPIYVEAGIGISLVDETYFAGKNISTHYQFEDRIGLVADFGETNVALRIIHYSNAGFKDPNPGLNFLTLSVAKRF

SEQ ID NO: 14948 - protein, 675 aa, Pseudoalteromonas atlantica
MGHIRVLGACVLTLRGHRYRYLRTAAAIASGVMVLPAASRAADLPLKAPALKTVYDWTGLYIGAHVGVTRGTSSATLIDPTLATDDHVFTGATGGVQAGYNWRLNSGLLLGVEGDISFPNYLPSNHVVSSAATVLSSAEERWDYVASLRARLGYTTGNWLFYATGGAAFTGERFLSTPTGGTEEKVLHTRFGWTAGGGVEYAFAPHWSARLEYLYSKFDNANVTFPSGAQYSSSMDFQSLRIGLNRKIDWPGVPTYNPKSDVTDTESSRWEIHGQSTVLGQGYPAFHAPYTGTNSLLPSPDFQQTWSNSLYLNARLWDGGEVYFNPELLQGFGFNNTTGAAGFPNGEAQKSGFPYPHFNASRLFVRHTFGFGGEQEELASGQLQLASKVDVSRLTLQVGKFSVVDVFDGNSYAHDPRKDFMNWSIWASGAFDYAADKLGLGYGATAELNQKQWALRAGYFLIDAVSNSNNFDMNVGRRGEYVMELETRYSLFGLPGKLRTLGFVNSAFSGSYRETLDNPAFGVDISQTRRGRLKYGYAFNVEQAITDDIGVFGRWSWNDGRNEIMAFTDIDRSLSGGVSVKGTKWGRPDDVVAIAGAINGLSQDHRDFIAAGGLGPLIGDGQLNYRRERVLETYYAYALNKALTFTADYQLIVNPAYNADRGPVSVFSGRLHGEF

SEQ ID NO: 14949 - protein, 1034 aa, Pseudoalteromonas atlantica
MQRSDSYRVHLSVLALAIAACSSGVQAQALDASNAAGQRSPISPAATPADASGDAGDAETPAAAANASQTSSEASNQDLPATATSATATATTATATGARAGAGAASDTGTGKVASASPSASSSASASATTGVQTLDAMQVTGVRRANAAAVESKRAATNITDVISATDVRALPDSTIVEALRRVPGLSVLPATDNEHPRDEAATPVLRGLGPSYNNVTIDGLTIASPGTPNGTLGSITRGVRLDLLPASIVSELQVVKTFTADLDPNATGGAINLKTRSAFENGGKPFFSAEAALGHANDVGKPRDQDDPGYRLNATGSRTFGSEQQYGFTLSANYQTLSSYTETHMTTDMVHYGFYDNNGVLQTGADLGNGWAVPQQDKYWYVQNQRDRYGVTGKFEARPSAAFEAYAMAGYYYFKDDMERNEVIIDPRNRGQVFNQTATSGSYPGGDIEVGYSNQIVTTRTKVAQLGSIWRPTDRQQFSARGSWSDATYDEPIRMIKYATGINRPAAVPVGQTGSGVTVNATPNYAFNYDTSGFDQRFGVSPQAYNNLDNYSLSYWRPDYKRTAADRILTGRLDYGFNQGESDQGIGFAAGVSYTTDKPSYDIFRVEYQPNTSVPTFGLADVAGTGRAPMRYAGLNLITIDPDKANRVLAATPLSAFNSTDQQAFSNQDNFTHTEKTFGSYGLVSYRSERLNVQAGLHLDSTKLNTVGRQRQLDTASNRYVYVDNPTNADYDYLLPSAIMTYHLTDALDLRVGASRTLGRPPYDAYAARTSIGFVNTTDAGNPSAQGVTVTIGNPDIKPRVSNNLDLSLEWRLPGDFDAFASTAVFDKRIQDEIFTLSRTDSFTFDGTTYANALISTPANAAKARIRGVEFNGIVNTLAPIAPWLSGVGFSANFALLDGSLDVPYSVGSGSTVSQRERKLDNLVGQPDYTANATLFYNTGGLELRAAYNRQGKALRAIVSNIDWQDLYWSPRSQLDFTATYAVSKQLSLIGQVSNLTHSRISSVTGPGQNLLKDSYSVPSTYWVGLRFTPSL

SEQ ID NO: 14950 - protein, 918 aa, Pseudoalteromonas atlantica
MGPNLKKVLLATVSAAVAGASASAAFAQEAATAEVDEIVVTGFRKSLSDARAIKQDSVIQVDAIVAEDMAKFPDLNLAESLQRLPGVQINREAGEGRRISLRGLGPDFARVQLNGMEVLGNVDSAQDSRGQRSRDRAFDFNIFASELFSRVEVEKTFEAAQKEGGMAGTVGLFTGKPFDYGTGADGALSLKVGTNEYTEDTQPRIAALFTQNWDNVFGVSFSAAYSKRETTEQGHNTYNRSNPSAATMQSLVTKGLNISGLSAAQRAKFLSGDLYFADGNRISSWNAEQERLGLTAAVQWRPMDGMELTLDVLHGEFTTRRNEYHLATRPLASTGSVAFDTAAGGVWPSIFQSASVINDLTWDSDNYVTMTDVTGATFGSEHRRSLNENKFNQVALTGEWEMSDRLKFDGHVGWEKSTYDTPYDDKLYMRAKGNLIANYGENGQSASFEYPNWDPTNPANYAMDSFYYRAFNNESELHEGELNARYELNDTWTLRAGVAYHKFRQQGEDLFYDDNVNGTRSKMRGTAVGDVTSVFTNAFGSWLVGDYDKAFAKYNEYHRLEQNKDGTGGALQDIENVYETTEETLSGFVQGDWDSELFGRRFRGNIGLRGYSTDTHSTGWIQGDNYAYLGTTDVEGSYEGVLPAMNAVLEVTPEVLVRFSATQNLNRPGLGSMAAEGSAFQDSSGKITASRGNPNLEPYKDNTLDFAVEYYFGDVGLMSASLFHKDIKNFIETVRFTDVPFSETGVPYSTIPGATASTIVNEFSMPVNKEGRVELTGLELAAQSQLSFLPAPFDNLGVVANYTYIDMPDDLTGISKTSYNATVYYETDRWGARASLNYRDKWYTGYNTAVMSASTRGFEGGTYVDAAAFFNITESLQLTFDAVNLTNEKDTQFWGQNEYLYNQNQSGTTYTAGLTYKF

SEQ ID NO: 14951 - protein, 661 aa, Pseudoalteromonas atlantica
MSVLASAMLPIMAGAQTEKTEPSNRHDVMTVYATGTERDSFNAPMMVTVIKNDSPETKTASTANDILRKVPGIAITGTSRTNGQDINMRGFDRRGILTLVDGVRQGTDTGHINGTFLDPALIKQVEIIRGPSALLYGSGAMGGVIAWETVDAKDLLEEGKNSGFRVFSQAATGDHSFGFGGSAFGKSDDLDGVFSFVTKEVGDIRQGNGDKMDNKETIANMLGKGTWQLDDSQKLSGQIRYYNNDAYEPKDPQQSNVSNSNLKVNRTTRQRDIQATYQLNPSDNNWLNFKATPYYSDVNITSKGKDSNYEGRTQKTYGLKLDNRSEIYELPLAAHNFTYGTEAYRQKQNPYATTTQFPEADITFASGFIQDEITLKDLPVSFILGTRYDNYKSSAKGNKDVKEDQWSSKAAVSITPTDWSMLFASYSEAFRAPTMMEMYNDSVHFQAGPIVNRWRPNPNLKPESTKTAEYGFGLRFDDLLMAHDNLRFKASYFDTKAKDYINTYVHPDRVNWDNNYTTSINTKRAKIWGWDASMDYTTDYFVWNLAYNHTEGKNEYNGESITSIKPDSVTSNLSVPVADSGFSVGWLGEFTNHTDFNKATKIEQQAGYAVHDFYVSYQGNGQLKGLDTSVVLGNAFDKEYYSSQGIPQDGRNAKLLVSFQW

SEQ ID NO: 14952 - protein, 759 aa, Pseudoalteromonas atlantica
MAQRQPEKTAAGGCCFNSLYNKYSGITMMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 14953 - protein, 656 aa, Pseudoalteromonas atlantica
MHKKTIFKLSLISLAVAGYAEANQATLDTVKVQAQPTVNHTRNISNLRELLANRTDINVGGGSVSAQYISIRGSGQDRIGMIVDNTSTNTQQWYHQGRFQLDPSMVKSIKIDKGAGSASAGIGITDGVIRAETVSAKDLLKDGRSFGARIGSEYNSNRGINDSLSLYGQANNLDVLLLGSWGDDKNYKAGKGYSDAVNKNSRVVNNTARRQGNYLAKFGYDITDKQRIGLSFRQESFYGAGQDRFEMIFNSRPVNANTTKRTYNLEYDAKDIGFARDVKANVFHILGTDKREDYQQNKLTGYQRSSKTKTTGANLGFTSEFGGEHLFKYGVNLRKEQTGSQNSFGNIKGEQKFEYGLYAEGIWSLGKVLTLTTGLRYDYYDLDTAGKVDKNGKPLAGNKSVSDKRLNPSFGLIWDITPNFALNAKLNYASRSPILASANTITDNRGSLDKARGLRFIDPKLKTEDVRLAEVGFEWKYADFNLKGSVFEQRVKNFYQTTNSIISNAGTLKTKGYEAELDYQWNALKLTAGVAYADPKADFALSNDPLNVIPQGRQWSTGVSYKFVEPNLEIGWLGRYAQSKEYKTGAAPKVETRRRIGYGVHDIFVNWQPLNQDNFNVNFTVKNIGNKFYRSHSQRNLEVTPPSPGREFKIGMNYSF

SEQ ID NO: 14954 - protein, 659 aa, Pseudoalteromonas atlantica
MKKTGWGAYAALTLLAFAAMPAHAEETTELPDLLISAGVEPLPTREVASSFTIVTAEEIETFQYRDLTDALRSVPGLHVATSGPRGGQTSVFTRGANSNQTLVMINGLPINDSASPGGAANLANIPLDNVDRIEVVRGPQSALYGSQAIGGVINIITKTGAGAPVTSLRVEGGTLGTLNTHASTGGSLDGVDYFLSLSREATNGSDATPTRLRDARGEEKDGNEVGSVSGRIGAKLNENLSASAFIQYTKSETDIDDDGSDAGFVQVYQNFDSTYDSNRLIMAGDLSGSFFDNKWRPKLSAGITNQKSFLDDQPDPGGSIYLSDVDYKGKTVTVRFDNAFDIHPQHLLTAGASYTRDEYSSSGIRDLGGFIVTPVSDADTDAFAVYASDHMTFGERFFATVSTRYDMPEDMEDRFTFTIAPGYYHPETDTRLTFSYGTGFKTPSLYQRYGQEINAFFGTITQYTGNPDLKPEKSKAWEVGVEQGFLEGRGLAGVTWFDSEVEDAISIEFDLVGNSSAVNVDKFDAKGIETFIQFKPSPEVTARIDYTLTIFKADPFVTTMTRRPRHLIGFTGSWEPVAGTVLSTNVQWVDIYRDIPRDSFGFFLDPGPYTVVNIAGSHKLTDNVTLTARVNNLLDTRYEPVNGLEAAGIEALAGVVFTF

SEQ ID NO: 14955 - protein, 404 aa, Pseudoalteromonas atlantica
MKKRVAVAMTAAGLAAATAAHAQSSVTLYGIVDNGLAYQNNSSATGATTGGHSKVQMSTGVWAGSRFGLKGSEDLGGGTKAIFQLEAGVNTANGSSQWTNGIFTRQAWVGLTNNTYGTLTAGRQYTAYYTLLSPYSPTTWLTGYYGAHPGDIDSLDTSYRANNSLVYMSPKFYGFTVGGSYSFGGVAGATNRGSTWSAAIQYLNGPAGIAVGYQKINNATLGGGVWGANSTVQNGLTASGDGNQPAVSSINNGYATAQSQQRIAVTAGYQFTPAWDISASYSNVQYTPGTGSSFRNTAIFNTAGAVLHWKAAAQWDFAAGYSYTAATQSNGITSSAKYHQVTLSQYYSLSKRTGLYAVEAYQHSSGNTLNGGKIIAATTSIGDGVGAGSKQNQIGLGVGMIHRF

SEQ ID NO: 14956 - protein, 648 aa, Pseudoalteromonas atlantica
MKTSYSPLYRSVVTALASSNLTPKALTIVSALAVCMPAMAAQNQGEVDAEQPRINFPAITVTATRTPTAVNNTIAQTRVIDSQELSTYKGQTVLDVLKRQPGFSYYQSGGMGTKSSFYLRGYDSQSILVLIDGIRYNAASTGRAALELFPADQIDHIEILYGASGSSIYGADAVGGVIQIFTKGQNVDQNQFSVTAGAGSNDHYLYGASAQMRNEKGSSLSLAASRNQTKGIDAIKSGGDAYKDDDGFNSNNFSLSMQHKLNDAVTIGANGIYAKSNTEYDSGSTFIDANQDNKNYVFNTFIDIENKGLNTKLQYGESTDKRVNFDKNSPNGSFFDTKDKQANLQLTYPTNMGTLTGGAEWLRQEADTSLYAGSHERKIKSIFTGYLLNTDQFDAQANVRYDDNSQFGSETTYNVGGAYKFSPELRAGASFSTGFRAPSLDTMYDNFSGNPNLKPETSDNYEVFIEKSDDHHKTRLTGYYSDVEDLIDYDGGNNWRMGNIDKARIKGITLVSDWIVNQYIFGMNYDYQDAKNLSGDFKGEQIKFRPKHKGLVYAGYRNSEFDVRAEVQHIGKRYALDGEWYGPTRLGTKMQHANLVNLSANYYVSPNLTINSQINNLFNKEYTSIDTYGTRYNEDGTNFFTSLTYTWK

SEQ ID NO: 14957 - protein, 568 aa, Pseudoalteromonas atlantica
MKPSQWTLRWVTLCGCGMLAASAAAVELPGTVQPSQLDERFKPRSEPQAKPEAPLVVPKQVAPQGSEQIRFKLREIRIEGNTRYDKAVLESYYQHMLGEQVSLAELVDLANRLTAKYRQDGFLLTQVVVPEQSIEGGKVRLQVIEGYLEHVQIKGTVDGPRVRVEELLAPLTEKRPLDADTLERGLLLVGDLPGVNVQSVLSPGQALGSSNLDVALQQQRYEGFVSLDNRGSHYTDPTTLAFGATEFSRLGFYEQIDVLGAISPFSDATRYIQLRGTLPLGGMFAGDTLQIMGSYSKVNPDIPDSVFPFDSVSKSTEGSISYNHPFIRSRSQNLSGGLALQWKDTETRLRDFASDASNPGRDHVRVFQQRLTYDWVDRWMGINLAEVRNNIGLDMWGATKKDDERRSREVADGRFVYLNGNIGRLQGLGGPWSVYGELQWQYSFDPLLPSERFGVGGSGIGRGFAPGNITGDRGFALKLEPRYGQAVGYSWLRSYQAYAFYDWGKTYNLDVDDDEQQKLGSIGAGVRFNLTDQLSFNPEIARQVIGEPADQRDGKRETRVLFNVVARF

SEQ ID NO: 14958 - protein, 228 aa, Pseudoalteromonas atlantica
MKIKSLLLASTVALIATTGAKAADAIVEEPAPVIVAEPIFSWTGAYIGGQIGYGWGKSEFEDAFRVKPDGFLGGLYAGYNFDVGNNFILGVDGDITYNNLKDNYSATDGDIAGDLESKLRWSGAVRARAGVAFDRFMPYIAGGVAFGSVKNTLSATDGVDEISVSQSKTYTGWTAGAGVDYAATDNLILRLEYRYTDYGKKDFDFGTDVSVEDKFKTHDVRLGVAYKF

SEQ ID NO: 14959 - protein, 807 aa, Pseudoalteromonas atlantica
MNTVTLEGGTFNNNGTLNDVVKIEKNSNAVINNTGSLSTLQLHDGTVNNSGIASARVNAQGDAVFNNLAGGEARKGAILYNSAVVNNAGTWKMGYQDENNNAGTLDIDDKSTFNNSGKLILDNSKNAIRFQGSNANATLYNTGEMTLDAALGAGAILYDDGASEFINKGVVDAKVTVAVSTAGATESDAFLWNQDGGVINFDKDNASAVKFTHNNYVALNDGVMNISGNNAVAMEGDKNAQLVNNGVINLGTEGTTDTGLTGMQLDANATADAVIENNGTINIFANDSFAFSVLGTEGHIVNNGTVVIADGVTGSGLIKQGDSVNVEGVNGNSGNNTEVHYTDYTLPDMPNTYTTSPFSETTDSGSSDGSSNNLNGYIVGTNVDGSAGKLKVNNASMNGVGINTGFAAGTADTTVSFDNVVEGINLTDADAITSTSVVWTAKGSTDASGNVDVIMSKNAYTDVATDASVNDVAKALDAGYTNNELYTSLNVGTTAELNSALKQVSGSQATTVFREARVLSNRFSMLADAAPKVGNGLAFNVVAKGDPRAELGNNTEYDMLALRKTVDLSESQSMSLEYGIARLDGDGAQKAGDNGVTGGYSQFFGLKHQMSFDNGMRWNNALRYDVHNLDSSRSVAYGDVSKTADTDVKQQYLELRSEGAKTFEPREGLKITPYAGVKLRHSLEGGYQERNAGDFNLSMNSGSETAVDSIVGLKLDYAGKGGWSANATLEGGPNLSYSKSQRTASLAGAGSQHFNVDDGQKGGGINSLASVGVKYSSKESSLNLDAYHWKEDGISDKGVMLNFKKTF

SEQ ID NO: 14960 - protein, 342 aa, Pseudoalteromonas atlantica
MKRTLLALAALTVSAGALAQSSVSVFGVADVSVAHISTTGKSVSGLANGGNSSSRLGFRGVEDLGGGLKADFWLEGSLSVDDGTASGFKFDRRSTVSLLGNFGEVRLGRDKTPAYQNLETFHAFGDTGMGAINGHNLISGSAAGTSEGSNPKRNSNAISYLLPKLGGVYGQLTHSFGEQADDHSLASSTGLRLGYANGPLNVAAAYGIARGGTAAAGVDYKTMNLGASYNFGVVTPMLLIASDRGNGKRVDLYSLGVKMPLGAGELRAAYTWYKDKKQSDADSQRLALGYGYKLSKRTEIYAAVARMSNDDKASRKLGSSLSPTPAVGKSLTGYEIGLRHNF

SEQ ID NO: 14961 - protein, 935 aa, Pseudoalteromonas atlantica
MFTNSKLAKSVKLACAFGAASTIGFTGAVNAQETEEAADAVEKIEVTGSRIRRTDIEGANPVTVMSRVDIEKFGITSIGDVLQAIPSAGSAINTNNNNGGNGTTTINIRGIGSNRTLVLVNGKRWAPGLTGSVDLNNIPASIIERIEVLKDGASAVYGSDAVAGVVNIITRQDFEGVHASGYIGQYDEGDGNKEQWDIGFGTSNDKGNVYFNISYVEEEPTLAGDREISAVPTFGTPEGFGGSSAPPQGRFWTFDQADNGFNEQGDGNGGLEPWVEPDSRFNFAPFNYLSTPQERTNIYTQARYELTDNLSVNVTGFYGNRKSEQALAPTPLFIGTAFGDTGFTLSADNPFSPYDFDVTTDQDVLDADPNAREMFLFGRRMMEAGFRSFKQNVDQFQFNGGFEGVIEFADREFFWDANYTYADITQNTSTDGLLNMDRVAQAIGDPANCTGECTPLNLFGGAPNVIGEGTITQEMLDYITFTAQDELNSSLESYSANISGELLELPAGYLAFASGYEKRWQSGYDQPDAIIAAGITSGNARQPTSGAFSVEEVYLELAVPLLSDMPGVEQLDLELATRYSDYSNFGDTTNSKIGLKWRINDDLLVRGTWSEAFRAPSLDELFSGNSDSFAPLTDPCNGGAAGNPELPGCAGIPASYEQPNTQIRTTVGGNANLEAEEAESFTYGFVYSPEAVEGLSITFDIFDIEVDNAVSSVGAQTILNACAQTGVNLCSLIERGAGGNVVDLFNGQVNLGGQTTSGFDYNVAYNFETEYGDFRVNWDGTYVDERTTIVVDPVTNTSTEFNDAGLAGDRDVVPRLRTNLAVTWAYDDWTANWLVRFIGHTTEECSIDGDTLDQQLCSDPSDELGGDSFNELEDMAYHDVSLGYAVNDNLRITLGVNNLFDTDPEVSYSTFANSFDPSMYEIPGQFFYSRVNLNF

SEQ ID NO: 14962 - protein, 377 aa, Pseudoalteromonas atlantica
MKHKTAMLCTLFCAVTNASAQDSVTLYGLIDQGIGFTNNAAGKQAWQTQSGWTAGDRWGLKGVESLGAGNAAIFTLENGFVLDSGRDLPSGMLFGRQAFVGLQNTQWGSVTFGRQYDSIQDYLAPLTANGRDGGWPFAHPYDNDNAVATFRLSNAVKFSSANYGGLQFGGVYAFGNTASFANNRSFSLGIAYKLSSLSLAAAYLQADSPGATGAGAVSSTDANFVARRQRVWGAGANYDWGPATLGLTYTHTVLNDPVSSTYFGTLPAGATLLRFDNVEANVRYQVTPTVVFAAMYAYTLGRFDGASGEATPRWHQAGLMLDYLLSKRTFLYTQAVYQHVGGDAAGTVFGNAYITGSAGISSTRSQVLGRVGIRTVF

SEQ ID NO: 14963 - protein, 810 aa, Pseudoalteromonas atlantica
MLLRDSASAHRHPLALAIFLALGGHVAVAEADSSAAAQRVVFDIPAGPLARQLNLLASQAGLLIGGDAALTANKQSQAVHALSVDVALAQMLAGTGVAAVRTGEREFQLVSQAEDAAGAVTLGATTISGQGLGAVTEATGAYATGRSSTATKLPMSLRETPQSVTVVTRQRMDDQNMKNLDDVMRNATGVTIIKNGSERSLYQARGQTVDNLQIDGVPTNIGNPYSMDTISKPNTDIYDRVEVVRGATGLMEGAGNPSASINLVRKRPTAERQALIETSVGSWDDYKTMVDLSAPLNEAGTLRGRSVITYNNANSYLDTAQKENQLFYGIIEADLAESTLATFGFTYQKERNSGYDWSGLPSKESGAFYPVSRSTSLTGDWNHLDKRNTTVFADIQHTFANGWKGVVAVNQMWAKSDFLGNYTYPGGGPDLFTLNPRHFHFDDTQTSIDGYFTGPFQLLGRQHELIVGGNWNKDDFDYHGGRDATYRYIVDMNNLAAFDPPKPTALNVNQWQYNRTQEQKGVYVASRFSLTDSTTFILGSRLSWYSHDSLDDTNGVREPTDHKHFSKSGEVTPYAGLVQDLNENWSAYASYTEIFKPQSAQDAEGTTLQPMTGSNYEIGLKGEFLDKRLQTAIALFQADQTGRAERVTCAQTWACYRASDKVRNKGIELELTGEVLANWNVSAGYTYTQSKYIGGEQKGEDFNGASPRHLFKVATDYRLPGALNQLRVGGSFYAQSKMTQTEVGEDYKIQQDAYHLTNLHAIYEINKRLEVQYNLDNVFDKKYYQTLGNPNYWNFYGEPRNFNVALRARF

SEQ ID NO: 14964 - protein, 713 aa, Pseudoalteromonas atlantica
MSTFRFHALPIAIAAITLALPQPARAADTPTTDAVDATDGGTPIRALDAIQVQGTLLGRSKPDDVQGYAGSRQVIDREQLRNGGNRSLDDALQRVPGIKIFDETGNGALPQLMLRGLYESRSGRAQVLEDGIALALAPYGQTSLSLFPVGLHQIDRIDIVRGGAAVQYGPNNVGGVIDLVSKEIPSAWSTTLAHKVTAGGQGQFLQDSALSSGGYLTENLGMQVDANRTYGEYWRAHSDTDISNLRVRAEWWLDDTTLLKASVQRYLVDMDLAGALSPDDYRRDPRQSTRPLDSFNGRTTRASLSYAQLLGDWGPMKDVRLDWTNFSARSSRNFIVGMRQASTETWRSDLPPQLRQTAPRDFRVVGSEPRLSWTMGDAGGVRQQWTAGARAVREDIDFLVGNLRLRDGLFTTVRDWQFEDHALAAYVSNAITLPDERVTITPGLRYERLDSRYFNRATGVSTLNRTRDVLPGLTLGFQANEQWFFYADGQRSMRAPQVTQIIFGNNLDAELAWNYEAGTRYQPNERTRIQLGGYLIDFDQQIQLDNTTRVFRNLGKTRHQGGELELQWSPEQLRALTLNASYAYLDASQESGAFRGFRVPYTSRNQITLGGSYALGHTTVALSGYSFSKAFSDAANTVQENAIASVGQLPAYMVWNTQVSHTLFERDGQKFSASLAINNLFDRQYWFRGVDTSPWGRQAAPARTVTAGLEYTF

SEQ ID NO: 14965 - protein, 937 aa, Pseudoalteromonas atlantica
MLRSVSPLFSLPVSGRRQPVRMVASAARPVLAVALGGAMIGAPLARAEHWSGATIKKTGQGEIGIEVPDKTAALHTGPWVARKMTVETTGARGVGVLLDKTGVSLTLEEAAITSSGDLGLDSSYQPRGTVMVRAGALTARGTTIRNRYGSSAGDWSRRPLALRVAGPDASLILSDSTVEGEQGMQLVSRARADIVRSTVRGLHATGLSIKYAAKASLADSEVLGERAARVDGDGELAARNTRFSGRSGLLLSSGGRADLSGGSLAASNGSALDLYGGVEGQLRDVEVSAQGAPAIDLVSTLAGDSAGDSPARRDPVLRVVGGSISVAGAHAPALSLGGGQARLDTVDVRTAGSPAVELVAGALGVAGGTVNAGQAPVFVTGAYDAVLAAANVFLRPAKAAPQDGMPAVTVTLSGAKVGGAQLLRQTTPVPVRLVLRGAAVAQGDVVRAPETAPEKDGFGTPVRPGLRVGLDQAPLELDVADGAQWHGATQSLDRLALGAGGQWRMSAASSVGELSMEPGAAVVFGDAAGPGFQTLTVRTLAGAGSFEMRADAALEHADQLVVTDQAEGRHRVWLRAPAGAEPSKAQAVLVRAPADGKASFELDGSDGRADFGTYRYGLAQQPGGAWGLVRTGYSSTAAAALDTGGLGAVQGLWYAESNALGKRMGELRLNPDAGGAWGRAFSQRQRISPRAGRHFQQGVSGIELGADRAWPVAGGRWHAGGLLGYTRASRGFSGQGKGHTDSVHVGGYATYIGANGVYADATLRASRFENSFDVPGWAGRTVSGSYRANGVGVTLEAGRRLALDRHWFVEPQAELAWFRAGGGTYTASNGLRIEDDGGTSLQARVGAQAGRRFDLRGGAVVQPYAQLSWVQELKGVSTVRTNGIAHRTDLGAGRVELGLGVAAALGKGHNLYASYEYAHGPRLSLPWTVQLGYRYAW

SEQ ID NO: 14966 - protein, 729 aa, Pseudoalteromonas atlantica
MNMGTPEDGTRSTPLDVIPSDSTERLKVVKSPTPDMPGDSIGGAIQVESTSAFDRDGRTLRGSIEGSHQSLFGKTSPNGAFNYSDIVGGTFGVAVGVNYQDRELESDNTEVAYEIFEGGADDDLFAGEVQRRKYFIERTRMGANLNLDWRPDADNRYYLRSLYSRFDDAETRHRTIFGLSDGEVSANGDGTYDVADLPADSISKRVRYRTKQEDNMAVSVGGENRLSSATVDYKVGYTKTTEHVNDEKEARFNYDGDDLSATVDQRSGIARLWFSDNGWQSNDDFVFDRFVIAPKQVDDSERSAQINVRFDGEHSSLKVGVLGRWRERDVNVDESELRRGPAIDLSDWTKAAPEHRGGTLGESIGSDGMRRYWNTSGTLYSARPQDVGGNLQTSLQDDYNASEDVFATYAMGTCDIGALRMIAGVRVENTQFNATGNQVDVAPNGRTATVTPREASSSYSNVLPGLHLRYDSGNDWVLRFAANKTLSRPSFGDVSPRVSINRGDNEVSIGNPDLNAYRSQNLDLSFEKYIGSTGLISLGVFHKSIDDYIVQTLNTNDAEFPGFQVTRALNGDTAKVRGAEFNWQQTLDFLPEGWNGVLVGASATALDSDFDPGLTNRAGDDFMLPRSSRRIYSGHLGYEKYGFSARVAAVYRSPYLDTIGQSRAYDIYVAPHTQMDFSMSYQFNSHVSLYLEAQNLLDEPLELYQGIPWRTLQNEEYGRTYALGLKVAL

SEQ ID NO: 14967 - protein, 340 aa, Pseudoalteromonas atlantica
MTLHRFKKIALLSALGIAAISMNVQAAERIAFIPKLVGVGFFTSGGNGAQQAGKELGVDVTYDGPTEPSVSGQVQLINNFVNQGYNAIIVSAVSPDGLCPALKRAMQRGVRVLTWDSDTKPECRSYYINQGTPAQLGGMLVDMAARQVNKDKAKVAFFYSSPTVTDQNQWVKEAKAKIAKEHPGWEIVTTQFGYNDATKSLQTAEGILKAYSDLDAIIAPDANALPAAAQAAENLKNDKVAIVGFSTPNVMRPYVERGTVKEFGLWDVVQQGKISVYVADALLKKGSMKTGDKLDIKGVGQVEVSPNSVQGYDYEADGNGIVLLPERVIFNKENIGKYDF

SEQ ID NO: 14968 - protein, 203 aa, Pseudoalteromonas atlantica
MKHFTALTLSALLASAAVPAFAQEKGDFLLGLGLGWIEPDSATTTAVGRVSADGALSPTITVEYFIAKNVGIELLASLPFEHDVDLAGAGQVGEVKHLPPTLSLQYHFTNSSAFTPFVGVGVNYTYFFDEKGKGPLAGVSLDLDDSWGLALHAGADYAISEKSAVRLDVRYIDIETDVKVGGAQIGKVKIDPWVFNVAYVMKF

SEQ ID NO: 14969 - protein, 699 aa, Pseudoalteromonas atlantica
MKTKHRSMLLAGASTIALAPAALFAQEAIKLDAIVVTATTDVTTQADGYKADYNQSATKSDTPVAETTQSVSVVTAEQIRDQGAETLGQALRYSPGVLGDPYGVDPRFDSPTIRGFEARGSQYVNGLRQLRYMGAPAYETFALQQIEVLNGPNSSLYGAGSPAGIINQVQKRAQGFDFGELGVGLDDNGSRQSFFDWNRTVSDTLSFRATGIVKDYESQVEEIGLERGYLGLAARWKPTDRTTLDIISSYTDDAPTSPPGIPFALTGQGNDKYLRELYTGEPGWDDHDRQIFNIGYELSHEFDSGWTFSQGFRYEKFDWEYTGHYVTGIDASGTGITRGANYQRENTTGLSLDSRLAGEVLTGGMEHKLLFGLDLRKYDADTVTEFYNAEGGVTDLDWRNPVYGGVPTGAPWYVSTPDVTQTQIGLYAQDEITAGRWRGSFALRHDWSKQEGTTYTNFAGEGEIDQSDKALSGRAGLGYEIAPGALVYANYSTSFDPEIGVDGAGEQLEPTTGKQWELGVKYQPDSFNALFTAAIYDLRQENLTVNLGGAEGRRQVGEVKSSGLELGAVGELAPGLNLRASYAYNDTEQVDPSGANDGNEMPNAPRHLASLWLDKAFDNGVSLGGGLRYIGEREGDLANLYSLESVTLLDLAVGYSRENMDASINLNNLSDEVYLANCGSFGCYYGEGRTISAKISYKW

SEQ ID NO: 14970 - protein, 903 aa, Pseudoalteromonas atlantica
MNTNTFRKSVTALAVTATLGFPAFVAAQDSGANDVERIQVTGSRIKRTDMETASPVSVFDAEAIEASGFTTMENFIHNLPSMNGAMNGSSTNNGSGGYATANLRGLGSARTLILINGRRYASGDLNAVPMAMVQRVEVLRDGASTIYGSDAIAGVINFITKTDFEGAEFSAQYDLTGEGDGETTKLSGVIGTSSGKGSVVLGLEYQNRNAIGQADRDFSRIPLAEKNGKAVFDGSTINEFGSFVPTGEKKTYVLDPQTGEQRLFNAQKDGYNYATDSYLKSPQELFTINAVANYDITRDLRVFLEGGYANRQSNQLLAPTGTFWGAPVDADFEYNKTGKDLSVYRRLTETGGREYTQDFSDYRMVLGFEGYLDNGWSWDISYNYARYVDTTVEYNQANRTRFNTLLDEELCNSDEECPGIWNPFEADSLTDEMMDYALIANSPVVRGTTKQFMANLTGDTGSWSLPAGSIAWAAGVEKRWESYENQPDGAAAIGQIYSTPGIPSEGSYDVEEAYIEVDAPLLRDLPGVQSLDLSAAVRRSDYNFLDAQTTTKFGLEYVPKDGLLVRATIAEGFRAPTIDNLNSPQVISFSRYVDPCTEYGDSSNDILDANCKADGLDSDFTPKTSQSATILSGNADLKPETSDSFTLGVVYQPEFMDNLNVAIDYYDIEIENGIGAPDISLIAEQCYTSENFSSASCDLILGPEAVDTKSWPSSDYRDAQGTLAGTDATTQNISTFETSGIDFDVNWNDEVAGGLLNLRLDGTYLKDYNYQVQEGAAPLELAGNFGADSNFAGRIAAFSKWRTNFTASYKVEDVAVTWISRFQSGVDDVNYDSSDLSSSVGSYIYHDMQASYFFNSETTFTLGIRNLFDKQPPYVSNNNDMNTLNTSYDTAGQYWYARVGFRF

SEQ ID NO: 14971 - protein, 726 aa, Pseudoalteromonas atlantica
MSNAAQRRRPVTPGSAALITGSRALLGLVLFCPPSVQAQTVPPEGAEAVLSELSVTGTGERAGGPVVGYRATRSATATRTDTALRDTPQSIQVVPREVLVDQQNVRLTDALTNVSNVQPGGTIQGRSDTYILRGFRTQTYAIDGLVLNPANAFQPTQRDLANVERIEVLKGPASVLYGQGDPGGLINIVTRQPTLTPSADLTVQGGSFGFRRVQGSVSGAIPSVEGLAARFSFGTQNEATFRDFGGPENSRHFFAPAFVWTPDASTRVYLNAEFTRQHSQYDEGLIAFGGRVPLDNISRFYGEPWSRYYGESNSITLLAEHDVNENLTLRQAINGQWGSFNLLATRATGVNAAGTTVTRRLTEGDSIYHSIDSRTEALGRFIDPLGFRHTALAGFEIVDGFRHPFTTQGTATSVSFLNPIRGSVPQIGTLTLQSDLRQKLSLFGLYMQDQIEFFPGLQLVLGVRFDTADQLYFQRTPTTRTIPPEQNLTGVSPRVGLVWRPLEPLTLYGSYTTSFVPQTANVLNVASPPPETGEQVEVGARFDLIPDRLTVSAAAFRILRTNVAASDPVNTGFSIITGEQRSQGFEGDIAGEILPGWKVIGGIGYLDAEVTKDATVAIGNRLPAAPVFSASVWSTYQFQGGPLHGWGFGGGLTYVGERFGDITNTYKVGAYARLDATVFYEIDPTWRFAVNGRNLTDRRYIEQPFNQFNNQPGAPLTVLASLTARY

SEQ ID NO: 14972 - protein, 570 aa, Pseudoalteromonas atlantica
MHFAPSVNTLFIRRKKIPSTRVHPSGPLSRNCSSPITAEWAGSPFRDVCPSYWVGDCPSDRRWPRLSPLPLMLLPPRFRALCLTLAMFMGAGLWAPSLVQAQGFGVYEQGSCAMARAGAAVADGCGDGSSIYFNPAHVAGTDGFTASFGTTVIDVGGNFTYDPGAQTSATVDEVDLDNDPLPVPHAYLTYGLTEKIGLGLGTYVPYGLETRWPTRLSDETVFDGAFEGFDNQLQAIYVQPTVSYQVTPNLSIGAGPVAVISSVELNQLQDLSPRTVRNPQTGEPVPDPANPDENLQFSQLGIPFHTAFARSKLDANNEFGLGANIGVSYQASDRVTLGVRYTTPIIVEYEGEATFEQEETGLIFPATSPLAQDLDDDDAPDPTPADGLLASQFSGDGVLTSQSVKTEITFPMQLVAGVSVQATEKLMLLADYQFTGWSSFDKLPLEFGQLEDRTRPEDYEDTHGVRVGAEYDLLAPLTVRAGYLFNTAAAPDKSVTPLLPESERNQFTVGFGWRVTDAVAFNVSYQRLQQNDRRGRVRGALPDEDLSTDLNQGLFSFNANLIGATFTLHL

SEQ ID NO: 14973 - protein, 447 aa, Pseudoalteromonas atlantica
MIRHVFTLVNVTALTLSITGVLYIGNAHAAAFQLKENSAKALGRSFAGAASAQDDAAIIVNNPAGMRQLDGRQFQADLSTVRFSAEYRGNPGIYRNGNTIGGGNGGDAGMVALLPDSYFHMPLGDNNNVHLGATLNAPFGFSTKYDRNWTGRYHGIYSKLQAIDLGIAVSYDVNPYVSFGGAVFAERLNVDLSNAIDFGSILNARHVPNFSPGSADGYSHIEGHDTSRGFTLGGLFSPDEKTHLGFSYRSQVEHNVNNGNAHFAVPENAAAVLAVAATGTFINTKIKSTIRLPASATTSFTHAIDDRWSIMAEVTRTAWSKFDKITIHFASSQPNNALNFSYRDTTFVALGTEYRFSDMLTLRGGLGYDQTPTTAEYRSVRVPDNNRTWISLGMTWKPSKQTDYNIGYAHLFIGHPTITQINATASTLVGDYNINTDLLAISINHKF

SEQ ID NO: 14974 - protein, 429 aa, Pseudoalteromonas atlantica
MSRKGLLKGIAVPLCVLFVICIIPNAYGSGFAIFTQGATALGQANAVIANSDSPSAIFFNPALINKLDGTQIEAGTTVLLPSNEFRSDLSGKTFKTEEDVFFPSTVFITHKFNDKVSAGLGVFNSFGLGIDWGDDWEGRYIATNSELQTFNINPVVSYQIMPNIAFAAGVNYVLLDTTLEKQINLSPYGLSDAGQQFDGDGDGIGYNLGFIYDINEDISIGTSYRSKIEVDIDGDADFDLPNGTPSLISTLFQNTGGNADLTLPQQAHVGITYRGIDCLTLETGLRWEGWSSFDELKINLDQPVAGSKTSVTEKDWKDTYSVNLGAKYQINKTFALLAGYLYSGNPVPDKTFDPIVPDANTHLITLGTNIKFKQFRIDIAYGYQRLEGRSKNNSIDDNPSDSLVNSATSASGKYDSDLHLIGISLVYNF

SEQ ID NO: 14975 - protein, 613 aa, Pseudoalteromonas atlantica
MLLQKLRYFFILSSILCALPVQAATNQQQPLVLDPIVVTASRAPETLSQVAQSVEVIDRADIANSAADSVADLLEYVSGVDVRQRGIHGVQSDIYIRGAGSEQTLILLNGIRLSNPQTGHHNMDIPVSLQDIERIEVIKGPGSKLYGANAMAGIINIITRSPGERHLSAEVKAGEYDYLAESLQAGFATGPVNHRLSAGQQYSSGFDNDEPTGFNVRTLNYQGETRFNESRLDFGAGYVDKKFGASRYYFDAPDQKEHTRTMVGHIALESDWLDIDWRPQWSVNRHEDTYRYLYGTSWYENNSDTTTHNFQLTGNSQNRFGQTSFGIGYEREKIDSSSLGDQDRSNRSLFVNHKLPLGDRVTIGGGLSAVHYSDWGWEYWPGMDALVTLTPQLRWFSSAARSFRIPTYTEMYYNTPTNIGDPDLEAEEAWSYETGLRWQQKRLTMSASVFRRDADNLIDWARQPNTLTWYVQNLSDTTTTGFEFNADIRRPIAALTWLNRVAVGYSYLDRDVDSKGLESRYTLNNLRHQAHGTLFLTWFNTVEQVIKARWQERLLGDSSWVMDTRLSYPLTDEMELSVEVSNLFDEDYIESGDAPMPGRWIMVGMRMEHSFLE

SEQ ID NO: 14976 - protein, 946 aa, Pseudoalteromonas atlantica
MKKFTLFIWMLGSASHLIAQQVSIRGTVKDVSTAAPLPQVEVRILTTPLQTTTDETGSFTLSPELAPGSYQLELRKSGYLELHLPITITPNTPIVFDFIPMEIDLAEANENLTRISLSDVQLNSDDALQDNVISGLLGATNDVFSNAAAFDFSATFFRPRGLDSKYSRVLINGITLNKLNSGRPQWSNWGGLNDAMRNREFSMGFTPSAYSFGAPAGALHFNMRATAYRPGGRISYATANRTYTGRVMGSYNTGMTKSNWAFAVLASRRFGQEGAIAGTFYDANSLFIAAEKLLSETHSINLALLYTPNRRGRSTALTQEVIDLKGADYNPNWGYQNDTPRNARNREIEEPLAIVSHYWKWNDHSSLNTNLAYQWGTTKNSRIDYTGNTLVINPNGQESFIGGARNPAPNYYQKLPSYFLRFENPTAAQYQQAYLAEQAFMEDGQLDWQALYRANQTATASGLNSIYAVQNDVTKDHLFKASSLLKSRWSEQYELQAGVSFTHLNSENYAELDDLLGGAAWLDIDSFAEDDNTTGGDLAQSDLQHRNRLVGIGDAYKYRYGLVTREAAAFAQLEATHKHLDWYLGLQIQNTTHRREGYYENGYYPGDASLGRSASVDFTTYGAKAGLTYKLNSKHFLQVNSAVLTQPLPTQTLFTNARQNNASIASPEAERILNLDASYIFRGNAFKARLTGYYLNFSNGSEVSYFYTQSMQTPLIDQGNALVQEVTTGIGRQNLGIELGASYQVHPTLTFKAAAAVGQYRYTSDPQVYYTTTLAPEPIRFGDGAVQLTNYRVAGGPEQAYQLGFDYRDPDFWWLGASVNRFSNAYVDVSYLRRSGAFARAGDGQPLTTYDTNTARELLQQEQLPSYYLVNLVGGKSWRVKQYTFGFFGLINNALNTRYKTGGFEDSRIGDYQKLTEERSRQTPLFGNRYFLGYGTTFYLNCYVRF

SEQ ID NO: 14977 - protein, 985 aa, Pseudoalteromonas atlantica
MNHNLSKITLAVISATAMNMSLSVHAQEETKNVKDDLEVIEVSGIRQSLTNALAEKRSADSLVEIIQSEDIGKLPDQNLAEVLENVTGIQITRQAGVGTGVQIRGTDANRTEINGVSTVGSGSGRSGISFEDVSASIISSLEVIKSPEAKTIEGSVGGTINLKTIRPLQLGEQLATIRVQGENSSLSTDSGLQPRFSGTFADNWEGDFGEFGILVSGSYAEQDVTAFRPRADRDNIVTSDSGVASAQSFDFLPIQFFVQDYDNYEYETKNFVGTLEWAPNDNTKFYFDAVINDQERRQESSRVQASGVSALNDISVPDEFETINLGSLGGTNLGSIQAALRGVIPVNLANDDDDPNLRFSSDTNSRVTDSNIFRLGGEWQGDKWFVSAEIASSSSDTTTPSFNTTLNFINPNAPLDAGGGNDNSVPFEYDLSGGALTFGIAQGAEYAPSVEQLLDPANVVLRDVNIGQDTVENSEDAFRIDSTYYTDSIVTSVDFGYRYSKSASKQNEITSSVGLRSMADSPRGDLFADLLVAGPDNFNEADGRSLYIGDFLLIDPELVASDPDAVLATLQQALQTHGSSRTLNAPTSSSSGFFDIEEITHAFYAQANFEYDMFRGNFGLRYIQTDVESTGNSVTQDGSGNELVTRITNESDYNFILPRLNLVADVSEDVVVRFGAGKDIRRPDYNDLSTSITYSTSPNDEVEFGNPALKPEEVLSYDLSADWYFTEASVFSVGIFHKTRKELHVNQLTSPVEDPVTGYRDLTDPCEGGGIFNPIADINVFGPENGRGVCVGTETKVNDTGETTQKGIEFAFQYDLSSFEKDLGWASGFGVLANYTIQEFSGGETVNKATSRASNVFAASTGTPGIEVSEIQGLLNLSENAYNFTLYYEKFGLSARMRYTWREGYRSNDFGSTSSFPWGFPVVQEDRGQLNASISYDVNEQLNIGLEAVNITESEISQSCVNEGSLLCFQGLTDRRITFGASYRF

SEQ ID NO: 14978 - protein, 683 aa, Pseudoalteromonas atlantica
MNTSKVSVAVCLALSSQLAIAEVTDEDKYLLDSITVIASDTDIQESVRSPQAITAVDAKTISNISSKNVPAAIQILPNVDVLGGPTPSNENVSIRGLPQSHAYVAIDGIYQSNFATKRGSWYLNPNFIKNIKVTAGPTSGAAAGKITIETLSALDLLAEGDTFGTKIDLGYRSNNAQQDYGLSLFGKSDTLDYLVSGQTSQRDAYEIGGVGGTYDKTRGDQQSGLIKIGNQFNADQRLTFTVNYDDSRTFQVRNDVGYRDTKYAGSSLVWTDQASDNELLDLQASVYFNNVDSFSWEEERGDVEGTQDIQDKSFGYSIGNNSLVDFGLLHYGTSGHFTTHTGAILKTDTQTGEIIEDESAGSEASSNSIKLATWINMQLPVGDSFEIIPGVRYDSFYIESSNAIGLEGEALLRDGRTESRVSKSLNMLYHFNDEIKFFASYAEALNAPGNGSLFTSGRGFKPNPELKSERADNKELGVVFDYQSIFSEGDSWVSRVNIFQNDIKDFITDLYSTEWPDGERVNIGQAQLKGFEFSTNYHLGDWDLSASYGQTRGIDKNTGWYLTDMPSDKINLISNYNVNDELVLGTSATFAFTHDKTPTQQLVAGGEIEDIPSEGVGSWFTMDIFSTYEPKKIKGFKVNLSITNLFDRGYAQRMDFERNGDPKNPIEFYEEGRSINVKMSYAF

SEQ ID NO: 14979 - protein, 224 aa, Pseudoalteromonas atlantica
MKKHTIAIAAFALCTLPAVAGATPARPGGYVSGFFGVSAASDADVTSIDNQFGDVFNDRVEYDPNIYVGGTGGYDFGHFRLEGELSYKHAEISSITDDTGFRFRGVDGNLGALAFMANAFVDLHNNTPVTPYFGGGIGFAVLSLSDTYGSDTSGRLLLYPEDDTTVFAYQAGGGVEIAINPSLSLDLGYRYFGTTKGTFDSDWITTTKLKYESHNGMVGFRVKF

SEQ ID NO: 14980 - protein, 1108 aa, Pseudoalteromonas atlantica
MNKQPIVYGFALKRSIKNTKITFAVLLLFILQGIVGNVYAQEKKISISVKNEKLETVLRMVEKQTNYLFFYDSDEINKQQRITINQTNSSLKDVLDAVASKTNLSYTIKGRHIILAKKPNVSSANKDGRASGSEKKITGIVKDEADLPVVGANVIVPQTKKGVITDMNGNFSLEVVAGDEVEISYLGYTTQKIKISAQSFLNVVLREDAKSLNEVVVVGYGSVKKSDLTGSVASVSNTTLLRGGKTNSAGALQGELSGVTITRSNNKPGGGYDIKIRGINSITASSSPLIVIDGVPGGNLDFVNPDDIEKIDVLKDASATAIYGSSGANGVIIVTTKRGQTGKPKISYNGYVGVRSYTNLPDMMSGDEYVQLAREATRGGSPNYIYKRDEQIFTDPSELQAVKEGKYFDWLDAVSSPAFMTNHSLSAIGGTEAVKYGFSGGYYFEDGMIQPQEYTRYNLRSVIDITINKHVSFGGSMYAVHSIREKGNWDLLRDVFRMRPTQHPNSLVTGEEIWKYSGNNLFNPLVTSKNQRSQVKSLNLQSNIYLKITPIENLELTSSFSPYFTQTSMGDYIGVWTKAQQGTAKGAKANATKDNSLSWIWDNIVNYTWKKSVHSITATGVFSAQKYQYDRLYGASKDLSFNSLWYNLNGGAIESLSSNFSQWTMMSYVGRINYGLMDRYLLTASLRYDGSSRLSEGNKWALFPSAAIAWRITEEDFAKNLDWLSNLKLRFSYGQAGNTNSVSPYASEGTISGSVYYPFGTSTSVGNLPANIANPMLTWERTSEYNVGLDFGFLNQRISGNIEYYNRTTNDLLMKRNIPVHLGYSSVTSNVGSVRNSGFELQLNTANIMTKNFAWNTTINLAYNKNEIVSLADEEDLSNYSIHLQGMRGRYSDKRFIGKPVDTNWTQNTIGVWQLGEEEEAAKYGCVPGNFKIKDYNNDGKLTDDDYIIDGKRTPDWTGGMTNMFKIYDFDFSFHMYFQAGATQYDRFFENFALEWNSQNFNNLRTNYWTPENPSNTMGRPSQMGSRGNIAYERTDFLKVSYITLGYTLNKRLMSKWGLDNARIYVTVQNPFILTKFRGLDPEQPDLTNIGDTDGMTMNALLGVNISF

SEQ ID NO: 14981 - protein, 708 aa, Pseudoalteromonas atlantica
MHAKTALALGAFIITSTTTSALADHDHSIEEITIQAFPLASQISVSPQSNPLHSPDSAELLKRIPGANNNSNGVITGIAQYRGMYGDRVSVKLDQAPTLSGGPNAMDSPLSYAPAGLLKELIVYRGITPVSQAQESIGGHMAAQFNRGNFGSNGEIEINGFARAQLTENGNQSNSDLQLVIANNQQKFSFLGSYNEGDNIEAGDNKTVAGSQHQRDRFDLAYGWTSGSTELTIFAGQLDISDSGTPALAMDIASVETDLAGMTLSTDLNGTYLNGTDLSGTSINMAVAWADVTHSMDNFSLRAAPPMTMGYRSNLATADNLSWSLDAQLPLSFGELKIGTDGNLSSHDSTITNPTNAMFQLLNFAGTQRDILGLFAELNGDMGNWGYQAGIRQNRITLDSGTVSSSGMMAMMAMMGDTANMLAMQFNQADRNLDYDTTDVVLKLNRALDPQTALTIDLGIKNRAPSYQETFLWLPLPISAGLADGRSYVGNLSLKHETASEISIGLSKRAQRFSLYPQIFYRQIDNYIQGVPSMNMAANMVSNMMSGATALSYENTDAEIYGADANWDYSINSNWSADGIFSYVRGKRTDVADNLYRIAPANARLSLRYRPDQIPVQLMVESVIYGRQKYVASYNDETQSSGFGIINIGANWSLSESIELRSGVKNLFDRYYAPHLSGRNRTGDSDITLGAAIPGLGRAVYLSMAINF

SEQ ID NO: 14982 - protein, 981 aa, Pseudoalteromonas atlantica
MKRFSLWLVLFVLLGVQSALAQSYTIKGSVVSKSNNEPLIGVSILQKGTTNGVVTDVDGNYVLQVQGGDATLIFSYIGMQTQELRVNSRMGVLNVVMQDDAQLVDEVVVVAYGVRKKGTIAGSVSTVKGDKFESVPAASFDQALQGQASGLQVMSNSGEPSAAASFQIRGVNSINAGVSPLFILDGIAVSADDFSALNPSDIESVSVLKDASSTSIYGARAANGVVVITTKRGKMGEKGHITARAQYGVSKLAYGKWNQMNTSERLDYEEEIGLRVPGTYDRELLERTNIDWRDAVYNDNAPFSNVELQFSGASDRYNYYVSGGVYNQEGIALGSDFTRYSFRANLEAKLNSWFKIGTNSAVSYEDISEATSGEYTTVTPISAARFMLPYWNPYKADGSYASVSDDTWLGTNVNPLEWQANNPTNSNKWKVMANLYGELRPIEGLVIKSIGGIDFLDRRGDVSSNPSYLPNMGEGYLGRSFSRYYNLTWTNTINYVFDYKDDHHFNVLLGQEAVNNQSEAFSIITRGQSSDKLLNMSSATRAESPSDSFSGSTYLSFFARGEYNYQGKYYADFSVRRDGSSRFGKNSRWANFWSVGLMWDAKREAFLEDYEWLTNAQLSASVGTSGNSSIPPYDHLALFAGGPTYGLEGSVLPGIAPYSRGNEDLTWEKLLTTNIALKLGFFDRINVVAEFYHKKTTDMLMAVPVTLTSGYVEQWDNIGAMVNKGVDLSFDIDILRMRDFRWNVGANISYNHNEITELYGGRDVYELANTNLLLKKGHSYGEFYVNRFAGVNSVNGDALWYDKDGNITNVYSENDKVLVGKNSIAPWQGGFNTMFSWKGLSVSAQFSWVKDRWVMNNDRYFDESNGMFINQNQSKKLLYDRWKKPGDIASVPRHGVVMEFDDRLLEDASFLRLKNLNISYSFDRKLLQKTRIIENLRVFAQAQNLFTFTKFQGMDPESTGNMYQAQYPMSRQFSIGLEVGF

SEQ ID NO: 14983 - protein, 867 aa, Pseudoalteromonas atlantica
MKNFKNLLFVALFFISATVLGQTKITGVIVDDTNQPMPSASILEKGTTNGTQTDFDGNFTLTTKSNSGVLVISYIGYKSKEVSFSSSKTNLGTIKLFMDENSLEEVVIVGKGVIDLAGGRKTPVAVSTIKAAEIQKKVGTQDVTMTLVNTPSIYVAGQAGGFGDSRISVRGFDQTNTAFLLNGQPINGMEDGRMYWSNWSGVNDIASAIQIQRGLGASKLAISSVGGTMNFVTKTTDKQEGGYFYAGTANDSYLKTTVSYNTGMNDNGWGTSVMLSHWQGEGYNNGTKGQGQTYFISFGYKPNDNHNFNFLITGAPQWHDQNFTKSISTYLENGFKYNNNFGFYQGQYLTERRNFYHKPVLNLNWDYTISDDTSLSTVLYASFGRGGGTGNRGNRERTADGLIDYDAIYANNAATGGDGNFGNDAYITRASMNLHSWYGVVSNLETKISENVTWNVGTDLRTYYGTHFRQVENFHGLTSWTEDRSLRDDTDNRVGPSVSVTATESMNANPWEATFNTMSEDQRIDYDNSERISYGGLFTQLEYADETVSAFFQGSVSNQSHQRFDRYDYQEEFEDSEKINNFGYNIKAGLGFKLSDNSNYYFNTGYYSRQPYHDNIFNQFTNAVNPSSQNEKIFGLEMGYNYRSEKFSANVNLYSTSWRDRVDGFSDVDPTTGVVTITQTTGQNQYHMGVEVDFIANITDNFRLKGFTSIGDWKYKGELTTLVFDEDRNQIGAASTVDVDGINVGDAAQFTAGLGFDYSILDNLSIDADYRFYDNLFANVSPTQGQLQLPSYNITDAGVSYTFNLKNDKSLDFRANVNNVFDARYISELSSANQATSNSTLYKGIDVSNRGYFGLGRTWNASVRYNF

SEQ ID NO: 14984 - protein, 873 aa, Pseudoalteromonas atlantica
MNTLSLTAKAVRSSFIVAAASSVAFSGLAFAEEQQEGAKVERIEVTGSRIQRTDMETASPVTVIDASAIKAAGATSIDEVLQKMTATGGAMTNPGINNGSQGNASINLRGLGSQRTLVLVNNRRMVNSGTGAASTVDLNTIPVSMIKRIEVLKDGASSVYGSDAVAGVVNIILKDDFEGLEANVQTGISGQGDASETSFDLTMGGSFERGNVVMGLQYMDRGEASMADRDSTQCDYAERTGADGKIELYCGGSSYTPGGHIWGPDGRDSLQGNLDGSWHEFTDDDKYNYNASSYLYTPMQRLNLTALGNFELTDSINLFSEAMYSKRWSEQQMAPQPIWTDTFTYTEAMGDSLLEHGYEYGDELDYGRRMADVGNRGFSQVVDTVRVVVGLDGYLENGWSWDTSVNYGRNDSVDRLANLINMGSVNTGIEEGTFNPLDQSSWSQENMSEYLYTELNSGGSEMFIASANLSGEAIELPAGYLGFATGLEHRTEKAWFIPDSLTSQGMANDPKVEPTGGEYDVTEAYLELAIPLLSGMFLAEQVDMSAAVRYFDYSTFGSDSTWKLGLTWRMTDDFMLRSVASTAFRAPSVDELYSGKSPSFDQVEHPVGQDQAEVTRGGNPNLTPEEAETFTAGFVYSPSWFDGFSVTADYYDISITNSIALVDSQYIVDQCMDAQGNPINTGTSLCQSADIKMGGGNRIIFNNQLQNIGAENTSGVDINLAYAFDAAELAWKTSLDTTILLENESIILGESIDYAGLITSGSGGFAKYKTNFDLGVEGDSWGASYQARYISGMDSYACQAKPSSCYAPSTDSILYHDISATYFLPQGWTISAGVNNLLDEEAPYYTGNNDANTDPYTYDTLGRYFYLQASVKL

SEQ ID NO: 14985 - protein, 751 aa, Pseudoalteromonas atlantica
MTKGKILLWALASTAFTAPASAQDGDAGRAADEIVVTARQRAEALQDVPVAVSAISGVALEKAGVTQTRELFASTPGLYFSQTGQRQNDEQFYLTIRGVGSSPVVEPSVGVFVDGVYMPSLGWTADFLDLERVEILRGPQGALFGRNTEGGAVSIVTRKPSAELRGRVSAEVAEFGSWRGSASVSGPLAENLYAGISGFASTTNGYMRNVTRNEHQDNRDRHGGRLMLRAVDVGGFEVLLSGDYMKSKGRFDAFGDAVAGQAITVVDPQAPAAARGTTLVSNPLAGRRYTTYGNDENRVSSENYGAALQIMRDIGPAVLTSITGYRRVRSRDIYDNDAIATASSVNGALTKQRILSQELRLVSDTQGPLSWIAGAYGFKERLDQDRLSQFFSGTTAGPIAGSGNGFGYVSDEATIRRDGLAIFGEVNYDVTEQLELSLGARYSYEKVRQDPNLNVAVQIGAVVVNVANATPRRKAFDGFSPSASLSYKLQPGILVYASAATGFKGGGFTKEVPNTPLQNAALDNETSLNYELGLKADLLDRAVRLNMALFYTKLKDQQLATRIELSPGTGVYIPSTLNVGRGHSQGVEVETVIRPVRPLRIAGNLSYTDTRFDDYVASPATATAPAYDRAGQAFPEVPKWLASASVEYAFELGNDLTLVPNVSWRHVGSKYVGQGNASIPFITIDSYDLFDAQLSLSKGPWSVVAFVKNIGDKYYLANRFQNQPATSAPGFLNWGKPGAPRQFGARFSYDF

SEQ ID NO: 14986 - protein, 738 aa, Pseudoalteromonas atlantica
MELLRVRRVLIRCATFYRNANDSYLHFYLSAMTVSLARPPVRPRRVAAALACVAASLAHADDSPGGATALPAINVTAAHDSPQHLTDTISTGALGTRRQLDTPFSTTIVTSEELEARQPYKLGDVFANDASVSDNSGAYSAWASYMTVRGMQLDWQNGFKIDGLPFVTYGITMPYEQLDRVELLKGLGGFLYGFVTPGGVVNYVTKQPGAEPVRSVDVGYRSTSVWTEHVDLGQRFGPNGMFGARLNATHEEGKTYNDGNIRRDSVSLALQANLTRDLSVTFGALYQDRRTTGQTPSIFTGSYPGGVLPATISGGTTNLGGKDQYLNTNLQLYTAGLQYQLAPDWQLDVAYSYSKATRRRNESTLTLQDAAGNYTDSRYVGMEDHRFSQWRAMVEGKVRTGPFSHQIVLGASWQKQANDYSANSVFVPLGAGNLYAPNPYRYDSPHGFVQYRTSEIVQKSLFASDTVQLTERWSVLAGVRYMNYEQRSFQASGVEDPGYRQNGVVTPTFAVMFKLAPTTTAYASYAESLEPGSRVNDVYANAGQVLKPLRSKQYELGIKSEHARWSATAALFRIERSAEYANAANVYVQDGESIIQGIEFGARAKFGARWTAGVDAMLLDAWYANGIGNNGNRVAGAPRFVLAGDIGYAVPGVPGLTLGVDAKFTGATPLRAAGGLDAPGFLVVNAGARYLTRVGRHDVTLRASIDNVLNRRYWEYQYADYVKPGDPRTVSLSAKIDF

SEQ ID NO: 14987 - protein, 669 aa, Pseudoalteromonas atlantica
MRATGGVHKRSILASTGLAVILVAMTSQAFAQEQKASEEEAGVALKTITIRRANDAQAPTSVAAPVGRVDREEINRFGGAKLDDVLRGTAGVFTLQNASNPGVAVNIRGFEGSGRVNMMIDGVPQSYRNTAHDAQGYAYIDPNLLSEIDVARGAVTTEGGTGLAGSVNFRTLGVDDVILDGKDKGVLGRASWGSNGTGFSEMLAGAARVNSIGIVAAISRHDSNDYKNGDGVTVEKTGEELTSGLFKAEFGLGEDQKLTLGGVLYNNHYGTYANGYRPGTYTIYDMFLQNRTFFAQYNYNPSDNDLIGLDVNLYHNSTLQNWEDGNGSFVGRQVSTETTGMTASNTSRFTFGEVAVAWKNGFEINRDTAGGTQTGVNPTDATSNRGAVFSEATWNYQALQVVTGLRYDYFKLESEDSSISNSDGEFSPKVTVAYNLTDWLQPYITYAHSMRSPSLQETFLGGVAHTGTGMMHGNPNLRPEKQRGWEFGVNIARDGILTAEDGLRLKANYYTMRVEDYITAASDYSQFINVDGTSTVKGFELDARYDAGFAFGGIAYTHSTSELPEQTAGMGANQYLPEDVVTVTAGARFFERKLESGLRVQHVSSGKSISGNDTDPYTLVDVFAKYKFTETVDLSLQVLNIADKEYTPALSTYGSGRGRTFLVSTQFQF

SEQ ID NO: 14988 - protein, 970 aa, Pseudoalteromonas atlantica
MTITTFQPLAAPKQARFGHSKKLLAVLVAAAAIQTPTTFAQEESSNQLEEVVVVGSLRNTMRNSIEIKRDAESIVDVISAAEMGALPDLSVAETLERIVGVTGDRFKGNASEISVRGLGPFLGYSTYNGREISSGSGNRSVAFSQFPSELVNGAVVYKSQTADLVEGGVAGLINLQSLRPLDYGKRRIQAEVKANYNDYDAKLNGDDGIGYRGSVSYTDIFDTDIGAIGVAIGYASHDSSTPEESYNTSSSLRNCNSDYFEDGGSNCSWSDSNAAANGGAAADGEYYFIPNAFYFRQMESEETRDALMATVQWQPNDDLNIVADAQWSDRFYYEDRHDLYFDDGRRRIGNWTTNDSGALTSYTGESRVSTYGEFRERDEVYKGAGLNVEWQVNDKLIVDADISYSDTVRYQETWQTRFRSDRLWYDFDTAGDYGSSWPTVSLYTDSDDAASSEIDYSLLNDYDFYDANQRARYGEAEVNDSISALAINADYLLEGDFITSIEGGMRLSSHEHKNYGEDRVEFTATDHADITDIASGCATAFPQSGFGDDAGGNLTEWATYDTLCAFDLMVGDEDMSLTPEAASAGDVILSENINSAFAKFNFNTMLGGVDVSGNFGVRVVQTNVESVGYRQDYSVVANDAGTPADTSDDTVTITETDGTLKKEVYNNDYINVLPSLNVNFTLNEEVQIRTAIYGAISRPDMWWMGAGRDLDLGDGEEDFASVAEAVAAGNATALGNPNMEAIESMNYDLSVAWYPSEDTMLSAAFYFKEFEAGLDVADSSTVQESFNINGTDITMDVNGLIQNTSEASNISGVELSLQHGFTTLPQPFDGLGVMAGANFADTNFDYFENGVDMTDDVVIAPASLPGFSKQSYNAEVYWEKFGITSRLSYKYRSDYLKPFGSDFGQTNRFVEDTSSVDLSLAYNVTKNVQLKFQALNLTNEPYAEYRVTDGSYNRIEYSGTKFFVGVRVKL

SEQ ID NO: 14989 - protein, 84 aa, Pseudoalteromonas atlantica
MNLTTFNNTYSAKVHNSNFQFLINLGLRTNLATAKKRYDAHSAQHGMELGVKIPTINTNYYSFVGTQLQYRRLYSVYLNYVFAY

SEQ ID NO: 14990 - protein, 765 aa, Pseudoalteromonas atlantica
MPIKLPQTLSFFLLFLCCSHMLMAQYVIEGTVIDQSTNIPLANAIIQNVESKAAITTNARGTFSIVTKNTVDTTLRISLKGYQTQTVLVYTGKKIVVALFPTTNALDEVIVNGITIQQKLKQTTEAVAVVNEREIYSENTVQLAPILNRVPGVFMQSGTLNTNRITIRGIGARSPFSTANIRAYYADIPLTDGNGESAIEDLELATISRMEIHKGPSSSSYGVGLGGTILLYPEYAKYNASSANLYTTVGSFGLFRTVAKVSHGGEKANVNLIYSNTHSDGYRDNNSLDKATATITSNWFVNDKNELSFIGNYTSLKAFIPSSLNREDFENSPRNAATIWQNARGFEDVKKTLFGINWSHHYNETFTQKTSVFTSFNNNYEPRPFNILEEKATTFGIRTRLLATKNFENSSLKWSVGGELFFDDYNAKQFDNLYQDFPDGTGSVAGDILSDIDENRNYFNLFAEAIYTRKKLTLSLGLHLNQTKYTVQERLNASTEEDFTFDAIVSPKLGINYAISNNFNLFGNIAHGFSTPTTAETLFPNGAFNPNIKAERGWNFEVGSRFHTKNRKLTGSVSIYSMAVSDLLVNRRTETDQNITLNAGRTAHNGVEAAVRYELLRDKNITVYSHVNASINDFSFKEFTENDTNFSGNDLTGVPKSVVNLGIEALSTKGFYGRFDFQAVGEMPANDENTVYSDAFQLLNGKIGYQNSIGSQFRYDISIGANNIFDKSYASQLQVNAFGNDTNARYFYPGLPFNMYGGIQLAYKL

SEQ ID NO: 14991 - protein, 1086 aa, Pseudoalteromonas atlantica
MLKQLKSVSMLLFLLTMSVEAAYPEIGESTLKVSVVQQGTTCKGVVKDAAGETIIGASVVAKGTTNGTITGINGDFSLNNVKTGDIIVVSFVGYQTQEIKFTGQSLNIILKDNTQTLDEVVVVAFGTQKKVNVTGSVSTVGAKEISARPVNSTIEALQGMVPGMNISTGDGGGSLGSDKKFNIRGVGTIGAGSKVEPLVLIDGMEGDMNAINPQDIENISVLKDAAASSIYGSRAPGGVILITTKKGKSGKTVVNYNNNFRFVSPLNMPEMADSYNFALAVNDQLTNGGQTPMYSATKLQQILDFQAGKSTQYMWPTDAGRWNSFDDPQRQDVMPTGNTDWLKTLFGNSFTHEHSLSVNGGTDKIQYYLSANYLDQGGLLKFGDDNKQRYSFTAKINADLTKWLKISYSMRFNRTDYEAPSFAGGDIKSNVFYFDVCRYWPVIPVVDPNGFYTVESKIYQLTEGGRYKSQKDVMAHQLAFIVEPIKDWKINVELNYRSNYNFDHTDYQTVYGYDVSKNPYIIANQTSSVTEYAYKSNFFNPNIFTEYGKSLESGHNFKVMLGFQSELFKQRDITASQDGIMSEVATLNTTQTNAQNRGGYSEWATAGFFGRVNYDYKGRYLAEVNMRYDGTSRFLRDNRWNLFPSFSLGWNMAREAFFEDLTDLISTFKIRGSWGELGNQNTDNWYPFYRTIDINKDQWGNYALGSWLVNGVKPNISKESALVSSLLTWEKTQTLDLGFDLSMLNNRLNVTFDYFQRKSKNMVGPAPELPNLLGIAVPKVNNLDMTSKGWEIQVNWRDQIRDFKYGVTLSLSDNQVVIDKYPNPSNTILDKDNNNTYYAGAHVGDIWGFQTIGIAKTDQEMKDHLAGMPNGAQDVLGSGWGAGDIMYADLNGDGQISRGNKTLADHGDLKKIGNSTPRYNFGLNLDAAWKGFDLKLFFQGTMKRDYMPGSGSTMFWGAVGYWQTNFFKPHLDYFRGEDTTNPLGANLGGYYPRPLENDRNRNPQTRYLQNAAYCRLKNVTLGYTLPKSLTEKFCVNNLRFFVSAENLFTITSLADTFDPETVGIGNWDGCTYPLSKTVSFGLSATF

SEQ ID NO: 14992 - protein, 704 aa, Pseudoalteromonas atlantica
MKINTRQCNWRFSLLAVAVAFAQPALAEERQENGTSREEEVSLSATMIKGDVLGQATDEEVRTYAGSRSVVKAEDLEKASVRGLDDALQRVPGVKIFDETGTGVLPQISVRGLYESRSGRVQVLSDGIPLSLSPYGQTSLSLFPQTLATVDRIDIVRGGAAVQYGPNNVGGVINFISKPIPKEWENNLAERITFYEGGHQLFDTYFSTGGRVTDSLGLFFEYDAKSGHYERDHSDTDVENIRLRGQWDIDENRSLSFGIQRYDADQDLAGALSKKDYDKDRRDSTRNLDRFEGDTDRLWGTYKQYLGSIGFADDVEFSFTGFGHHDYRNYYVGLDAARTFNPANPPAYLQDAPRDYRVWGLEPRLSFTIYGDKVNQTWLIGGRYVREDTEFEVYRENLRTGAVDTVRDWDFDTEGKATYISNAISMLDGRLTITPGIRHERVHQDYSDAVTGKKTENLDDEWLPGLTMGYQMTDEWFLFANAQRSLRVPQITTIVYDGDVSSEVAWNYEVGFRYTPLPNLRYDFNLYRIDFDDQILFQDGAWKNVGSTRQQGFETELFWTPAAMPNLDLHASYAFLDAKIRTGQYEGNEVPYASQSQFNVDARWRFAEGWTYTLDGLYVSEAYSDDANHREENATGSYGELPSYWIWNTSLERKFKLKESELTTSVGVSNLFDREYYFRGIDTSPMGRQPAPGRAVTVAANYRF

SEQ ID NO: 14993 - protein, 452 aa, Pseudoalteromonas atlantica
MKSHLLRPALRPVAGSLLSASLLCNAAHAAEAFSPNSKWMLGDWGGKRTELLEKGYDFKLEYVGEAAANLDGGYDDDKTGRYTDQFALGVHMDLEKILGWKATEFQFTVTERNGKNLSNDRIGDPRAGHISSVQEVWGRGQTWRLTQLWLKQQYFDGALDVKFGRFGEGEDFNSFPCDFQNLAFCGSQVGNWAGSIWYNWPVSQWALRVKYNFAPDWYVQVGAYEQNPSNLETGNGFKMSGSGTKGALLPVELIWQPKVGAEQLPGEYRLGYYYSTAKADDVYDDVDGQPQGLTGNDFKSRGSKHGWWVVAQQQVTSHNGDASRGLSLFANLTVHDKATNVVDNYQQLGVVYKGPFDARPKDDIGLGIARIHVNDDVKKRQRLVNQVNGIDDYDNPLYQPLQDTEYNAELYYGVHVTDWLTVRPNLQYIKQPGGVDEVDNALVAGIKIQTVF

SEQ ID NO: 14994 - protein, 1109 aa, Pseudoalteromonas atlantica
MLFMTFSVQCSLAQLNLNTSRTTLGKVIEQIKSQSSYNFFYDDKLASLAVENVQLSNASIEQVLNTVLNGKNVSFKIKGGVVYLSENKQTPKNGNQQGKERKITGRVSDDMGPLIGVNVLVKGTNVGAITDMDGNFTLVTTEANPVLQISYIGYTTQEIAVVDNTPLNVKLSSDAQQIEEVVVTALGIKRATKALSYNVQEIKNDDITQNKDANFVNALAGKVAGVNINASSSGVGGISKVVMRGTKSIMQSSNALYVIDGVPMFSGRNARESESEFDSRGTTDPIADINPEDIESMSVLTGAAAAALYGSEAANGAVIITTKKGKEGKVSISVNTSMEFNQPFILPRFQTRYGTGTGGKWVDGSSQSWGDKLSVSNYYGYNPKDDYFQTGIVNTESVSLSTGTEKNQTYASAAAINSKGYIPNNKYARYNFNVRNTTSFLNDKMTLDIAANYILQNDRNVVNQGEYNNPLVGAYLYPRGNEWADAELYEVYDPARKIYVQNWTVGDAGMTMQNPYWINYRNLRENKKDRYMLSANLSYKLLDWLTVSGRVRLDNSNNDFTEKFYASTNTQLTENSSRGLYGITKMQDKQLYADFLVSINKTFGEELTLSANIGGSFNDIRSDAMSVRGGIADGTDAYPDEQVGLTNYFAIQNLSNKAKRMQEGWREQTQSVYASAELGYKSTYYLTLTGRNDWASQLAGPNSTSKCFFYPSVGVSAVLSELFPNLNKDYLSFWKVRGSFASVGSAFQRYLSNPRFEWNSSSGQWSVLTQYPVYSLKPERTNSFEIGMNLRFLKYFELDATYYNAKTENQTFNPNLPVSKYSKMYIQTGAVRNQGVELALNFKNTWSDFTWSSGLTYSMNKNKIETLADNAINPVTGELFSIPSLDMGGYGDMRFILREGGSMGDVYSRMDLQRDANGAIYIDENNKIYTQSIQDPNQYIKLGSVLPKGNLAWRNDFSWKNIHVGFMVSARFGGVVFSRTQAVLDNFGVSEFSADARDLGYVTVNGNDRVDPEAWFSTVGSKAVPQYYTYSATNVRLQEASIGYSIPRKWLGNVCDIKVSLVGRNLWMIYNKAPFDPEAVASTSNFYQGVDNFMIPSLRNVGFSLNFKF

SEQ ID NO: 14995 - protein, 794 aa, Pseudoalteromonas atlantica
MSFQVNSKTAIIITLSLGTITLPAGLQAHQYTGTNNKADNLSLSSDPISDLKSSLPDKKNDKEKNFQKNEADHHSKDEKNVYWSGKEITVIGKAERLAPSSVPLNITQPTSIIQSSFMANNIIPLASVDDIIKYQPSVWTQNPNGPGIGKAETMSLRGFQDGQYNMTFDGIPFGDASDLHHSTSSLFIAHFLGQAEVDRGPGTASTIGNATFGGTIGFTSRKPSEKFGITPYGTYGSYNTRAGGLEIDSGETIAGKMVLDLQHEATDGYLTHSNERRSNIMFKDVIKLGSDITLTAATTFNKEHQYTTQGATLAEYAQYGKNYGLCNDPQLQCFYKYNPSTYKSDFSYISLKAKPLSWLELENKVYSVGFEHSYTKTTDASQNSPSANGVTFYNAAGKKVGSYANDVPGKYADAQFRAYGDTLALKAKTPVGDILTGVWADVQNDRRYTYAVDLSQNSIMVPGKNGSAYSYNIHDINTTLQPYLEFDWHPMKGMTVKPGIKYSYFHRNYDAAINKNTKTALKDNQSFKSWQPSIAINQILMKGWSAYGQIARGFLAPPLSVFQTQNVGYVKPETTWNYQVGTVLQKKNWTISADGYYIDFSNYIASAQINVPNIGTETTYVNSGGAIYKGLEIEGQYAIGYGVSLYGNYSVNSAHYKDSKIRVAASPKSLASFGVLYEKKDGPYFSFIGKYVGNHWGLDSTTDTAGNTVFKNQYLIHSNITADMAFGWHFKNVGGNILRNITPSIKISNVFGSHAISDFAGNQSKTTAEYPNGAPLYWRLSGRSVFFNLTMTIL

SEQ ID NO: 14996 - protein, 569 aa, Pseudoalteromonas atlantica
MKFCGYLVSNPKLLTPGVRIEFMKNLFKVMLAGPLAASVAFAGAAQAESLNRDTINQVNAIANEELPAAQVTSITQLSDVKPTDWAYQALQSLVERYGCIVGYPDRTYRGSRALTRYEFAAGLNACLDKVIEFAASKEDLDTLKKLMEEFQAELATLRGRVDSLEARVTELEATQFSTTTKLQGEVILSLDRAFGPSGLDTGTSFSQRVSLNLNTSFTGKDLLKTRLRSNSITSPGLRDFNGGVPGSGIISPAAALDYDNATNAPNANFFLDTLLYTFPVGDVKFTVGTSNLQVEDILSTTGTFYAPYISYFFSTPIPGIYGDADTTNSAGAGFNWQLSKSFNFGAAYINQNGPTTGGNLASDPTSGVFGADSQTTAQLAFKNDSGTFIGALAYAYRKGPDLATDLSFLPSQFGGVNFGTPRALAGLGLGSSGSDIVSTNNIGLSLGWAVSDGFTISGSYGISFGNGFGANNTVQSWTVGFTFPNLFADGNEFGFAVGQAPYVISDSRGAAFQDTGNFAFEVYYKLQVTDNISITPALYAITNAGGGLSFPDSANGDFIVPVIKTVFTF

SEQ ID NO: 14997 - protein, 390 aa, Pseudoalteromonas atlantica
MKQVRSLALLALPAALYAAGAHAQSSVTLYGIADAGIAYVHNAQNANGSNASSLVKFSSGNLSGSRWGLRGTEDLGGGLAALFQLENGFNIGTGALGQGSREFGRKAVVGLSSSTYGTVTLGRQYDPVVDLVQGLTQDNYFGGVFATPGDLDNYDNSLRVSNSVKYTSPLISGFQFEGLYGFGGVAGATGSGRTYSFGASYANGPLSLGAGFFYANGGSTVANGVRNWSSSSDTLFNTVINQGFSSAKSIQIVRVAGQYVAGPATFGLAYSNTQYGADTLSAFSQNAKFNNGSAFFNWQFSPALRAGVGYNYTSLTGPSSAHYNQVNLGADYALSKRTDLYALFGYQKASGNTLNANGAVVKAAASVGSYGVNSGTDTQELAIVGIRHKF

SEQ ID NO: 14998 - protein, 690 aa, Pseudoalteromonas atlantica
MARLKVPCLLFAPLLLLPGGPAQATDDLKLAALPVEDDADDSWSEPVGASIPAYQRFALPRSVAAVQTLDREDIEAIRPRDVSELIEGSLGMSIGRQGARVHNFSYNRGDKVSIILDGVYLTQTEAQRVLGDLPVEMIDSVRFLRDSSVITISPLMDFGSANAGSPNQGFILIETRKGGPGKDRGDFKTSYARFDNRKTLGFLSDSWLDDRLTLGGGYQRSDYNGRPGWNMEYHSDTWLANGGWKDENFIASASFFLNKASREIQRAEGTYTGATRYPVSGPTPNHVMDKNIWKYTPMDTRVIAVNLAKPWNDVHTTSLTYGWTEAKGTQYAYSLTTDKSTVAGREAKDRAKEWNLSHTIATAKTTLKFGGQTVEWYQFTEGGTSSREEKVYGLYTTLEHRITPGWSVDAAFRIDRKHIIQGGDKYLDNGTRTELSDDEWTDDATLFSLGTAWQIDPVWRVSARYSFNFTPTPDQISTRNNENLPGEKRHRYELGINANFSRALRLGLTPFYYVLRNAKVSDGAIDTDSEGNPIVDPSTGDQTSVTIYKAVDEVIRKGIEVSLQGDSGPWSYELGWTYYDGNDENGTTGSEVPDNKFNGRLGWRHGPWNANFSVVRVEPYKSYDYTVGDFTTVNLNLSRELGKGFSVALFGQNLLDEEYGTNNKGYPATANWGVVRDVGRTFGTELRYHF

SEQ ID NO: 14999 - protein, 710 aa, Pseudoalteromonas atlantica
MSVGTSFKFSRVGLAIVAALASSTAFAEEATAESNVKVDSNIERISVTGRSFNDYNAGSSSGAMRGDIDILDTPQSVTVIPDFVTDEQLATNLSEVLVNDSSVTGGSEKWNRQVFNIRGFELSSGSGFLINGQQQWSHYVQPIETLQQVEVLKGPSSMLYGQSGPGGLINMVTKKPTYETMLDIGFDTDENGSTRFQLDAGGSLNEAETIRYRTVLVKQDTTYWREYQDGTNQERDRWLGYLNLEFDITDDLMLSLKYDHTQDKTGIDRGGWLDSSGDLIGGRDIIWDQPWAFTDNTISNLGAELTYHLSDDWKVKAGYNDQQFNRQRLDSSPSLISGSDDPFTDGYYVSPFDRYDDWQHKTGYVDFTGNFYTGDIEHQLLIGANMLDYYYGQLKDSGEKKQVVMPGQPMPKPDLDYNRDETLYESEYKHYGFYVQDLVSITDEWQVLAGVRYDEQKKEGAGNNSYAVSPKFGVIYSPADNGSIYVNYSKSFTPQGIVNDIDDVNDGKNLDPEYGEQYEIGTKWELFDGSLLLTGAVFDITVSNVTVTEEIEGSSQTITTQSGEQRHKGFEMGAQGQVSDSWFMTGSMMYLDAEYLRPETDSLNGKTPVDAPEWSANVWTRYEMTDDLALNFGAIYVGERFANTSNSISKDGYVRFDMGAAYTMDVMGSDVSMRVNVKNLFDTDYLAGGTNTDVTVGQGRHFSLALEAKF

SEQ ID NO: 15000 - protein, 668 aa, Pseudoalteromonas atlantica
MQHPASRLPLLAGGLCLCLNGLSQADDNVFELGQIFVLGSHGDASRLDNTDSVDSRDMRLHDRETVGEALNLIPGVSLSKTGARNEQMVYVRGFDLRQVPVFIDGIPVYVPYDGYPDLGRFTTFELSRIEVSKGFSSMTYGPNTLGGAINLVTRRPQEEFEGEIGTGFSFTDRAENNGEWTYANFGTRQDNWWAQMGLSYLNEDYFRLPGNFDDERLEDGGRRGNSDRKDKKINFKVGFTPNDTDEYVLGYVKQDGEKGNPAYAGHLGGSYNRFWRWPKWDKTSYYINTVTAFGDHKVKARLYHDIYKNDLYSYDNDSYSTQKTSRAFRSYYDDYSTGLSLEDEWTLDENNQLRLAFHHKQDVHREHDAGEPKQRFEDETQSLALEYTRKLTERLTLIAGFSHDRRNGREAETYTSAAGLFEEEGGRESTNNGQLGLFFQADPRTLWRFTVARKSRFPTMKDRYSYRFGSALPNPDLKTEEATHFEIGYKRALSDSLELDLALFRSHVDDLLQSVRVAGSACSNPPCSQMQNVSEARMNGVEASLNGNLGAWEVNFNYLYLNRQNRSSDDSIRLTDTPKHKGFLSIGRWFGPWHLMASSDASSSRYSSTDGTQEASGFVVFNLKGGYRFDNGLQLDASVQNLTDHEYEYSEGYPEPGRTFVVQANLTF

SEQ ID NO: 15001 - protein, 1030 aa, Pseudoalteromonas atlantica
MTNFFVTSKHKRFKCLCFLMLMLAFSYHMDAQTTVTGMVSDANGPIPGANVNLKGAKNGVSTSFDGNYSISVPSNGTLVFSFIGLKSKEVAVNGQKTINVTLEEDLSTLKEVVVIGYGTQMKESVTGSVASIGGKELNEVPAANITQALQGRLPGVELTQTSSKPGAAMQIRIRGTRSLTGSNDPLIVLDGVPFAGSIGDINPVDIKSVDILKDASATAIYGSRGANGVIMITSNKGRKNQQATFSYNGFSGIKQVFGKYPMMNAERFAALRDYAGLYTDGVDESRSTNTDWQDSLYGAGEMISHDVSVAGGTEKGSYNAGLGYYKEESVLPGQKFERYSLRAGVDQQIGSAFRIGFTTNSNYAVTNGDNIGTGTILGTSPLANPYRADGSLKRIVSMGADDQWVYTRQSIKNLGESYINLTRAFSSYNNIFAELKIPGVKGLKYRLNTGLNLRTSNSGYYEGQGVFDVNPATLSNASITNALSTQWLIENLLTYDRTFADKHTVNFVGLYSNEQYTGNSSQISRNGITSDAFQFYNLGQSEEEAVINPANQDYTQWGLRSYMARLMYSYDNKYFISGTIRSDGSSRLSDGNKWVTYPAVSVGWNVSNESFMKGIKETVNLVKLRAGYGETSNQAVAPYATLGALSTRPYNFGNTNSTGVYVTELPNPNLGWEFSTTWNYALDFGLFNNRLSGTLEYYNTQTKDLLQRVGLPATSGVSSYVANVGATENKGYEISLNGVILDNPEGLSWSVGFNLYANKNKLVSLASGAERDEANSWFVGRNINSIYDYEKVGIWQEGDPYMSILEPGPTGINQQGTVVGSIKVKYTGDFNPDGSPTRAINANDRQIIETDPDFQGGFNTNLTYKGFDFSAVGAFKSGGVLISTLYGGASYLNLMNGRRSNVEVDYWTPDNRDAEFPNPRGIRSGDNPKYISTMGYFDASYVKIRALTLGYTLDQDFIKDLGINKLRVYFTAQNPFVFFSPYHKASGMDPETNSFGDENQAVSSYQRRFLVIGTNTPSTRNYLFGLNLTF

SEQ ID NO: 15002 - protein, 816 aa, Pseudoalteromonas atlantica
MSNQRLLMAGSSVAVLLALSSQAFAADPVAADTSVAVDEIVVKARDKAGLLETRPNNTVFGLDKPLLETPRSASFVSDTTLQRYGIETIDGLTAVSPGTYTASFYGVPGALNIRGTLAENYFRGFKRIENRGTYSTPIGAADQIQIVRGPPTPIYGSGKVGGMLNFIPKSGKNEGGYLSEPTGEVTATYGSYNKKNATAQLGLPVNFGPVTGGVYAYGEVEDSHSFYKGVYPRRQTGEISADFDLGNGWSTAFGGMKYHSDGDVQTPGWNRLTQSLIDTGTYTTGRDTTLVDSDHNGRMTLNEISGNSANPYYYDPAFNPLYIPYYNFYNTNAAHVLDAGVGATKLSPRTVYISPADFSKTDTNTLYFDLAKTLSPSSTIKAQLFYDDQENKRFVSYGYPAWFDSSVWEARLTYNFENEFMDGAVKAKSFIGASYRDFSGRRRESYNSGVIALDRRDISYGATATDIIDSPFTTETGSGVLGLAWENDNKSDWQQKGVFFMSDVTVGEKLNLMVGGRYDDYDVKSHDTGVLSYQVSGEQKASKGKFTYTASATYKAPAGVMPYITYAKASALEMSQAGDVAASLVADQSDAWLSNSDLAEAGVKFQWLKGTLVGSLAGYRQNRTQLTGISGTPTGTRAKGVEMEVRWLASENFSFTFSGNTQHTTVKGPDNSFQYIPAYTAGVPGSQAFGGTYVVWAFSGLAGRAGDYDYTLIPKSVVSLYGAYTSDDHDWGKVGGALGVTHVTKTSGTVQNAVTYPAYYVANASAYYEYGPYTVTANIDNLFDKLYFTPDADSYANLGALPSKGREWRVTLSRKF

SEQ ID NO: 15003 - protein, 178 aa, Pseudoalteromonas atlantica
MKFNFLLSTSILVVSTLSFNAYATLENTVSIGYAKSKLKVDEDLINDNLKGINLKYNHEVANDWGVISSFSYAKNKNDGYDHWGYAGTSKISYYSLTAGPSYRLNNYVSAYGLIGFGYFHEDFHYYDEREKENKISMAYGLGVQVNPITNLAIDVSYEYSKLYDIDFTTWVVGIGYRF

SEQ ID NO: 15004 - protein, 104 aa, Pseudoalteromonas atlantica
GRPLLQLPKHLFNANLSWQTTDRLNSWANLNYRGKEMQPEGGASNDDFIAPSYTFIDTGVTYALTDTATIKAAVYNLFDQEVNYAEYGYVEDGRRYWLGLDIAF

SEQ ID NO: 15005 - protein, 175 aa, Pseudoalteromonas atlantica
MKTALLLEKLEGQLATLRQRCAPVSQFATLSARFDRHLFQTRATTLQACLDEAGDNLAALRHAVEQQQLPQVAWLAEHLAAQLEAIAREASAWSLREWDSAPPKIARWQRKRIQHQDFERRLREMVAERRARLARVTDLVEQQTLHREVEAYEARLARCRHALEKIENRLARLTR

SEQ ID NO: 15006 - protein, 702 aa, Pseudoalteromonas atlantica
MQSTFKMTRITAYLISALAIFNSSAQTTDAPTEVIKIKGHEPHDALGNLSRQLSEQGVDFSAAGGVSALPVMNGMMGDRIKVIIDGAELTAACANQMNPPLSYVSANQVKSTQVIAGLTPVRSGGDNIAGVINLQQMRAQFADTESLSWQRGYVAGEYQSNGDQWLAGIGAHWASDTWSIDYQGAYEQSKSYDDGNGDKVLDTLYESQNHALTMAWRDSQQQLSTKITAQMIPYQGFPNQYMDMTDNQSLGAHIQYQRELATGGQLTGYVNWQSVEHEMGFFSPEKPGMMPMVTDATDRSYKLHWHLPTQQIGAYSSQITLGHELFDYQLDDYWPALAGSMMMGPNPYININNGQRQRIAVFADSDTEITDNWVLNAGIRIEHVRTDADEVQPYNDSPMMGMPNVDATAATAFNQADREQTDNLVDATLATKYTIDPQQSLELGIARKNRAPNLYERYSWGRGIMATTMIGWFGDGNGYVGRIDLQPETATTLKATYQRDDANNAWQFSVSPFYSRVDDYIDANVIDTFNRGTQPSTARNILQMTNVDATLKGISAHYTYRWTQVLGADEWQLRSSAKYTHGEQASGRELYQIQPLTIRVELSQQWGHWRQTVRVEHVEQKDRVDQQRLENRTDAYQVVDWQVNYTRANWQLNLGITNLLDEFYRQPLGGVSIAAQKAGQTQGFENVAGAGRSINFGVRYTF

SEQ ID NO: 15007 - protein, 770 aa, Pseudoalteromonas atlantica
MENFFMKNSKAFYRSALATAIVMALSAPAFATDSTVSTDPVTLNTEKTTLDQDVVINGDNKITAVTIETSDSDKDLNVTFGGHDITAASTVNQDFVEGVKVSGNKNVVINATDSTITAQGEGTYVRTAMVIDSTGDVVVNGGNFVAKNEKGSATGISLEATTGNNLTLNGTTINAQGNKSYSNGSTAIFAQKGNLLQGFDGDATDNITLADSNIINGGIETIVTAGNKTGIHTVNLNIKDGSVIGAANNKQTIYASASAQGAGSATQNLNLSVADSTIYSDVLALSESENSASTTTNVNMNVARSYWEGNAYTFNSGDKAGSDLDINLSDSSVWKGKVSGAGDASVSLQNGSVWNVTGSSTVDALAVKDSTVNITKATVNTGTFASQNGTLIVDASSENTLDISGKASGDLRVYSAGSLDLINEQTAFISTGKDSTLKATGTTEGGLYQYDLTQGADGNFYFVKNTHKASNASSVIQAMAAAPANVANLQADTLSARQDAVRLSENDKGGVWIQYFGGKQKHTTAGNASYDLDVNGVMLGGDTRFMTEDGSWLAGVAMSSAKGDMTTMQSKGDTEGYSFHAYLSRQYNNGIFIDTAAQFGHYSNTADVRLMNGGGTIKADFNTNGFGAMVKGGYTWKDGNGLFIQPYAKLSALTLEGVDYQLNGVDVHSDSYNSVLGEAGTRVGYDFAVGNATVKPYLNLAALNEFSDGNKVRLGDESVNASIDGAAFRVGAGVQADITKNMGAYASLDYTKGDDIENPLQGVVGINVTW

SEQ ID NO: 15008 - protein, 721 aa, Pseudoalteromonas atlantica
MKNKNLLFLSAAVLSAIYGSAVAADCDSTLTICETVNINNGDTAQINKDVNVSQGDGVVFNGSSTEYKAQAITKNITVTGNGANAIKINQGATFSSNINLNGANVTSENGTAILVEGNFPKRGTGVYIRDGAIIRGKTAAIDFSTLKTGFRSDVNGEIHGDILGNNHVDTKINFAYQGGAQNALFDGYKITGVPLIENHGNLTIQGKDKTIQWEGNFMNKENSQLIFRLDDNTNTDETILHVTGDVTFKKGSQAKLDFKGTSVDNIINKDIVLIASDSAIKDEAGITVTDANAIAPDISPLLEKTDSWLETTPPNISGGVSGNQLIARYGISYEGGDNFISAAERGNVTENGLAAANFIIPTVLNEFNNTRSQISDEALSLLVAAGNNDNNIAALSNDLAPIADGSDIQAGLIMVEDMRNNIAHRYLRYDNQLPIEEREIGWNSWANILYGYGTQSQQGGINGYNTYRTGIQIGTDYEINQDALIGISLAYNYAKADAKQRNASKEISHFEFMPYAGWYSDTLFLNGNLNIGYYTVDSERDIGGNTGWQGNTKAKGDYSGVQLGYQINAGTYLDFDFIHIKPMLTYQYQWLNIDSWEETGSTLSMRTYGQRYAVNQLGGSVALWNDYQTSYGKLTPSLNLRYIKDIAGNNDINQRHSLTYFNTGGSTFDIKGNTVGGDIISAELGANLDITQSLNLGTTMGYQRYDKFNEGRIGFTVSQRF

SEQ ID NO: 15009 - protein, 1096 aa, Pseudoalteromonas atlantica
MRTHAGTVCFLVALFATLAPAQNFGRISGTLTDSSGAVMPGVKVRVINEGTAVERVAPTNETGSYVATNLPVGTYTVKADPVGFQAEARTGLTLVADGRLTVDITLRPGNATQSVDVVAASGEALNTVSGEIARQINTQQVENLALNGRNYLQLATLIPGSALLDEDQMATTTSLSTSTQAVNGNRGISNNLMVDGSYNLDSGSNSSQLNNVGVDFIREVAIKTSNFSAEYGRNSGAAINVITRSGGNQFHGGALEFLRNDTLDARNYFSPSKGKLRFNDFGWNLGGPIKRNKLFFFAGQEWKRIRQDEAPLQATLPTRAQRLGDFSAITGNLFFPGTTTPIPNRSLSGMITPDGKALANVFNRMESLAASYTDIAKGNNTVYQFPNPFNWREEILRIDYIINEKHSLYGRYLHDDYNLIDPHPLGGLPTVPINRVRPTPSYQLTETWSILPNLINEARGSATWSAQRRQLSSDTWKRETYGFQYPQIFGTGPLSNGIPAVSIDGITSFPAPTFVKLSPNTEISFNDNLSWVKGSHTLKVGVLVARNRKNQNGSAINTGSIAFSTSGNTLTTGNAFADALLGNYRTYSEANNDPVGYFRYTQADSYVQDNWRINKHLSLELGLRFQSGTPTYSTVNNMTNFVPSLYNPAQAVTVNLAGVIVAGSGNPFNGLLRAGSGVPSDETGRVPSAGSADVAAVPAGAPKGLYSGQTVVAPRFGFAWAPFDDSKTSIRGGFGMFYDRPDGNITFPTLNSPPFIKTVQFQNGNLSNPSGGAAAALAPFATITAIDPNLHLPYTENFSLSVQRELPRGFLVETAYVGNLGRHLLRAPDINQPTFDALVANAALPAAQRASTNTLRPYKGYSSIIDRLSDSTSNYHALQVYTTKRTGDLTLTASYTFSKVLTDASGEGDNPEDPANRHYSYGPASFDRRHILVGTYSYQIPFARHWKNPAKYALAGWQFSGINRFQTGPYYSVSGNTSIGGRRADYVGGPILLPQGQRTVTTYLNPAAFAAAPNGRRGNTGVGIVQGPGLMLWDISLRKEFAATERFRIRLQGDVFNLMNRANFRGLNTNATDLAFGSITAAGPARNVQLGLKLQF

SEQ ID NO: 15010 - protein, 506 aa, Pseudoalteromonas atlantica
MKLKKLPGFSLGLIALAVGNAYATQLLDDYSIISYMTDEESPIEIKDNNPISNGEYLTTEDESHAVKVDDGVTGYINNASVMTSGDGSYGISVDSQNKVLYISDSDIKTSGSVSDKENGGITASAVVSEFGGTIFMNGDNSVESGGAYSAGLLSQVNDSEKMVNNTRLETTDKTNIVTSGENAVGVLACSSPGESRTCVDAVDDEVSDSNSYEVISRADLKMNGGSITTNGINSYGAYANGKKAYINLDYVALETVADGSYAVAIRQGNIDIKNSSITTTGTKAPIAKIYNGGELFFSNVTAVSKQDKGISIDASNIDSQAKIALLSVELSSALDSIDVNKTTTDVSILNRSIITPGNNVLVNNTGGDLNIISSDSILNGATKLVSGTTTLKLSENTIWNMKDDSVVTHLTNSDSIINLSYDDGQTFTQGKTLTVKGNYVGNNGQLNIRTVLGDDKSATDRLIVEGNTSGSTTVYVKNAGGSGAATLNGIELITVNGDESPADAFR

SEQ ID NO: 15011 - protein, 651 aa, Pseudoalteromonas atlantica
MSASARVAARTAIALALACATCPAPAAGADPGPDPDVPLVVLEEQVVRLPRATTEARSLASGTVVDRATFEGEAKDVGQLVSTAPGIAVEEHGGLGQLTTISIRGSPPSGVKVLLDSLPLNTAFGGGVDLSTIPRSWVDAVEVVRGPAGARYGSGALGGVLNVVTRRPEAGSWSLETGGGSFDTARVAADVATSLGPGAVLLGATAETTSGRFPFRLDPGLPGGPTVAATRENAEVRRGGLLAKLVRPQERGRLDALLEVSGGHRGLPGFAAAPTPWAWQDDARLLAMGRVARFGALGPATLAARGHLRLDRLDARLTGPDDSPIRQRGAAAGLALEATGSHRNGVLSASLETNAELLAADGLGGRRDLYGVAAAVADDLSLADGGLRIAPAARAERAGQFGGVSGSLGLSVRLAPALRARAGVGRTFRPPGLAELHLQQGLLVPNPDLRPETAVAADAGLVADGRAGLLAVTGHLTRYEDLVVYEPSDAFGRLKPFNSGRASATGLEVEGASAPVGGPLRASASGSYTLLVTELLRGAPAEVGHWIPYRPKQRAFLRVALAPGPLSAHVELHRLGRRYRDRRGVNPVPSSTSWNAGLGVRVARRPEVRIHLEVLNLADDRTLTDGVGDPLPPRTVMVTLRAGSSAQEYAP

SEQ ID NO: 15012 - protein, 385 aa, Pseudoalteromonas atlantica
MNTLTKFGLLSVAIASSFSAAAKIDIYENDGLSFSADGLVNAFYSNSSIETTDAGGVGTDRDQSRVRMGFLPNNVGFNFSNQLSDMKIEMRSSFWVSINDSDNNRDASPADLGTGSLIDVRQFYATVKADWGEVLIGKDFGLFNRANILNDELLLGFGQTSDFFGLVDGGNVTFGNISTGYTYPFPKAQITYRSPEFNGFKIAVGLMDPNKVSSDSSEDLPRFEAELMYNSTFDSGSFMAWLSGVSQSSEVDGIEQDQSGVGYGAKVKFAGLALSASGYSTKGLGHVAGLDQLVGPEVIETDGMLFQASYTLHDHRFVVTHGRTEVENTDSVLDAEHTNTGLAYFNTLRPGLTAVFEYNHTEADVTNSLAGEDNDTVSVGAVVTF

SEQ ID NO: 15013 - protein, 994 aa, Pseudoalteromonas atlantica
MRMITRNLLTRSYKLLLTLLVLLMSTNAFAQRLTATGKVTDAAGLEVIGASVLEKGTANGVVTNLDGEFSLSVGQNATLVISFIGYKTIEVKATTNMNITLQEDNELLDEVVVIGYGSVKRKDVTTAVSTVSTKDLDQRPIVSAAQALQGKAAGVSVMQPSGEPGGGMSIRVRGTTSFNGSNDPLYVVDGVPVDNINFLSPNDIESLSILKDASSAAIYGSRAANGVVLITTKAGAEGNAKVALNVQYGMTKVAKSMDALNTEQYRELQEEIGAVNPAALEGLTDQTDWFDEVYKTGQTQNYQVSVSNGNEKMKYFLSAGYLNEKGILEGTYFKRYSFRANIDNQIRSWLNVSANISYSDNIGNTGIISGTGANRGGVVLSVINTPTYAPIWDPEKPNQYNKNFYGVNIMNPMENLARQKNNKNKENRLIASGAATISFLPNLKLKSSVALDRRNGVSTTFLDPISTTDGRNSFGTASDNRNMNTVLVFDNILTYNTNIKKHGIDVMAGSSYTKSDYTNSWINGSHFRDDKIQTLNAANKISWDGTGTGASQWAISSYFARVSYNYDSKYMLTMNMRADGSSKLHPDHRWGIFPSFSAAWRISSEKFMKDIAWIDDLKLRGGWGQTGNQSGIGDYSYLQRYNINRIPWFEEGNDHAVPGISQANLRTSDLKWETTNQTNIGLDLTVLNNRLTFSMDYYYKKTTDMLMNVSLPAGAAATTSITRNEGEMTNKGFEFAINSHNLTGEFSWDTDFNISFNKNKLTKLSLQKIYTAASSAEVVKENIVRNEPGRPLGGFYGYISDGVDPETGNLIYRDLNEDGKISTSDRTYIGDPNPDFIYGLTNTFTWKDLSLSIFIQGSYGNDIFNVSRMETEGMYDGKNQSTEVLKRWRIPGQITNVPKANFNIKNSTYFVEDGSYLRVKDISLSYNIRCRQFKKWGISRVQPYFTASNLLTWTSYSGMDPEVNQYGNSGSVQGIDYGTYPQSKSFVFGINVEF

SEQ ID NO: 15014 - protein, 326 aa, Pseudoalteromonas atlantica
MLRKTIVFAGFLNLICTPGISQEQKHDTIRASKVYEIGEVVVTGSRNETDVRHLSQTVSVINRIDIEHAMQPSLLPVLTEQIPGLFVTSRGIMGYGVSTGAAGGISLRGLSGGTGRLMVMIDGHPQYAGIFGHPIADAYQSFLADRVEVLRGPASVLYGSNAMGGVINIVTRKMHDNGVNTNIHMGYGSYNTLESEFTSRIRKGRFSSVVSGSYNRTDGHRNNMEFEQYGGYAKLGYEMTGNWNLRGDINITHFNASYPGPITAPLLDGDQRITRGVTSFAIENNYEQTSGGLSFFTIGENIGLTMDIHLRKKRNLRMGVLTHGII

SEQ ID NO: 15015 - protein, 668 aa, Pseudoalteromonas atlantica
MTTIRAFRLRRGRQIVLTGLVLVALAGSAAAADIGASIPTKAVPHPIIQWTGLYLGAHAGFGGGRSTATLADPAPITTGNDFGGLISGVQAGYNLQLPSGLLLGVETDISFPSYIESNSFVSKLATARSDVTHQWDFIGSARGRIGYATGPWLTYATGGLAIAGERYLNDPPSGDREKTLGSRLGWVAGAGLEYAFAPHWSARLEYLYYQFDKTNVQFPSAAQYTATMDFQSIRVGLNRKLFPNAASVNLSAASLTDPESDRWEVHGQTTYIGQGYPSFGAPYSGANSLSPAAQYKATWSNSLFLNARLWDGGEVYYNPELLQGFGFNDTVGIAGFTNGEAQRSNFPYPHYNTTRLFARQTFGLGGEQEELANGPTQLSDKADISRLTLQAGKFAVLDVFDGNDFAKDTRKDFMNWALWAPGAFDYSADKVGLSYGVTAELNQKRWALRGGYFLMVSESNSNSFDGRLFERGEYLLELETRYSLLGRPGKLRSIGWLNSAYMGSYRDTLNNPAFNLDIALTRAGRIKYGYVFSVEQVVTDDVGLFGRWSWNDGRTEIMAFTDIDASLAVGTSIKGTRWGRPDDVIGIGGAINALSQDHRDFIAAGGLGILIGDGQLNYRRERVMEAYYAFALNKWFTLTADYQLVTNPAYNADRGPVHVFSGRLHGEF

SEQ ID NO: 15016 - protein, 809 aa, Pseudoalteromonas atlantica
MSILAFFPIIGFAQEYELTGKVIDASMDFPLEYASISAKSIEDGSIVNGGVTNREGRLSIKLEKGTYNLEIEYISFEIKVFSNFTIDKDTNLGIIKLGIRPDNLDEVTVVAETTQVEVRLDKKIYTVGKDLTTAGGTVSDALGNVPSVTVDIDGAISLRGNNNVRILINGKPSSVAGFGDQDVFQQLPAEAIESVEVITSPSARYDAEGTAGIINIILKREKTLGFNGSIRGTLGDPKNSGAFVDLNLRTENFNIFTSLGYTDRTRPGNAFFDTKYTGISNFDRIIEDREYDRTGQNFNVNAGVEYFIDDMSSVTASLFTRFGDDRDMTTNTNRRFVNGIENSTTARIEDELEDDKSFQYSMNYEKRFDKENRDHKLTADLQYSSSNETKNGIINENQTLPSDSLVAFQDNLETEKRDSYLIQADYVKPMGDAQFEVGFRGDYSDQTQGFLVQRQNLETGNLETDEFVSSDFDFQQNITAVYSQYGNKFEQFSFLLGLRYEHTQLKGTTTPLVSGNSDRIFDFDKNFGGFFPTVNLVYELGEDENVTLGYNRRINRPRSWFLNPFPSQSSRINVFQGNPDLDPSFANAFDLGYLKRWEKLTLTSSIYFQRETDAFERVERDTGRLTEEDGIPIIENIPINLATEQRYGAEVGVLYNPTKWLRTNLSFNYFRFESEGSFEGIEYGATNESYFGRFSSNVVLPGKIQWQTNAFYRGPRVNAQTETDPIASIDLALSKDFLKDDNLTISLNVRDLFNSRKRDQFTITENFTSNSSFQWRVRQVTATLVYRFNQQKREQNRRSNNDDGDFGGS

SEQ ID NO: 15017 - protein, 1032 aa, Pseudoalteromonas atlantica
MKAQEVSIKPGTMKIVMQPDAEVLDEVVVTGMTKVDKRLFTGAADRLTAASVKLDGLPDISRGLEGRSAGVSVQNVSGTFGTAPKIRVRGATSIYGNSKPLWVVDGVIMDDVVEVSADQLSSGDAVTLISSAIAGLNADDIESFQILKDGSATSIYGARAMSGVIVVTTKQGKAGTSRLSYTGEFTMRMKPSYRNFNLMNSQDQMGIYKEMRDKGDLNFASVYRASNSGVYGKMYQLNNWYDKTNGMYGLAQTPEAQNAYLREAEYRNTDWFDLLFSNAIMMNHSVSYATGTEKSTSYVSVSAMVDPGWMLQNKVQRYTANLNNSYKIVKDLSLNVIANASYRQQKAPGTLGQSSDAASGTVSRGFDINPYSYALNTSRTLDPNEYYMRNYSDFNIFNELNANNISLDVIDLKFQAELKWKLFRKLELSALGALKYSATSQEHKIRENSNQALAYRAMGDGTIINRNSWLYKDPDDPYALPVSILPKGGFYNTAQYKMLSYDFRAAASYNDVFNDTHIVNVYAGMESNAQNRTANSFDGWGMQYENGEIPFFDYLAFKKLREGNTNYYDLTNTKKRNVAFFGTATYSYKGRYIITGTGRYEGSNRLGKSRSARWLPTWNIAGAWNMHEEEFFKKLEPALSHFTLKASYSLTADVGPSNVSNSKIIINSYTPWRPSAGVSESGLQIVDLENSDLTYEKKHEMNIGLDMGFLDNRINLEAAWYKRDNYDLIGAITTQGVGGSVERMANVASMKSHGFEFTLSTRNIESRNFQWSTDFIFGYNKTEVTDFKSRSRVFDLISGVGFAREGYPVRGLFSIPFEGLDSDGFPIFSFNGKTVTKANYGSLNLQQSTDVDFLKYEGPTDPTITGSIGNIFTYKNFRLNVFVTYSGGNKVRLDPMFRSSYSDLDATPKDFKNRWVLPGDEKVTDIPVMASSFERNQYANLSIAYNSYNYSTARIASGAFVRLKEVSLSYDFPKEWLKSTPISSVGLKIQGTNLALLYADSKLNGQDPEFFRSGGVSAPVPKQFTLTLKVGF

SEQ ID NO: 15018 - protein, 988 aa, Pseudoalteromonas atlantica
MKMTDTQRRVRRAALLAGAAVALAMPAMVPVHAVAQEAGALEEIVVTGSRIRAPNLVSTSPVTAVTGEDIKAQGVTRVEDLVNSLPQAFAAQGGQVSNGSTGTATVNLRGLGSSRTLVLIDGRRLMPGDPSVPSPDLNFIPSSLVQRVDVNTGGASAVYGSDAIAGVVNFIMERDFEGVRVDVQHGFYMHHNENDDVQSIIRAKSASASVPTDFAVPDSNVTDGEQSEATLVIGANSADGKGNVTAYAGYREIKAVLQGDRDFSACSLNSGDVFTCGGSGTAYPARFGNWVVDPAGPGNTFRARNASTDVYNFGPTNYYQRPDERYVLGAFAHYEIQPWADVYADVMYMDDRSIYQIAPGGIFAGTFSVNCDNPFMTPTQQQQLCGANAGTQNNFTGTIARRNIEGGGRQGDMRHSAYRFVTGVRGDITDEWNYDAYLQYGATSFNRAQTGFFQTQKIRNALIARRDANGNIVCQAAIDGSDTSCVPYNIFKIGGVTQEALDYLETPSYATGNTEEMILSASLAGDLTNYGVVSPFATSGVGVAFGIEYRSEYLDSASDYTAAAGLLNGSGGASLPVEGDFDTKEIYGEIRIPLVEDKPFAQSLELDAGFRYSEYSSVGSTDAYKAGLIWSPVSDLRFRGSFQRAVRAPNILELYDPQVVQLDGSTDPCAGLSAGDALVARCAQAFGLTAAQVLAIEENPASQYNGQNGGNPNLDPETSDTYSIGVVLTPEFAPGLTVSFDYFDIKVEDYISGIGADLIISRCLETLDPYFCGLVNRDANGSLWLSDQGYITNTTLNTGSLKTTGIDVNIDYSLDLEDVGLNNAGSLAFTMAGTWLDTLKTQPLPNDKAYDCTGYYGTVCGTPNPEWRHKARLTWTTPITGLTLSTQWRYYSKAELDATSDQPGLNNPAQVAGTDLKLGTQNYFDATITYQFLESYTLRIGANNIFDRDPPLTGSANCPTGPCNGNTWPQVYQDAMGRYVFVGLTAKY

SEQ ID NO: 15019 - protein, 868 aa, Pseudoalteromonas atlantica
MKLYKFRKELFVLTLLVSGSSISAEIIAELDEVVVSDSSSVADFQSLAFQGGRKASDVFIEGKEFKTRSATLGNALAGELGVHSNPFGGGASAPVIRGQEGVRIKLLQNGSDIVDMSNISPDHAVVADTLLAQQVELVRGTSTLMYGMASPAGVVNIVDNRIPTSRPEKGYEGEIVSRFDTASKEKVLTAGVTLAAGDNFLIRAEGLTRKSENYHVPEVFIGQKLNYLPDSHHKSKVGTLGTTWIGDKGYLGASVSYRKDHYGIPGHNHAFDYCSGHLFDTDNLKAITGGDGEAPYLNAYPHLMTDADMISSLHFHCGADIQGHKHSHESIYGHDHDISEAGPVVDMRSKRYDVRGEWKSPIPGISKVKLSLAYADYYHDEKHDGKAHIDKNDSQGIKDRKKYTAAIMSGKPEAFYANRGFNSRLEIYHQPTEHFNGVVGMQYQTQKTKVQRLAPSLNNNGQDLSGERKESERNPLVPHTNKQFSVFALEQFTWRNFIVEVGARWEKQRIPIKYDPHKLRLDKAAGSKVRLPDLSPYTENALSYSGTLMWDFHPAYRLSITGSHNERIPSPMELYYHGKHLATNSFQYGNKDLKKERSNNVEIGLMRISDKWDFKVSAYYQRFKNYIHNENLYREGNLFMRRYNQSQARFYGFEGEIGYQITPNHKITFFGDYVNGKLFGFKKFYGNPKFKRVCELENDGKNNLEKCVENEEWGEEWSYHKIGEQTIERPNRNAARVPPMRLGFRLKSQFNDNWSGSLEYTRMFVQKRISINSVIKEIDREEAEKRRENAKGLGYDGHYTELVPEDVTQGYHLLNLSLNYSRKIDGVEYSATLSANNLLNQKIYIHNSYLPYVPQMGRNFILNVGVTF

SEQ ID NO: 15020 - protein, 893 aa, Pseudoalteromonas atlantica
MNRISKGLLFASACASLGLVGTAAAAQQTGGAAVDEVVVTGSRIKRADITGVGPATVVTEEAIARTGVMNVETLLQRLPASAGNAGNQTNAYWTGNGWGTAQVNLRGLGINRTLVLLNGRRVVYGGTGANSAVDLNTIPTGMIARMDVLKDGASAIYGADAVAGVVNIITRTDFEGVQVTGKYGVTDEGDGNEYAVDVLWGLRGDRGGFTAGVSYQKMDPVNMADREPCGLGEVGGQLVCVGSAATIGGRAVLPNGQQINFNQTPGGNGNFFEPYSAAKHNFNSNPFLNAVSALERVSVGVFGDYDLTDNIELFGEFLFTHRETGQIATPGSLRNLTITANNSTNPTGQELLLIQRRLAEPGPREFFQETDTWRGVAGLRGDLGEKWSWEVAGNFGRTTGIDGSTNIANLERVRNTIAACVPGYTGTAPCADYLGYGDLTPQVLDYILFTMRDTGGNEQASVTADITGTLFDLPAGPLGVAAGVVYREEKGWRDPDALTVLGVANTNQQDPISGSVNTKEAYVELSAPLIADMPFAERIELNGAVRYSDYNLFGDNITYKLGLDWTVMEGLRLRATYGTGFRIPSVPELFGGVAEGNLTTTDPCSRYSTSGNATLIANCQASGVPAGYVQLGNTVLTTVGGNQNLQPEESENLTLGAVFQPEFVPGLSVTVDYFDIQIKDAIRNIPGSTKLAVCYASPNLSHPFCGPEHFTRSTRTGEVNFLSSQPTNAGKETMKGVDFGVRYAFDVAHLRADLDWNTTYLAKYEVIPFQGADPIIFDGYIGGGNGGYPHWRSNASLTVSDVNWNATWSVQWIGKAKDFNASPGDIGDETPNVFYHNVQFAYRLSEKANVAVGVDNVFDRDAPFIQSWTDANTDTMTYDLLGRKGYVRLQYTF

SEQ ID NO: 15021 - protein, 380 aa, Pseudoalteromonas atlantica
MKKTLVVAALAGVAATAANAQSSVTLYGLIDAGITYTNNQHGHSAWQETSGSINGSRWGLRGTEDLGGGLKAIFTLENGFGINNGSLKQNGREFGRQAFVGLAHESYGSLTLGRQYDSVVDFLGPLSLTGTQYGGTQFAHPFDNDNLNNSFRINNSVKYQSANYGGLKFGGLYGFSNSIGFANNRAYSVGASYSYMGFNVAAAYMQLNNNINALALAASDPGAVAGDWTFAASRQRTWGAGLNYTFGPATAGFVFTQTRLTNSAGISAGQSGVSTGIPLTGGTRFNNYEVNGRYALTPAFSLAGSYTYTDSRLDGQTPSWHQFNLQADYALSKRTDLYLQSEYQRVNANGLAIGANINGLGAASSTNKQIAVTAGMRHRF

SEQ ID NO: 15022 - protein, 778 aa, Pseudoalteromonas atlantica
MPSPSVRSLPPSANGRGDCRLRGRGFSQRLPMIRLHPLVVALSLALPVVPLCAIAAEAEAEADAGAAAARDVHDFDRLQVTATRTQRALVEVPGTVDVIDREQLDNQLVRELKDLFRYTPGVSVTSTSGRFTGASGVRIRGLDGNRVAILVDNVPVSDTFNFGSYLNANRNFVDLETLKRVEVVRGPASSLYGSDALGGVVAFVTKDPSDYLSADKHSYVGLKFGYEGDWNGLFAGATGAFGGERWSGMVAVSHRQGQEAQNQGDNRARNYTRTAPNPQQVDGRSVLGKLVYAPNAQQRFKLTVEGNEDDGRIEALSGIDARSPSASQRILSQDGRDHQTRARVSLRHELDALDTALADDLFWQLYRQDSASLQRTDELRGNTTRRHNEHHFDQRVYGLLVNAHKAIDTGTLRHDITYGLEGSWTDTREKRDGYSLNLANGAVSKLVGQDLFPVRDFPMSETTKLGVYAQDEMRLLDGRLSLIPGVRVDYFRLSPRVDDIFRQDNPGVAAETIDEQQVSPKFGAVWRFSDTWSAYANYAHGFRAPPYNDVNIGFTNLQARYTAIANPDLKSETSRGGELGLRFNDTVGYLGVSVYYTDYRNFIESYAPAGVNAEGLLLFQSRNVDDVVIKGAEARAGVDLGALAGWQGWSVNSAVAYSQGDNLTDDTPLNSVDPLRGTLGVAFDSGRWGAEVIGTFVARKRRPQLADYYTPAGYATLDLMGHWEFAPGAKVTAGIFNLADRRYVDWNALPNGTLDSSTVLDRFTGAGRTASFSLAVSW

SEQ ID NO: 15023 - protein, 870 aa, Pseudoalteromonas atlantica
MKTLNNQKTPRLKSFHRKKISTIVGLVCGSLLVSDIAAAQEKPAGPIEEVYIVGSRALGRTAEDLPVPVDVLSADSLEKTGQTEVGRMLQMTAPSFNFSSSSVSDGTDALRPATLRGLGPDQTLVLINGKRRHQASLIHINTSVGRGTAGTDLNAIPAASIQRIEVLRDGAAAQYGSDAIAGIINIVLKDDNEAGSVSASYGQYYEGDGQTLNLNANKGFNLGDTGYLNITGNFRDRGNTNRAAPQAGCLYGGCEDTDDNGYLEPAPGNEALEVSGPARNGFRIGDADSQQVALVLNAGMELGAGELYGFITYSQRENESGAFYRNPTGSNGVDNALLTDGLNPADTDGFLPLIYSEIGDLSFNIGYTLEFDNDASLDLSYTRGANQIDYTTKNSANYSYANYLQFDEGLSDSEIRSQIPREAYAYGLELSLETINLNFTKQFSRFNLAAGAEVRTDEFKIKAGDEYSYRDYDTDPDTGDALYAQDAGGSIQGFNGISPESEVSESRNVMSLYVDGEYEATDDWIVSAAMRFDEYDGFGNTINYKLASKYTLTDSFTVRGSLSTGFRAPSMQQLYFNNISTQIRDAGAVTVGTFRNDSPAVRALGVPELKEEESTNMSIGFIASITPEWNITADFYSIKIDDRIAISNQLSAENDPGDGALTAALEESGAAAAQFFLNGANTETTGVDIVSTYSGIDFLSGNLDITFAANFTETEVTSIYVPSSGALAAVNPSVVFSAQDISIVEEWQPKDRIILSGDYMIGDISVNLAFNRYGEYTVLDTTSQTYGSEWLTDVRIGYAISDNMDIYFMANNLFDVTPEETTNTGTRGGLFESAPGAEDMASDTVFRYSRRSAPFGFNGGFYSAGINYRF

SEQ ID NO: 15024 - protein, 241 aa, Pseudoalteromonas atlantica
MFKRLSLYTLLLCLVPFFIWGISYQWHGNSQLTQADYWLYLLTETGSVPYALITCVLFTLLFAFLFKNPKQWILGVIVMGISVIATQAAKTGAKALFEEPRPFTVYLAEQTHSTPENFYKNDRTLRAEIAKNFYSMDAITPAWLVHHYENETGYSFPSGHTIFAATWLMLAVGFTQLLGNRSFKAKLLVVGIAVWGLLMLISRVRLGMHYPIDLLVATLLAWLINSIIFAFLKKKAIFVMK

SEQ ID NO: 15025 - protein, 707 aa, Pseudoalteromonas atlantica
MNNTQRGWWCALPLAACACVPAIGADKTAEKGETLVVVGQAQADGVQSYQPLTSVTGTRTETSLLDVPQAIDVVPQQVITDQAVSSLDEALYNVSGITQANTLGGTQDAVMKRGFGDNRDGSILRDGVRSVQARNFTPTTERVEVLKGPASMLYGMGEPGGMINMITKKPQLQQHTHVEGWGSSFKGGGGQLDVTGPLGTSGFAYRMIVDHDETDYWRNFGRNRQTVIAPSLMWFGESTTVRVAYEHMEYLVPFDRGTIIDSRTGKPVNTPRDRRFDESYNATRGDQDSVTLQVDQVLNESWKSSLTYAYSRNSYSDNQARALALDPETGVLSRQADSTAHAVSHANAVQLTLNGDVDWGSINHQMLFGFDFEDNRTYRGDMIRGKKNSDFNIYNPVYGQMPTSNAVSAKDSDQRENLTSYGWFMQDSVQLTDKWLVMGGLRYDAFDVFAGKGRPFVTNTDSSDGKLVPRAGVVYKLTPYVSLYSSYTESFKPNSSIASQIGSLPPEQGKAWEMGSKVELPNGVTGTLALFDITKRNVMVSELVNGETVTRTAGRVRSQGVELDVAGNITDSLSLIGSYAYTDARVVDDPDNKGKEMTNVARHTASLFLTQDLGSPRLYSGDNLRMGAGARYVGRRPGDAANSFNLDNYTVADAFAAYIMPVNGYRVKWQLNVKNLFDKTYYPSSGGNLRVAVGEPREVVLRASVDF

SEQ ID NO: 15026 - protein, 730 aa, Pseudoalteromonas atlantica
MKVEKAGKCVALRERGLPHPRPIYVALMLGLASLGAHAQESPAAASGTDAAKELPAVQVRSSAEDPLGPGVGYVAKRSMTGTKTDSSLLTNPQSVSVVTRQQMDDQGAQTVDQALRYTPGVYSQDGTDIRFDQLYGRGFPLDSYLDGLHLYQSPRFATPRIDPYFMERLEVLHGPASVLYGQGSPGGLVNYVSKLPMEQPYHEVMMQIGNHNNYQLGFDLSGPVDKNGTVLYRLTGVARTAETQVSDIKDQRLAIAPSVTIRPNRDTTFTLQGSFQRDPNGGLFNPVPAGATLFSNPNGQLGPDKYFGDPDRDGMHRTQYWFGYQFDHAINDKISVSQNLRYLHIDQHYYQTSVTSALGADQRTVSMWGNVDNEHYTQFQVDTHAQAKVATGAVQHTLLFGLDYQRSMLGDTEGNSVLGTVDLYNPNFSSLPMQQANTRLDYSLSTVGVYAQDEARWRNWVLTFGVRQDWTGGNQQTTLLTTGKGSIYHTNDHAFTWRAGLAYQFESGIAPYVSYSRSFQPVLGATFSGAPFSPTKGRQVEAGVRYQPKWFDGFFSLAAFTLTQDNVSVVDPNNLGYTIQTGQVRSRGVEFEAHANVTADLKVIASYTYLNQQVTSTTTPTSFGKRPTIAPRNTASLWADYTFHRGPLRNFGVGSGVRYMSSSAGDAANTFTVPGRVLVDLGAHYDIQNWRLSLNLNNAFDREYISYCTTASVCYWGATRTVLGTARYQW

SEQ ID NO: 15027 - protein, 807 aa, Roseobacter denitrificans
MLTSDDCPLDVTADVTTGVEPTVPTVITAEGIPDITEIELPISDAQLLSQESPDEADLPAAEEEAAPTDTVDEEVELEITVTGTRTPRAIQLSPANVTVIKAEELQRQLGQDIRDLIRYEPGVSVNEDETYGATDYNIRGLERNRILLQVDGIRLPTFFEFGSSILGRDFVDVGSVQTTEIIRGPASALYGSDALGGVVSYLTPDPSDLLALTDRDYYISGSTQFRSSNSGFSGTGTVAFRATDNLSGLVRFTHRENTERDNNAEDRFEDPFFGVTNNVLGKLEFKINDYNTVLLTGEYFNEAGDFDTAVDNLNLPLAFPGITILSDDTDTETTRSRFSIAYKFDNPESESFLQFGRVQFYYQESDYQETRTRNDIFANPFVPPPFTPPPARRFRELNNLFVEDIIGGDIQLRSDFRTGSVAHKLTYGLDISSTFNQRIRDGQRINLDTGAVSNRVGPDAFPIKDFPDSDTLRIGVYLQDEIEFGEGRFTVIPGLRFDYYSLTTQPDALFFNNPGAEATDLNDSALSPSLGLVYKVTPEIALVGRYARGFRGPNYIEINSGFSNPESGYRTISNPNLEPETSHTFELGVKGAFPRGTFGVTGFYSIYDNFIFGAAEGSTAGTEPAGCFPPFTPGCVQVFQSQNLEQVRIYGIEAQGEYRFSSEPHGFRIFGGLAWIIGDDDQNNQPLETVNPFEAVVGLGYRAPEDQWGAELIGTFVGTARVDSEPEDFIPGGFAVVDLTGFVKVTPNLSLRGGIYNIFDAEYVRYADARRLNNETNNTTTDPTFGQRRARITQPGINFGVGLTFEF

SEQ ID NO: 15028 - protein, 379 aa, Roseobacter denitrificans
MKHTKVAVAAALACAACVPAIGHAQSSVTLYGILDAGITYVNNTGGSHVVKFDDGVAYGNRFGLKGTEDLGGGLKAVFTLESGFRLGTGQLGFGGSEFGRQAYVGLQNDWGTLSFGNQLDITNELVSIYNISAWGSGYAIHQGDFDRFNGDRLPNSVKFLSNDLSGFKFGAMYSFGNVAGNFHRNSAWSAGASFTKGDFSIGAAYTRLNNPNGIYAFDPYAMIGTHTFLGQQTVTVDPATGARTDLFANTPMDVDSQGTFGIGTSYTIGKLTLDGNFSYTTIKGFGQSSHMQVYEGGGSYQFTPALSLIAGYQHTRFEGHHWNQGTAGLHYMLSKRTDVYLSGDYLRASQGVDAVIGYSFTPSTTQTQADVRIGMRHSF

SEQ ID NO: 15029 - protein, 1135 aa, Roseobacter denitrificans
MRNVVSWKPLVLGASFLLYGAGTAFATETDHLYPTPSTGFMSVQQDGRQINCHIVDKSGPIVGANVVVKGTTIGNISDMDGRAIIENVPANAILVVSYIGYVTQEVTLKSNQTNIKITLVEDSQALDEVVVTGYSTQAKKDITGSVAVVATDELKETPVSNFAEALQGKAAGVFVQAGGGPLGETTIRIRGVGSVNGSDPLIIVDGVQGVDIDAVNANDIESMQILKDAAASAIYGAKGANGVIVITTKQGKKNDRVQVSYNGYFGVAKMANDGYGLLNAWEAMEFQEEGQRNLFNYRGGQTVNHAQFGSIGKDGTGHLTMPYAIKPAGYSKEQIISQYGSIAAWEASYKDNGENTWSRSAYYQMLEDGYSEEEARAGTNWYDEVVQTGKVQDHQISITGGGEKATYSVGLGYMNREGTIKESWFRRYSLRANTNFFVNKWFNIGQNTNIAVIENSGERGRQGDDNTFGKTFSIQPWVPIYTVGGDYSGSQNAEGGRAESAPMSVDYGKDNRRRFLRAQSAIYAEIMPLESLGENLKIRTQFSARLGGAWDFWMNKRTIMTNKEGRNNNEFYEQANYWLDYQWTNTATYSKTINDDHTINAVIGTEALREGLGRWIQAGRINYPFEDDPNTWVINNGASSDLRNSGNQNAVSTMFGMFARADYAYQGKYLATVTVRRDASSRFSEKNRWGTFPSISLGWRMSDEKFMEKSRTWLDDLKIRAGYGTTGNSNIDSYNWAFQYGTGNRYLYSINGSDTEVYQGFGVTNLGDIEAKWETSKMFNAGFDITAFNQRLTANFDYYIKKTSDMLIDANWSALAGAADKPKVNIGDMTNKGVDLNITWNDKIGEVGYSVGVNLSHYKNRLDEIGTDAGIFTGTRISNMNVLMKGHAIGEFHGYQLDGIYKSEEEVRNYKNDAGGTVLPYGTSDASTLNAANYVGQFKVKDVNNDGKIDASDRTFIGNPHPDLTGGINLGVNWKGFDLSTYMYFSVGNDLFAMYKYYTHYGSLQSAYSKDRRDNSWHPVTNPDGIYPMWATANGESTIAANESNSGYIEDGSFLRMQTLTLGYTLPKSILDKIKFEKIRIYGQIANVFTLTGYSGLDPQVRTDTDGRSNDRTMGTDFGSYGMPRQFIMGVNVTF

SEQ ID NO: 15030 - protein, 126 aa, Roseobacter denitrificans
DSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSY

SEQ ID NO: 15031 - protein, 203 aa, Roseobacter denitrificans
MKKILLVTLIGTLTSSYASAYENPSNKYNGFYIGAGVGTTDFHYDKSLTSSVENNHEINYSNKADGESYKLIAGYQFNRIVSLEAQYTKYGDVKETLEVEGHKLTSKAEHQSFSLAANLGYTFDNGLRPFALVGLGQISLKSPGFKDDGGLIRLGAGLEYQIKQVPGLGIRTAYEADFYTLEATNKDYDMSVGSWYLGTTYQF

SEQ ID NO: 15032 - protein, 239 aa, Helicobacter acinonychis
MKNFFAVCIIPLVVTWSATASAKEGIYITGKAGTSVVNVYGINSTFSQEEIVNGHATLPDRTKGVFGGGVAIGYDFYDPFQLPVRLELDTTFRGETDAKGGQDIIAFGQPVHINVKNQVRMTTYIVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKAASNDFMLGITYAF

SEQ ID NO: 15033 - protein, 147 aa, Helicobacter acinonychis
MIADVYELAATTGNVFILTASYTIPRTGLSITWLSRFVTDLDYCSYSPYRNGPTDIDRRPSNCPKTPGIFHVHKPGYGVSSFFITYKPTYKKLKGLSLNAVFNNVFNQQYIDQASPVMSPDEPNQDKYARGMAEPGFNARFEISYKF

SEQ ID NO: 15034 - protein, 855 aa, Helicobacter acinonychis
MLKRVSCAPQSVFVLNRLHIMKKNKSTFTINFITNYLMLSLAGVPVYAVDFNTDVLDAADRQNIDFSRFSRAGYIMPGQYQMEIRVNGQDISPSAFQIAFLEPPFSDSDNEKPLPEPCLTPEIVSRMGLTEASQEKLRTWNNGQCAIRQLSGVEIRPESGRRMLYINMPQAWLEYSDASRRAAVRWDNGIPGLLFDYNINGTVNKPHQGKQSQSLNYNGTAGANFGAWRLRADYQGNLNHTTGSAQGTDSQFTWSRFYMYRAIRWRANLTLGENYINSEIFSSWRYTGASLESNDRMLPPKLRGYAPQVSGIADTNARVVISQQGRILYDSTVPAGPFTIQDLDSSVRGRLDVEVIEQDGRKKTFQVDTAYVPYLTRPGQVRYKLVSGRSRNYEHSMEGPVFAAGEASWGISNTWSLYGGSIVAGDYNALAVGLGRDLSEFGTVSADVTQSVARIPGYDTKQGKSWRLSYSKRFDEVNTDITFAGYLSPERNYMTMDQYLNARYRNSNFTGREKELYTVTLNKNFEDWKASVNLQYSHQTYWDRRTSDYYTLSVNRYFDAFSFKNIALGISASRSKYQNRDNDSAFVRLSVPWGTGTASYSGSMSNDRYTNTVGYSDTLNNGLSSYSLNAGVNSGGGQPSQRQMSAYYNHNGSLTNLSASFSAVENGYSSFGMSASGGATVTMKGAALHAGGMNGGTRLLVDTDGVGGVPVDGGRVYTNRWGIGVVTDVSSYYRNTTSVDLNKLPEDMEATRSVVESVLTEGAIGYREFEVLKGSRLFAVLRMSDNSYPPFGASVTNAKGRELGMVADSGLAWLSGVNPGETLNVGWDGRTQCVVDIPAHPDPAQQLLLPCRQVK

SEQ ID NO: 15035 - protein, 678 aa, Helicobacter acinonychis
MHLHRPPTALALLSLLAAGTVEASSADAFFEPLPVVLSASRLAQPLQDSPGAVTVIDADLIAATGYRELARVLRLVPGFQVGQERGNLQWVTYHGLGMDSPMQIQLLVDGRASLTPSFTASAERALPGDIERIEVVRGSNSAAYGSNAFLGIVNIITDDASRHPGTRLKLATGAPGIRDASLRHAVQSGPLSVRIGAHHEEDEGFADLYDGRRTDVLNLRADLQVGEHDAVALNAGVAESTHELGYAGSIFDIAAQREGRDTNRSLHLRWRHGPEDDAIRVSAYWSRQSRDDLWRYDSAANSRTLANAFPERLRGTVGNSATFVQHNLEIERRERVDEATRLMWGAEWKRIEHDSPFWYHERRNHARDEHRLFANLELRTGTAFLWNAGGMLEQLQGDEARLAPRVFLNWQAAPRITWRIGHSRAWRQPDLFERNVDIRITDDKGELVQRRQYPNPDLRPQRIDASEIGFLGVFGDSRSTLDVRLFRERIEDLIVRNAVPSDWPIEGKLPEAISRGLGSTRWENHSGRVQLNGIETQLHLKPWRGTEFLLAHSLIDRDVDDPRIRRNVAPYTASLSWLQRAGAWRSLLSVLRMGPIDAGFSYVPGFDYTVPSYTTVDWSVSRNLRLFDMAVELRLTGINLLGRHQELANRPLQAQPEFAGRPANEVSRQAWLALETTF

SEQ ID NO: 15036 - protein, 122 aa, Helicobacter acinonychis
MLNEHFGVEAGYLAGSGGVASALVEAFSEIKDLSYQGGRIAAYGEYPLSRGNSLYAKLGAAYTQVSYEMDKQDRDSDDIGFYGAVGWQYRFKSGFGLNLEYQYIPMKELELQGINVGISYKF

SEQ ID NO: 15037 - protein, 1005 aa, Helicobacter acinonychis
MNPLFKLSPLAFAVTLALLPDAQAADYVLTNGQETFNSDRVIDGSIEVRSTDGNSSSLTINSGATVTSEGGNIVGQASSTGVNQAQASVIVEGAGSRWVVPRTSFVLGNTIVVGGVGQGDLNVRNGGQVSVRDLDLGEVNGYRSNEFSNAQLLVSGQNSLVDAVNIEAGGVFVYRSSITANDGGKINSQQVDIDSVVNLSGAGTRWDNSGAFRNRNNLTLDNGAVLTTDSLLLGSAIIGRSNQVSISGQGTRLAAQSMTLGTSDSRTYLTLSDGAELSSTNGILISTISSINNPTRGTLAVGGPVVTDPNRTDIDSTTAGTAQAAGRLDPQTAINFGTGNGGHLAFNHTDTDLQVANTLNGTGRVYAFNGNTTLSGDLTGLAGSVVVRGGRLVLSGNVDQVNQRGNTATTQSLSRFNVGNGTLVVNGIAGRTEFGTYTNSAQVLDGGVLAGVGQVGTTQVASGGTLSPGESAIGALAIQGDLDMAAGSRYAADIAGDGRADKINVSGTATLRGTQVNVTALDPAQSYQSGRTYTLLSAQGGVVDGAAAGTAYAQALTNSAFLNVGLQRTANDLNLTIEQKSVEPTPTPTPTPTPEPTPTPTPEPTPTPEPTPTPTPEPTPTPTPEPAPTPGIFQTVMLTQNQFNTAGALSVLEQSGEPLRLYNNLLVLDAESARNAADQLSGDYLGSTSTALIANSQVVSGVLGTRMRNLLDTGTLRMPAMALNLMPSTPTTQNGAWVQPFGNWTKTSGNNGAGGLHQSTGGLLFGADGSFTPDWRGGVYAGYSRSKFDADDRDADGHSDNYHLGLYTGGQIDALRLSADVGYTWHKLESERNVAFAGFSDHLTGKRNAQSLQASGEAAYRIPVGSMALEPFAGLSYVRYDAKDLHEKGGPAALDVSSDKQDTFFSTLGLRASSSINVANVNTQVYGSVGWRRAYGDLDPRNVQSFAGGPDFEVQGVAQTRDTALTEVGAKLRLNRQTDLDLSYQGQFGTDTRFHSVNAGVTVRF

SEQ ID NO: 15038 - protein, 319 aa, Helicobacter acinonychis
MKKSVIAGVFIALSFTTCSAIANSLALSLANDDAGKFQPILNDIYGNKHENRDDYSQGLFLGYSHDISDSSQLSLHIAQDIYSPSGSNKRHNTAVTGDRAFSAYTHTGIEWNSLANDWIRYRLGTDIGVVGPDAGGQKVQNKAHEIIGAEKYHAWDDQIENRYGYTVKGMLSMTPSMDILGANVGLYPEVSAVTGNLFQYVAYGATIAIGNDKTFNSDNGFGLLAPRGLMHMSDTSGFKYKIFAGMERRDVNRNYTLEGKTIQTKQTTVSLNKTVDEYQVGATIGYAPVAFTLAFNKVTSEFKTGDDYSFINGAITFFF

SEQ ID NO: 15039 - protein, 268 aa, Helicobacter acinonychis
MNDVSFMISGDAMKIITCYKCVPDEQDIAVNNADGSLDFSKADAKISQYDLNAIEAACQLKQQAAEAQVTALSVGGKALTNAKGRKDVLSRGPDELIVVIDDQFEQALPQQTASALAAAAQKAGFDLILCGDGSSDLYAQQVGLLVGEILNIPAVNGVSKIISLTADTLTVERELEDETETLSIPLPAVVAVSTDINSPQIPSMKAILGAAKKPVQVWSAADIGFNAEAAWSEQQVAAPKQRERQRIVIEGDGEEQIAAFAENLRKVI

SEQ ID NO: 15040 - protein, 185 aa, Helicobacter acinonychis
MKKIVLSSLLLSAAGLATVPVAQADTHSVSVGYAQSRIEHFKDIRGVNLKYRYEAQTPLGLMASFSWQSGKRGESGGIPGGMSWRDDVKATYWSLMAGPAVRVNELVSLYVLAGAGTGRAEVKEHISMPGYNGRFTGSERRTGFAWGAGVQFNPVENVVIDLGYEGSKVGAAKLNGVNVGVGYRF

SEQ ID NO: 15041 - protein, 1075 aa, Helicobacter acinonychis
MLQVSAGTKAQKINLKRSSINIASIFKEVRRQTGYSVIWKSKELNASKRLSVAFVNASLAEVLRTCINDKNLEYLINEKTIIIKEKEPGIFDIFKTTISTAFDDIQGRILDEQGKPLPGATITIKGTKQSVISQQNGTFRMLGVDKAAILVVSYTGYETIYVKASDHIRDIVMKTTNSELDQVQVIGYGTTTKRFNTGSVATVKGGDIQNQSVSSPLQALQGMVPGLFIQQGSGMPGASSQVALRGKNSITSGTVPLYIIDGVPFDGNPVEQSGDIYTSEQGNGSSDPLNAINPKDIESIEVLKDADATSIYGARGANGVIIITTKYAKSGATTLSGTVFTGMSKIRKYPSSLGTADYLALRKAAFANDNITPTAINAPDLVLWDQNGDTDYQKYLLGNTAPQTEANIALSGGNSNNGLYLSGSYRNEGTVYPADFGYRRGSLHGKAFHTSDNGKLRAEISTIYSSDLNRMPATDLTNTTTTYPNNYPLYNPDGTLYFHPAFSTNPIALLRNYGKNTSKTFVINAALQYNILSNLRLKVNVGQNSVSQDAIAIYPGSARNPSLGSISGGGGSYTNNTNNTYLAEPQLDYNTVLGKGKLNATLGGTYQFRENKQPYYVSAGMFSSDALLENYSSAGMIYYQTSSSSQYRFASVFGRAVYNWDSKYILSGTFRRDGSSRFGPGKQFGTFGSLGAAWLFTEEPFLKNTEWLSFGKLRASYGTVGNDQIRNYGYLETYGSTGTPYGNNPGILPSGIANDDYSWETTRKMELALELGFFNDKLMLNTAWFRNRSGNLLSYYPLSGQTGFTGYTANLDALVQNEGWEFELRATPINKNSFSWNAAFNISTSVNKLLAYPGLSGSSYASRYAIGYSLNSMTLYQFAGFENGIAQVADLDGDGQISPGLKVNGMGDYIIAGSTDPKFYGGFSNNFKVGNFQLDVFMNFVKKDGLSPTSFPGLIANQIEGVMDRRFTPSTSTGSASYASYENYYVNSSAKVVDASFIRLRNVTLSYNLPEKWISKANIRNCRIFATGQNLLTITSYKGFDPETLQYNPVGFPMPLPAPVFPPLLAITGGIQFSL

SEQ ID NO: 15042 - protein, 996 aa, Helicobacter acinonychis
MHLKFLQLIKPGIVLLLLFSASTLYAQQVPVKGVVLDVSGQPLPGVSVRAQDQRDGKSVSTSTSGQGLFNFNKLTAGGPYRFIFSYMGYQTDTLSNYMLVEGQQVALNIKLKEQSNALQEVVIGYGKSTRNAITGSVSSIKPEDFNRGVVTSPGQLLQGKVAGLNVTRSGNPTDRPAVILRGPSSFREGAQEPFYVIDGVPGASIDLIAPDDIISMDVLKDASATAIYGSRAANGVIMVNTRKAGKGQPTLSYSNYVATESISNSIDMASGDQLRAYLEANGKTLDAVSNDGSNTDWLKEVTQTGFSHNHNLSLSASGDNSSYTGSINYLNNEGIIKTSGMERFIARGGMEQRMLNDRLKLNLNITNSNTTNDRIASQVYNNMFTYLPTVAVRKADGSFTEDYSRTTGTGGYYNPVALLNNNTIQGKTDLYLINGSAKVNILKGLDFTGMGSMQKEQINENLYYNNASMLAQGLKGYAQRSAIKNTQKVLEGYFNYDRSFANHNMKLLAGYSWQENRNGDGFQTSGQGFVSDDLKWNNLGLSNGNGNTVVNYGTNYISTLRLISFYGRAMYDYKGKYLLQASIRRDGSSAFGKNNKWGMFPSVSAGWNIDQEDFMQNAKVISNLKLRAGYGVSGNSVGFDAYTAILTNGAQPSSYFYNDGKWLTAIGPTQNDNPNLKWERTSTLNAGIDFGLFNDRISGSIDVYNKKTSDLIAPYTVSTTLYPYNVMTANVGEMSNKGIEFAISAIAVKTKDFSWTTALNLSHNKNEITSISNDIFKAGQFYTANFGGRGQSGINGFQVIKEGLPLGSFYTLRYAGKNADGVSMFYDNDGNAATSNTGFDKFAITGSAQPKLLYGWNNTFRYKQFDFNFFLRGVYGNKILNATLADMNAPIYAHQTNIPLMTLNEAMKDNTAQFVSDRYLESGSYLRLDNATLGYSFHIKGTKSLRVYASGNNLFIITKYNGVDPEINMAGQTPGIDNRNFYPKTRSFLLGLNFNL

SEQ ID NO: 15043 - protein, 3506 aa, Helicobacter acinonychis
MEARFGVALVSRFSPLSLAVHLSVAGLLFGGVSEQAFATCSAAGSTITCSGVPTLPLFLNDYSSATSGLTVNVTNGAQMNATLGGKVINLTGANINLNNSGTLDPALLGLVSILSGGAFIGTGATSTVSIVNNTTGLIRGTGMLLGLNLTSIDGLGIGVNNSVSGTTTITNDGTITSTGLSVGGITLADTPVVGVYGGSQVNMTNSASGTINGRVAFETSVAGNTFTNAGNITGGVSMGAGSTNTFYAITGSSVNVGDGVQVSVGLGGLIGINLTFAPTGTIDGGAGGTNTLILQNPIGVGGGVTGTGTASSATYVNFNNLTLNSGTWTLQGPLVSGATTLNGGVAQFNDNAAFGSGVLTSNGGILQASNAGLTLGNQINLGASGLTLQGINGMTLNGVISGTGGLTKIGSGQINLNGINTYTGNTVLNGGTVLVGNNSAFSTGGITVGGASSISATTPISLANAITLNSTLTATGTGALTLGGVISGAANLTKTGSGSLTLNGINTYTGITSLSAGTLRVGNNNALGTGVLNTSNGTSLDSTGNVTLANNVGITGTLNVLGSNALTLAGIVSGTGSITKSGSASLTLTGNNTNSGSTALNGGSLLVGSNTALGTGALNAAAGTTLDATTAVTLANAVALAADLTIGGTQALGLSGVISGAGNLIKGGTANLTLSGNNTFSGGTALNNGTLIIGSNTALGTGALTTAAGTTLDASTSVALSNAVALGGNLNIAGNANLTLDGVVSGSGGLTKNGAANLILNGTNTFLGAIALNAGTITAGANAALGSGNITVGGAATLDSNTAVTLNNNVILNSNLGIGGSNALTLGGVISGASQLIKNGTANLTLNGANTFTGGTALNAGSLTVGNGAALGTGTLTVGGSGGTLNSSANVTLNNAIALNANLTTGGANPLTLGGVISGASNLIKTGASTLTLTGNNTYTGATSLNAGTLLVGSNTALGTGVLNAANGTTLDASTATSLANNVNLGGNVTLGGSNALTLAGVVSGVGGLTKSGPADLILNGANTYFGNTALNVGKLIVGSNTAIGSGALNAAAGTTLDTNTAVTLGNQINLAGALNVGGSADLTLTGTVAGAGSLVKDGAANLNLNGTNTYVGGTTLNAGTLTVGNSSALGTGALTVGGAATLDSSSPLVSLANAVVLNAALSVGGSQNLTLGGVLSGTGQLVKNGSANLTVNGTNTFSGGTTLNAGTLTLGAPGALGSGTLTVGGAATLDNSTAFTLGNNITLDAGLTLAGNNGLTLSGVIDGAGSLTKTGLDDLTLSGNNTFTGALNIAAGSVTTVSSGALGNTSGADISAGASLNLGSNASLNGLSGSGSVQIGGGNTLTVGGVSSTSTFDGDLSGNGGLTKVGTGTLNLTGINGIIGNTAVNGGTLNLSGSLASAQVNVNTGATVTGSGSILGALNVNDGGHLALSSGTTLSAASLVLAANSNIDANLATPSTTSLMDIGGNLTLDGNLNVTDAGGFGVGVYRLFNYIGALTDNGLTVAGVPVGYGLGDILVQTLGTQINLVVSAPNTNLRFWDGSQTIANGTVDGGTGTWTAGGTNWTNSSGTVNQTWAGDFAVFQGTAGTVAVNGTQLFTGMQFLTDGYNVVNGTSGLLTAVNGTGGTTAMRVDPGVTATVGVNIDGSGILNKLDAGTLVLNGANSYSGGTQLDGGTLVVGSNTALGTGALIANAGTQLDSNTAVTLANAATLNGNLTILGSNALTLNGVISGTGGLIKNGSASLTLGGNNAFLGPVALNAGGLILASNSALGSATLNAANGTTLDVSGAFTAGNAINLAGNLGIVGSNDLTLSGAINGAGSLTKNGAANLILSGANNFLGGITLNAGTLTAGSNGALGLGNLTVAGASALDSNTSVSLGNNVVLNANLTNTGNSDVALSGVVSGTGGLIKNGASNLTLNGINTYSGGTTLNAGTVTLGTSAGLGSGAVTVAGAATLDTTAPLVLANDVNVNANLSVAGNNNLTLGGVIAGAGTLTKNGLADLTLSGNNTFSGTFDVQSGSLTTLGNSALGSNAGINLGAAATLNLGGSGSLASLTGSGTALIGGGNTLSIGGNNASSIFGGVLTGTGELSKLGTGTLTLTGLNSLTGNTTVNAGTLNVSGSLDSASVLVNSGGTLTGGGSLGGAVTVADGGHLAGATGSTLSVNSLVFNGNSNFDVGLGTPVSGGGNALVNVGGNLTLDGTLNVSDIGGFGSGVYRLINYTGGLTDNGMLIGTVPGSVNPGDLTLQTALANQINLLVTAPGVTVQFWDGNQLVANGSVDGGSGTWGTGTTNWTDVNGTTNQAWTNNFAVFQGTAGTVTVNGAQTITGMQFVTDGYSLQNGTAGSLNLVNGSLGNATVRVDPNVTATVGVALNGAGTLGKYDTGTLVLNAANGYTGGTALNGGKIVVGNNAALGTGVLTAANGTALDSNAAVSLANAVVLNGGLTVAGANALTLDGVVSGSGSLIKTGASSLTLNGSNTYSGGTQLSGGSLILGNNSAISSGALSVLGNGTLDSTSALQLANAINLGAQLTLAGNQNATLIGAITGSGSLVKNGGGDLVLSGANTYSGGTTLSGGSTRGDTSSLQGAIVNNATLTFEQNSDGSYTGNLTGAGNLNKTGIGALLLTGNNTFTGNTAVQAGALNVNGVLNSANVNVASGAKIGGSGVFAGAVQLANGATLTGGGSATPLSVGSLALSSGTNLDFTLGSAASSTTVVNVAGNLTLDGTLNISNAGGFGTGVYQLFTYGGSLTDNGLVYGSLPVSAANLTLQTALANQVNLLVQNAPNEVQFWNGGKTNPDGSIGGGSGVWGPGTNWTDPTGTQAQASSGQFAVFGGQAGTVTVQGNQNFTGLQFLTNGYSLIPGAGGTLTPVNGPGGSLAPVRVNAGASAEISVPLIGSGGIEKLDSGTLILSGANTYSGGTTVSGGTLIGNTTSLQGNILNNASLVFQQNANGQFNGTLSGLGALAKRGSGTLLLTGNHPFSGTVSVDQGVLQVGSPAARASLGGQVTVANGAGLSGNGSVGSVVNHGVVSSGAEAGTLSVTGNLTNAADGLLALTVSSPTATPLAVGGTATLGGGLLVNSLAPFTGNAVYSLITAGGGVTGTFSAADLPQYAFLNTTLAYDANAVNLVVSRNGNSFVDVAATGNQGNTASALMRNGAAGAVLQNEIVNLSVADARNAFDSLSGEIHASTASAILEDSRYVRDAVNDRMRQPSCSAPDDPRRALAPSDNQLTSNGCHGEMVGWARALGAWGESDGDSNSAKLDRNLSGFMLGTDKQLDDQWRVGMAAGYTRSDLDAHDRRSNATVESYHLAAYLNSQFDALAVRLGAAYSWHDIETKRDVSVGAYNDRLKANYDARSAQVFGEVGYAIEAAGIALEPFAGLAYVNYDSDKAKEKGGVGRLRAESDQDITFSTLGVRAGKVITLANGGQFTPRAALGWRHAFGDTKPDADLTFIDGGASFNTQGVPIAKDSAVVEAGVDFQISPTGKLGIGYSGQLSNESNDHAMTISFSLGF

SEQ ID NO: 15044 - protein, 792 aa, Helicobacter acinonychis
MITLSGWSQTGKITGKVTFTNNEIATGASVQISGTKKNAVVDNNGQFEFRNLSYGNYTLDISSMEAQNKSVNIVLNRPSQQITISLEKITDPKALNEVLIQKKTAKKEIIEKGFSVNVIETQEAAKRNIQTNDLLGQSAGVRIRQNGGLGSSVNYNLNGMSGNAIRIFIDGIPISTYGSSFNLNSIPPALIERIEVYKGVIPAHLADDALGGAINVILKKGAKNSLNASVSYGSFNTIQSNFNTTYRDKSGFTLKGSGFYNYSDNNYEIWGKFARDVQADGVMKQIRAKRFNDAYRSYGGRFELGFTDVEWADTFLVGINMSDDYNEIQHGQAMSTPYKGRFTEADAKVISINYAKKDFIIKGLEFNINSVFSQRNEVLNDTVKWNYNWFNEKAIGLKGLPILTPNGAQQGAPTILHLNNKIFSTRGGLNYSVNENHRFVFSTMLYSFMRDDYDEMKSELERNFQQKRDLQKNILSFAYEFEGLGSRLRTNVFGKRYNQKTEQKTPVLTTTNGQTKITENLENNNTTFYGYGFAASYFVLPKLMLSTSAEKAIRLPSENEIFGNPGENQTSNSSLKPEQSNNLNVGLRFGPFKINEHKFSFSGSGFWRNSKDKIVRQFSTRVNEALQATPSVNMGTAQSLGYEASLEYSNKNKLFVSMNMSRFNSLFKLKYDPNGKIYDNYNKQYPNEPYFIINTNAQYNFKNVLQEKSELNLYYNFSYVGEFYTTWLQTEMDKTPSQFPHDLGLSYIFPGKRYIVSFDAKNITNEEVYDNFAVQKPGRAFYLKVNYILNKF

SEQ ID NO: 15045 - protein, 420 aa, Helicobacter acinonychis
MKKAMLKTSLGIAVALASSHLLASGFALNEQSVSGMGTGFAGRSSSADDASTVFGNPAGMSRLKREQITVGGAAIIAKSDISGRGSNLGGETDGDMVPLVGVPMGYYVKPLDNNWSVGFGVYVPFGLVTDYGSGDAARYWGKKSHVEVVTFQPTVSYAFNDKVSIGFGPTINRIKGELSSNTINPRTPGRNDGEVKIKGDDTAVGYNIGILVQATDHTRLGLTYHSMVDYKLEGKTKVNNALIGPYSGSKFDADLKIKTPESVDFSVTHELDDQWTLYAGTTWTRWSRLKDITVNNDVPAALRAQFGTITEEQNWHDTWAGAIGASYKVNKEWTLRTGFSVDQSPTNNQDRSPRIPTGDRKIFSLGAGWSPNDDMTIDVAYSYLWEEDTKVNLASPTKGTYQAKYENSAHGLGASLTYRF

SEQ ID NO: 15046 - protein, 187 aa, Helicobacter acinonychis
MIKKFFLYMPCLCSLSTAWAEESPWTYRIGMSNIAFDTSAKVYLGGQRVPGGSADASNNNALTFDFGYAINDQWNARLIVGIPPTTKVKGAGTLPGIQLGKITYAPTVLTLNYNLPRFGPVRPHIGAGVNYTRILESKDANLKSFDADHAWSPALHVGADIDVSRNWFVSIDIRKLYLAAAKTECNT

SEQ ID NO: 15047 - protein, 566 aa, Helicobacter acinonychis
MKKFNIKSLTLLIVLLPLIVNANNIDSHLLEQNDIAKYVAQSDTVGSFFERFSALLNYPIVVSKQAAKKRISGEFDLSNPEEMLEKLTLLVGLIWYKDGNALYIYDSGELISKVILLENISLNYLIQYLKDANLYDHRYPIRGNISDKTFYISGPPALVELVANTATLLDKQVSSIGTDKVNFGVIKLKNTFVSDRTYNMRGEDIVIPGVATVVERLLNNGKALSNRQAQNDPMPPFNITQKVSEDSNDFSFSSVTNSSILEDVSLIAYPETNSILVKGNDQQIQIIRDIITQLDVAKRHIELSLWIIDIDKSELNNLGVNWQGTASFGDSFGASFNMSSSASISTLDGNKFIASVMALNQKKKANVVSRPVILTQENIPAIFDNNRTFYVSLVGERNSSLEHVTYGTLINVIPRFSSRGQIEMSLTIEDGTGNSQSNYNYNNENTSVLPEVGRTKISTIARVPQGKSLLIGGYTHETNSNEIISIPFLSSIPVIGNVFKYKTSNISNIVRVFLIQPREIKESSYYNTAEYKSLISEREIQKTTQIIPSETTLLEDEKSLVSYLNY

SEQ ID NO: 15048 - protein, 951 aa, Helicobacter acinonychis
MRKKTLKIKFFLLFCSLAGYSTIISAQDKTVKEKNEKDSTIISIPYGSKLKTEFSGASDVISGKVLENVPVQHLSNALSGRISGLTTIQRSGEPGNDEASIYIRGIRSNGNDALVLIDGQERNYYGMVQTQEIERVTILKDASAIALYGMRGANGVILIETKSGRLGKPRVSLNIQGIYQQNMRVPKAVNAAEYAQFYNEANINDGLNPFYTETEINKFANHSDPERYPDVDWIGNLLKKGTFMQRYNATVEGGSGRTRYFVSLGYTGQAGMFNTEKEQNYSTNTEFSRINFRSNVDFDITSTTLLSVKLDGWMQSENSPYHDQAQQYIFQNLLKTPATAFPMYYKDTHNYVDQSGNPIKSQPGDRIVAGNDKYINPWAILNRGGYTAIDKRYGAFSVSLKQDLDFLLKGLSLYGQISMDVYNLQKQNRTRSFNYYTLQNNGVLQKYGTSEEMISNAAMKYGDARNTTLNFKLSYNRISGKHNVSGMMFYDQYEYNQSIVLPYRYQTVGGWFAYKYDNRYQIDATFGYQGSYKFNNENRWGLSPTVSLAWYASNEKFFDVLKPAISNLKIRGSIGKVNNDRAVSAYMYMSRLQNLNEGIYFGNDMAQYTSLLETQQANPSATYEKSTQINLGADLGMFSNRLNATFDIWKDRRTGVYTIPSTFSSMLGYTTIYMPGKNIGKMETKGLEGSLNWKDNIGKDFTYFLSGNISYSKNKVIDMDEALQPYDYMYSKGHPYGTSLVYIADGIFQSYEEIAAAPVHTLNSVVPGDIRYKDINGDGKIDEKDRVRYGYTDVPQVFYGFSLGGSYKGFSLSVLFQGAAKVSKMLSSYTAFAFYNNGNMYEHQRNRWTPENPSVNNPRFTTKAAGSSNNSLSSTYWQRDASYLRLKNVELSYNLPTKVVRSIGLEELRIFLNGQNLLTFDKLDVIDPEAYGNGVAYPLQRSFSAGINIKF

SEQ ID NO: 15049 - protein, 525 aa, Helicobacter acinonychis
MKQNLKPFKMIKENLMTQSQKVRFLAPLSLALSLSFNQVGAEEDGGFMTFGYELGQVVQQVKNPGKIKAEELAGLLNSTTTNNTNINIAGTGGNVAGTLGNLFMNQLGNLIDLYPTLNTSSIRQCGATTSGATTAAATSNSPCFQGNLSLYNEMVSSIKTLSQDLKNNIFQGNNNTTSANLSNQLSDLNTASVYLTYMNSFLNANNQAGGIFQNSTNQVYGNGVTAQQIAYVLKQASITMGPSGNGGAAGAFLDAALARHVFNSANAGNDLSAKEFTSLVQNIVNTSQNALTLANNANISNSTGYQVSYGGNIDQARSTQLLNNTTNTLAKVAALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 15050 - protein, 612 aa, Helicobacter acinonychis
MIKKSLLCTALSVTAFSGWAQDTRPDTLVVTANRFQQPRSAVLAPITVVTRQDIDRWQSTSVNDVLRRLPGVDIAQYGGMGQNSSISIRGTNASHVLVLIDGVRLNLAGVSGAADLSQFPVSLVQRIEYIRGPRSAVYGSDAIGGVVNIITTREKPGTELTAGVGSNGYQNYDVSTQQQLGENTRVTLMGDYAYTKGFDVVAYGSTGSQAQPDKDGFLSKTLYGALEHNFSDTWSGFVRGYGYDNRTNYDSYYSPGSPLLDTRKLYSQSWDAGLRFNGELIQSQLVSSYSHSKDYNYDPDYGRYDSSATLDEMKQYNVQWSNSIVVGHGNVGAGVDWQKQTTEPGTGYVTDGYDQRNTGLYLTGLQQLGDFTFEGAARSDDNSEFGRHGTWQTSAGWEFIEGYRFIASYGTSYKAPNLGQLHGYYGNSNLDPEQSKQWEGAFEGLTAGVNWRVSGYRNDIDDMIDYDPHTEKYFNEGKVRIKGVEATANFDTGPLAHTLSYDMVDSRNAITDKPLARRSKQQVKYQLDWQVYDFDWGLTYHYLGTRYDTDYVTYQPVKMGGVSLWDLAVSYPITSQLTVRGKIANRFDKDYETVYGYATAGREYTLSGSYTF

SEQ ID NO: 15051 - protein, 113 aa, Helicobacter acinonychis
MHLIGVQAGYKQFFGGKKTWGARDYGFLDDNHAYIKFSFFNPASDVFAYGVGAGALYNFTNDKATQNNKISFGGIAIASTPWLNAQSMHSAAFNHFYNAKWMRRIFRFYPTRA

SEQ ID NO: 15052 - protein, 470 aa, Helicobacter acinonychis
MSYGADIAWKRKLVYRDQKDENYTLKYNYLPENNPWINLSTQFSYSKTTQNDTRHEKVTSSFLGTLGNKSWITYSDLTFDINNTSTFNIKSTQHELLFGLQWLKNTRHTLMYDKSKVGKADYNYGYFQPYYMPSGRQYTQAFYLQDQIKWKNIIFSTGVRYDHINNIGQKNLASQYNDISVGHNYSQKNYNGWSYYLGLNYDVNHYLSLFTNFSRTWRAPVIDEQYETQYKQASGPVKATSLNLEKEMINQTRVGGIITLNHLFQENDAFQFRTTYFYHRGKNEIFKTRGVNCVGNAANTKHVCPKPIGNYRNLPGYVIQGAELEAYYQSTYLFGELTYSYVKGKRDTSPRNPWGKTSTWIAEIPPRKATATLGFNVPKYYLTVGWRAEFVRRQDRSPLSGDPEAKYWSLPASRGYSLHNLFLSWSPAKIKGMNVKITVDNLFNRAYNPYLGELASGTGRNIKFSLSQKF

SEQ ID NO: 15053 - protein, 743 aa, Helicobacter acinonychis
MSLRSAQSGLLLATTALTTVAFVQAAAAQDAAVQLNEISVEATRPAIAAPAGSGIGGGNVSGGDGGSAATSGGGGGPSGVTGYVARVSPTATKTNTPLIETPQSVSVVTREQLNDRNVQDLAQAIAYTPGVSSSVFGFDPRYDAFYIRGFSATYNGIFRDGLRLNAVGLTIPRSEPYGLEAVTILRGPASGLYGLGSPGGIVDSTSKRPVFVPFGEVQFQAGNYDRFQGNFDIGGPVAGTDGTLAYRVTGVKRQSNTYLPGGDDDRTFIAPSFTWRPDSDTSFTFLSEYFESRLPGTSFFYNDPGFRVTNFYSGDPAFNQYKQQQYRIGYAFEHKFSPDLIFRQNFRYYDVRADYDYTSITGLNPARTLGSRTAGAYLDTLSQISLDNQLEGHFTTGPIQHTLIGGVDYAHYDYTRAFGFGAAPDLNLLTLNYGQQVIARPRYTNFQSQAQDQIGAYLQEQAKLGRFVLTLTGRHDWVFQNTSDQTAGTVANQTDRAFSGRIGLNYLLTDFLVPYASYATTFTPQVGIDVNGNPFKAATGDQIEAGVKVAIPNTNITTSFSGFDIVQSSLLRQDPNNIANQVATGSVESKGFEAELTANFAPGTNLTLSYTHLDLRYLRQTSLVTGRPIDGNALSGIPGDSFTAFGTYLFAPSSPLAGLQLGGGIRYAGTSFADDENTVRNPTVTLFDALVAYDFAALDPKYRGFRAQINASNIFDRSYTTCQAGFCYRGAPATVIGSLIYRW

SEQ ID NO: 15054 - protein, 1107 aa, Helicobacter acinonychis
MKKIPLCMKLSAIMLFVFASMAFAAKGYSQSVRVTLNVNNSSLQKVLDEIEKQSEFHFFYNNKQVDISRNVTIKSNQKEISQVLNQLFAGTNIGYKILENSIILSPKQILETTAAQQQTTKKIKGLVTDETGSPVIGANIKEKETGNGTITDINGNFSLSVGTKSTIIISYIGYITKEVPVGNNTSLTVQLAENTKQLDEVVVTALGIKREEKALGYAVQKVDGDKLAAVKTVNVATSLTGKIAGLNVKNSTEFNTSPSLSLRASAPLLVIDGVPYGNVGLNDIAADDIESVDVLKGATASALYGARGGAGAVMITTKKGKEEGLNVTVNSSTMFAAGYLRKPEVQTSYSSGSQGTYSTGGYVWGDKLDIGRTALQYDPYTHEWVDMPLVSKGKNNLKNFQELSMVTNNNVSVSQKGKYGSVRTSLTHVYNKGQYPNQKLNKITYSVSGDMKWKKFSFDGGLTYNKRFYPNDMGAGYGGSGFLYNLLVWSGAEYDIRDYKNYWIKQDEQQNWMDTKWYDNPYFIANEIVRSSDYDLINGYLSANYDFTPWLNLSLRSGLDSYSQKKEWRNAVSAVGGWHKQGYYGLQRLGGYSLNNDLILSADHKFGDFNVDGFIGGNVYYWKSDNILGETQNGLKIPGYYSLKSSIDPVKTTSGITKKLVTSVYAKASVSWKSTLFLDVTGRNDWSSSLPSETRSYFYPSVAGSVVLSQFIPMPEVIDFWKVRGAWTQTKSDLGVYDTNNTYSVSTDLWNGESAAYYPTSIRGVAVKPSATRSYEIGTAIHMFKNRLKLDFTYYNKLYYNLTRSAGISNSSGFTSTLINIDEEYVGRGVELTLSGDIIRTRDLKWESSFNWSRDRWYYTKIDPVYSTQKPWVAVGKRWDWYGIYDWERDSQGNLVNYNGYPKQSDYQSVIGYEYPDWIWGWTNTVTYKNFTLSFTLDGRVGGMAHSKTNQAMWNSGAHIDSDNQWRYDEVVNKKTNFVGSGVKVVSGSVDYDSNGKIIHDNRVFAPNDVQVSYESYMKSTNPYIGTVTRQNVFDETFFKLRDLSLSYQMPKSVCDKLHMKGLTLAFVGQNLFVWTKEFRFTDPDSDSDNLSSPSTRYLGFNVKLDF

SEQ ID NO: 15055 - protein, 720 aa, Helicobacter acinonychis
MVLKINKYRRRLFHSYEEEGAVIGLYKRSLFFLLIPGVIFLSQAAFAEEKADQKNIKSPTQKESVSSQTSPTELESIKVTDAHPREDLMPDSPTNPYRVESSARFGTEVFTQEDIQNLKPGDVNDLLDKATGMNVTYQGRRSPFFIETRGGGSFTYIIDGAVLPPSVNRILYKLPLAAIEELQIVRGSTSLTLGPSIPIGASGSGSGLNTGFIIIRTKQPRKTEAVLTGSVEKSIGGHPIATDVNLYLGTRLGDSPKINGYVGGMASMMDRPSQDSWFDGRNADNGMGNAGFTIGKFNMNFMGWTSSGNFEMQRGVKYDGTLDNMKWYYDPLQSTVLSTDMTMRWSPNQTTLLNVFKTTYDQKEYVESFINSSSSMRKYKEETRGIGLRHNARFWNTLIQLGGQMSESEGLGPNLSSNYNRYDTSVMGWSASVEQKLFNDRLVLDAGYRQDQKHIDNSSTSAAKDSANNDVDMDPAKIYALGARWRIMDIVALNGRYYHGEQGTSGDFDMRSQTGELHPEKQDRMEFAIESDFKAYFRPMLTWFNIKTDNQKTATNTTYTLDSGTYYYYTEADNLRRGVELMIKGDILKNTSYSVSWTRMLKNEDTKNGVTTDNNGVSKPKNLYTLEISHKWRDYRANLSIKKVDSWYSSTSAMGTAEADLGDYTRVDANIKRLFHLKPCLLTATLYGRNLGDERYATRYSTGYYYDRGRTVGMELSLAY

SEQ ID NO: 15056 - protein, 1162 aa, Helicobacter acinonychis
MGFKRILSVLLLCWLCMAGFLFAQSDRATVTGAARDASGAVLPGVKVEVTNIATNLVSTAVTNTDGIYRISNLPIGNYTLVFSHEGFKAVERKEVTLMTSQIAEINAVLQIGVATEVVEVTGVTPMLQSQDATVSANLDAKAVTELPLNVQGSRNLSNFMFAYVPGVEGGDYSSHINGSVALSKEVMIDGTSAVSQLGGYISESQPPMEAVQEFQADTAGIGADAGRSGGGVFRYEMKSGTNAIHGSLFGFLHSTSLDALSASNRLAVVTDPANAGAYLKKSDSLSDWGGSFGGAIIKDKLFYFVSFERYMQANWALGPNSRTVPTDAMMGLNADGSVAQYADLSKLLTTSVTHGNDPCGNAVYRGSVFNPATNCVFVNNQIPTNLISKTSAQILQLYHNYYAPESDLPTNNAGNAYNPDPWFHNTQTSVKIDYNFSDKNHLNGSYYYDNYPRINADQGGAWSANSPYGGPMANAYWHNTTAPSVRLSDSHMFTPNVLNVAHFTWNRFRNPSIAVSQSDNWDNKLGFYDGAGNFPLITYSSGMYTNWSPNVNGWYYSNLGSQFNDYYAANTYIYNDEVAWTKGRHAMKFGAEFRAMQFNSHPDSETFNNITFDPTSTASSTWYNYGWNEVGSSFASFLLGDVYQATGTAVDPQYGRRKAFSLYAMDDFRVNDRLTVNMSLRWDYNSPYKEKYGHWSSWVTDAMNQVSGTMGQYQYLTRGDESFEKRQQWANFGPHVGAAYKINEKTVVRGSVSVFFVPLNMNTWGGIPYQQTGNPGYYQHSIQQNFNWDNGYQPVLSQVQKPDYTQWGVVMIDPRSLTPGNTQQYQIGVQRELTRDTKLEAVWIQSHSYHLQSGTVNTNQPTVENMQNYVLHGEFPADYNHYWDAGGPGWQGITPYPQIAVGYGPMFSVGSPLGNSDYKSFQASVTKRASKGLSLMGSYNWSQAHGDVDSSMGELWWAGAIQNVYDLKNEAKDIAGFDMTHIVKGYVIYDLPFGHGQAFGGNVSTPVDYLIGGWSLNGSFHYNTGTPISVHSTNSYPGYNAVYVNMVAGCDPTNGSAKLYKQWLNAACFANPANAELGTAGNFQDFLRNPGLATEDIGLHKGLAFGPDGRYNFTFRLEFFNIFNRHQFAGPDTNLGSPTFGQITGYTGFGGRTGQFGARFTF

SEQ ID NO: 15057 - protein, 284 aa, Helicobacter acinonychis
MCSKKIKNLILCFGFILGLNAEENTAQENMTEENTPKDAPILLEEKCAQTLEFEENKEAKKKIDEKSLLEEIHKKKRQLYMLKGELHEKNESILFQQMAKNKSGFFIGVILGDIGINAHSYARSYESFEPSSNIQASPLLYGLRSGYQKYFANGISALRFYGEYLGGAMKGFKSDSLASYQTASLNIDLLMDKPIDKEKRFALGIFGGVGVGWNGMYQNLKEIKGYSQPNAFGLVLNLGVSMTLNLKHRFELALKMPPLKETSQTFLYYFKSTNIYYISYNYLL

SEQ ID NO: 15058 - protein, 680 aa, Helicobacter acinonychis
MLKLKMTFYSALFVFSASSTAIAADSDSLDLSLQELMNVEVTSVSKQKQSLSNSPAAIYVVTSESIRRSGATSIPQALRDVPGLHVAQIDSQKWAIGSRGFNGRYNNKLLVLMDGRTLYSPAFSGVYWEVQDTLMADIERIEVIRGPSAALWGANAVNGVINIITKHSADTLGGYGELGAGDYEQGFAGFRYGSTLSDKVTSRVYLKGHERDSFELDLNDLESDLLVPFADAGKDNSWQHLQLGGRIDIQLETDTSLTLSSDFYKSKMQQAPNIASTEAPLYRNYYTDEVKSDGFNLLSKYTKALSATSEYSVQTYYDYANRDENLYGLSSETFDVDFQHQLIIGQNHNVVWGLGYRYIQDELGSSPILESSEASSTNTDLWSAFISDEIMLVKDELWLTLASRFEQNDYTGFEVQPNIRLRWQLDTRNSVWTSIARAVRTPSRLENNISANALNIPPSDVAPLVKVWVSGNDNFESEEMVSYEIGYRFIPASQWSFDTTVFYNDYGKLRSVSESDSTIDFSTFPNYISQYVLFGNSLDGYNYGVELSSLWVATHSLQLRANYSFIQSEFGSSLNQNTDAPEHMLSTIIDWNITDDIDVNFVWRFIDNNNVISQNGTSMKTIPSYHSVDIGLRWMVTPDISLSAFGKNLLHPTHLEYEGESLQFPYRVGPSYFVKATLSF

SEQ ID NO: 15059 - protein, 775 aa, Helicobacter acinonychis
MNQNIKGLSMNNVSYNRNFKTGNDQRINHRSFVLNGVASAQMALRLGYALGTVFVLCASNTYATVIDNSTKTLEQQQAAQTNVAALPAITVKAEQDDTYAGGQVSSKSSVGFLGNKTAMETPFNTIAYTEKYIADQQAKDITDVIAKTDPSIFSTGAYGVIAESYAIRGFRSSSVAAGRDTSMGGLYGIAPLYRASPEMFERIDVLKGPSAMLNGMPPGSTLGGTVNLVPKRAGDDPLTRFTTTYMSDSQFGGHLDIGRRFGENKEFGVRFNSVYRDGEGPIKEQEKTTHLFSLGLDWRGDNARLSADLYTSRDHADGINRGLTILPGVNLPKAPNPDTLLNPTWTVYNTRDTGGMIRGEYDLNDKWMAYATAGMSKTEYNTLGAAKTEIQNEAGDIKFNIAHLGFKYERKSAEVGLRGKFDTGAVKHALALNATHYRETDDEAGIRQGFPEGDRVTNIYNPNWGSKPNRVPIAPIFSNKENLTSVGLADTMSVLQDQVQLTLGLRYQNIVTESLNGQGVRNINGRYDKNAITPAAAILVKANDHVSLYANYIEGLSSGGTVPTGQNYENEGQIFSPFKTKQMETGIKIDSGNFTNTFSVFQIKSRNSYVIKSTDEKIKSIYGADGEQRNRGVEWGFYGSPVDSIRVMGGLTYIDPKITKTRIASELGNVVAGVPKVQAKLGIEGDVSYIPGLTLTANATAASKQYIYNDNSTSVPGREVYGIGARYNTKIAQFPVTIRGNIDNLTNKSYWSMPQFTSLMLGAPRTYLLSATIDF

SEQ ID NO: 15060 - protein, 862 aa, Helicobacter acinonychis
MAVYSDHAITLMAALLLSVAPVKGFGATTEAGPDASSKPTSKTPSKSTAGKAVRGVAVPPGKTAGASSGLAHVGAGEEIVATGAADRISPAFRVATLTNSTVRVAVVTAAQLLQTGQTNVISALQMTSPEINAPPGGGGGAYSTTPTQTVILRNLNADETLVLVNGVRRHISALGNWGDGPAEGTEPADLSLIPLSAIDHVEIITEGATALYGQDALGGAVNIVLKSGARNGGTANLMNSGYYRGDGQAIEGYGDIERTIGHRGGGIDIAWQVLNQLPTHRDGLNTATLYGPQDAALQQKVGQDVNRVEGLSKSLAEVFSFNGHVPVTDRVDAYLTGTLGHRTTDRVGFPRGPANNNNVRAIYPNGFAPIETFDELDFQVNGGLRGVLPLGVSWNTYSSFGREQVNEDVENDLNPTFGAQSQTNFHQGTIVASELIGGAKFSKEFRSAALPKPAVLDFGLEYRHDTYQLGQGDYQSWATGPVLIGQTGVQPSSGAVGYAGFEPVNAGNWSRDIFDGHVGLDIFVTKKWEWTIGGRAVSYSDLGAAPTGSIGTRYNFSRRFALRANVNTGYRAPTLGAVHYNATSTGPGEVTENLSDFDPTARLLGATGVKGESSRSYNIGFDWTPLDSLHLSLDGYRIDINDRIESTTEFSGPLMNQFLYSQGITSSPTDKIYVTYMTNIGNTTTNGFTGKISYQFPVDPSWGKLVGTVMANAADTEVTHYASTPAILGQLGQTYFDSLSRNNLLRASPKNKESFALDWSRGRYSVYVQEQRYAGVEWINYSGDPASTWTHIRPQVQTNVEFSARVGRGFTLTVGANNLFNKYPTHVKRSTVAETQGTIAYPMTAPGGYEGGYYYARVGYVF

SEQ ID NO: 15061 - protein, 235 aa, Helicobacter acinonychis
MIKKHQITLFIVATVVAVSANAASVDYRQEYKHNDKSYASRVKVGSSVGHHFFSLEAKQTGKPISDWQAADNEFVYGYNFKVNKKWRITPSMPITFGNDRVTYKPQVRVQYKFDSGLTSKLRYRHEFRNYTGDKSDKDSIDRSKITGNLDYKVGALQLGFEANYAEDFFHDNEWFGGKSAKRHNEWDYNVKIGYKETDWDWRPYIELGNVQYSNGPSVTNSNRQLRTRVGLTYSF

SEQ ID NO: 15062 - protein, 360 aa, Helicobacter acinonychis
MQKISPMLLIPVSIAALGLPSQTHAQSHVTLYGVVDSGVMYTSRSFDAGTGASGPHQVSATDGAMSGSLFGITGVEELGAGTKAIFTLESGFTTNNGALGNSNGNFFGRQAFVGLSGRYGIVKAGLQYSPFGLAIVDTDARHASFFGSQAGIYMGNLFATGIFVANAVSYTSPTIAGIQASALLALGSDPNGFQAGRQYAARVRYEWKDLVVNAALFSGNPGGSASVSTPFPSTIEFSGRTIGASYTWGGATLKGSYTSYKIAGSFNEKVYAAGGEYLITPALSADLGVWYMRDSNDSANHSLLASAGLDYFLSKRTTLYGAAACVNNHGLMHTGFTVNGALYEPTGSSVGIVVGVRHRF

SEQ ID NO: 15063 - protein, 1060 aa, Helicobacter acinonychis
MNLKTKLTLLIMLFSSIIIVAQESYTLTGTVVSSVDQFGIPGANVIIEGTSTGASTDFDGNFEIKVKSGDVLLFTYIGYVTQKVVITDQTTLSISLAEDANTLDEVVVVGYGTRKKSHVTGSVAKVGGDDVAAMQTSRVDEALAGKLAGVLIQNQDGSPGADPKIQVRAASSINGSSNPLIVVDGFPISGSLATVNPNDIESIEVLKDAASAAIYGSRGANGVILVTTKKGKEGEPSFTYSTYSSISSKYKSDRINMTAGEWADKLQSGIANGTYDVSEVDPALLQYRLDAYENAPDVLAVEDWLYEEGYSTNHDFSYSGGTEKSKYYASIGYQKTDGIVRTEGYERLNARLNVDSDLGDRFKTGLSFNGFTSDRDILGHDQRDLLRAYNISPIYHTAESIAFVQGLDQQAQALGLDGFDLGYRGGPDAPFNQSIYTLEPGDTAQDWHYGRSGNGIGGTGDAGVATKLDNTERYQKTFFANVSTFLQYKIIEGLNIKAVLGADVKDTKDYFYRGLEFDSRARGDQTALDETNLKQTSALSETTLNFAKEIGDHDISAVAGIEFQKIYYKGTSLSGTNVPFSDIVNYNLLDPADITVSQIDETISRWSIFGRVNYAYDDRYLVSASVRRDGDSRFGENNRYNTFPAVSLGWNVHNEDFYNLELISLLKPRFSTGSLGTTSDLGAYSSLSLLNPQATAFGTGFLIPSEVANSNLTWQTNTETNYGIDLGFLNNRFRMGVDYYTSDIEDILINQSVSEVFGTTSIRLNSGDVRSSGFELELSASVIRSEDFTWDVSGNLSTVRTEITDLGGLDELPQSIYGQSGRGPVFRNYVGGEIGEMWGLETSGAVEDSYIEDPSIAIGVNSSAYYVVDQNGDGVIDKTKTVEEGGDLVKIGQNTPDFYWGLNSSMSYKDFDMSFQLQGSQGGDVWNVDPIYYNSEYGGRLRDSFDANNDGIADHNGEHYLDSNNQLDAQVQDASFVALRNLTIGYTVKSEWIDKVGADSARLYLAASNLLYLWSSDYTSFNPEGVETTNPDYLGPTTYGVQVGASPIVRSFTFGFNVNF

SEQ ID NO: 15064 - protein, 143 aa, Helicobacter acinonychis
MNLTISNVRDLRSFGVGGRYIWGPATLWALWTNTRLEPVTGGSTTYNAYEAGGKYAFTTALSAGVGYTYSRVSGANSGHWNQVNGALDYALSKRTDVYLLAIYQEASGKNLQAQIGSSTSYFNTSGTGSKNQFAARVGIRHKF

SEQ ID NO: 15065 - protein, 236 aa, Helicobacter acinonychis
MEFKMQKIILGMLVVTASNAMALNNNFNVYGKVGVDLVSRFDTIAITRHDTQAPKNTARFSPSLFAEITYNATPKTEVGLGLGYIHRKSSHHIIKQKTDNGNRALIDVIEEYPVNRYNSIPLYFLVKHNFYSQSDLRSYLKVDFGYAFNKTKSTLNLTESTDAAGNNQYYIEKHNISLNVENGNYYGIGFGVEYKNILAEIAYTHTDSRLTYSSKLIRGESEYKNDALRFSVGYRF

SEQ ID NO: 15066 - protein, 309 aa, Helicobacter acinonychis
MERLKRMSVFAKVVEFGSFTAAARQLQMSVSSISQTVSKLEDELQVKLLNRSTRSIGLTEAGRIYYQGCRRMLHEVQDVHEQLYAFNNTPIGTLRIGCSSTMAQNVLAGLTAKMLKEYPGLSVNLVTGIPAPDLIADGLDVVIRVGALQDSSLFSRRLGAMPMVVCAAKSYLTQYGIPEKPADLSSHSWLEYSVRPDNEFELIAPEGISTRLIPQGRFVTNDPMTLVRWLTAGAGIAYVPLMWVINEINRGELEILLPRYQSDPRPVYALYTEKDKLPLKVQVVINSLTDYFVEVGKLFQEMHGRGKEK

SEQ ID NO: 15067 - protein, 375 aa, Helicobacter acinonychis
MKRILVGGVLSALTAGAAAQGSVTLYGVADAAIDYVSAKGATAGPAADKPGTTRLSSQGSYWGIRGSEDLGGGLDAFFQLEGNFSIDSGASSTPFFNRDTFVGLRHRPVGALTLGVNTTSVRALGNALDLTPGANTGIGALQSLVSSMNGISTDHDSRLQNSVRYRSASFYGIEVGAQYGFGEVRADGTGRNDHVIGAGLAYARGPFYVAYAYEDRHDKNKAGLAQTNGHDQKHRVGVKYQVTERWLIGGLYDRSVSDGQFSNGDGRLRRDAWAFVTEYDWGAHEIYAMYGRANDVRCQGDTGGNGVNCGSSSQTGAQLWTLGYNYNLSKRTMIRTTISKILNQAAAKYDFSNGRTGAAAGADPFGASVGLRHRF

SEQ ID NO: 15068 - protein, 479 aa, Helicobacter acinonychis
MKKFVSLKLIVFSFILVAGSVSYSAAPVIKAGTATDSTEAGVDNVANGVKSSAFGYDNKAIEKESSAFGTGNRATGEFSSAFGFHNIASKIHSSAFGSNNAADGVNSSAFGFKNTVSGFNSSAFGSQYQVTGNFSGAFGMGEFNGQYQYKNEGNNSYMIGNKNKIASGSDDNFILGNNVHIGGGINNSVALGNNSTVSASNTVSVGSSTLKRKIVNVGDGAISANSSDAVTGRQLYSGNGIDTAAWQNKLNVTRKNDYKDANDIDVNKWKAKLGVGSGGGGGAPVDAYTKSEADNKFANKTDLNDYTKKDDYKDANGIDVDKWKAKLGTGAGTADIENLRNEVNEKIDDVKDEVRTVGSLSAALAGLHPMQYDPKAPVQVMAALGHYRDKQSVAVGASYYFNDRFMMSTGIALSGEKRTKTMANVGFTLKLGKGSGVTYDETPQYVVQNEVKRLTVENQELKERVRNLEEKLNMLLKNK

SEQ ID NO: 15069 - protein, 1027 aa, Helicobacter acinonychis
MNLKIKFTLIITLLFSVAIFAQESYTLKGTVTSADKMPIPGANIIIVKTTRGTSTDFDGKYQIEVVKGDVVQFSYVGYATQTIVIDSQKTLDIVLVEDANSLNEVVVIGYGTQKKSHLTGAISKVVNEDLDQIAVSRVDDALVGQVSGVNIQATEGEAGSAPTITIRGAGSITGNSRPLIVVDGLVVDDDFLGSLDMNDVKSFEVLKDAASSSIYGSRGANGIIMITTKDGKEGATKFSLNSFTGFKEAKHSDAYTFSVDQTAAAEMAATGSVSDRTRYKQLIDAKNNWQDVIFDGGIIHSHSFAARGGSKRTKFSTALSYVHDEGVLLTDDYKRYNLRLKVDTKLGEKFRFGVNLTPSVTDRRRFDGSTHDILRQPSWLPIYVTDELLPFVNRLRDGGKYADVQVGDYAIQRMFDNYDLDNSIPLSSGGTSISNTSNTNPAAKILERDRTDNKFKIFGSIYAQYQIADPLTFKVTGGGDIQYTKRRRWQGVLSNRNGASAAQLDLFNEKRVHGSLDGYFAYDKAIGDHSISAIAGFATERWNFSNDAQSGNGYTSDKLQTISAATTIISFDSEKYEKALFSVFARANYAFADKYLASVSLRRDGSSIFGSNYKYGNFPAFSAGWMVSNEDFLAESDVISKLKLRVSYGFTGNDVLDTNVNQIDHFPSISLLDPSTAVIDGSVTNGYNPLNIANEDLQWERLREINPGIDFGFANGVISGSLDYYDRTSDQLLLNNPISATTGFTDALVNLGEVKNSGFELELRSRNVSKENFSWNTTLIASKNKNELIDFADSNGQIQSVDSKRAAEWINLEGNPISSFYGWVVDEEIPLEYISNPYHPIGAQAQDVYVKDLNGDGLIDDDDKTILGNPYPDLVWSLSNDFKIHDFDFAFMFQGSHGAEVRNMADQYIFNHFNSAQDFISSTPNQGFIKQKIFTNSIIQDASYVALRTVNIGYTLPNSLTEKLNVKKLRLYLTGQNLLYFTADGYTGWNPESIYQQSGSQLSTTYGYQRGGSPINQTISLGLNLEF

SEQ ID NO: 15070 - protein, 747 aa, Helicobacter acinonychis
MRAVHPRPTLRALLAGASLAVLAQAAPSLAQDAAPRRGGANPPAGGSVQLGELSVTGQGGGPASGVPAGAPVRAAESPTGPIDGYVARRSATATKTNTPLIETPQSITVVGRQQLDTQNAQTLTQATQYVAGTYAGTFGADTRLDFFQLRGFVVSDYGLYLNGLQLLNYGFAYSRVDTFGLERIEVLRGPSAVLFGAGNPGGLINQISKRPTETPFGLVEVGGGSFDQRYAAFDVGGPADAEGHWFTRLTGYARNGGTQVQGAPDDSYYIAPAFTYKPDGSTKFTVLSSFQHDNTAVTANFLPYYGTARPTVLGLRIPRSLNVGDAGFNTFRRDQAFIGYEFEHVFDDTWAVRQNARYGYTQSFQNSYIGQLGYTDPLQTQLGRYLFRDSAKIAQLDVDTQAEAKFSDGFFRHDFLMGVEYRNFQIHDNQASGFPGPDLNILAPIYGPQTVSASPYLINANSFQQVGLYFQDQIKLTPELTLILGGRQDFVQNTVYDRLTPANTNGRNDSAFTYRAAAIYNFDFGLAPYIMYATSFQPQIGVDINNRTFRPDTGDQVEGGVKFEPPGQGYFLTLAGFDIHRNNVLTPNPVNTIFQTQVGAVRSTGFEAQLVANVADGLNLVASFTKFDFTTIRDADPVRVGKTPVNIPQTLASLFADYTIPLGPWRGFGFGGGVRYVGSSFADVGNTLRVPDYVLFDAQVHYDYENWRFQVNASNLADRRYVASCQSNVSCFYGDARRVLAKVSYKW

SEQ ID NO: 15071 - protein, 710 aa, Helicobacter acinonychis
MLPHPLLATTIGLLLTLNAAQAEEQPAGAPAGSAEQETASQLPALTVSASPMSGYSVPNASTATKTDTPIMETPVSVQVIPQQVLQDTQARSLPDAVNGKVSGVLGRTGGGFLYDNFVIRGFSDTSGFGTAYRNGLINRQDIYDVSNIERIEILKGPASVLYGRIEPGGMVNYVTKRPLDEPYYAIQQQIGNYHQQRTSLDLTSPVDDDHTLLYRLNAAYQNNESFRDFVASERTFIAPVVAWRPNAHFEANVELEYKRDRFQADMGIPAVGDRPAPIPIKRSLTDGPGRQFLEELLIAYDWTWRLNDNWKVTQRFHWRDWTLDHRQTLPRGLAVDNRTLDRWQHEASQKIKTQVASLDINGHFELLGTHHNLLIGIDDFRSETRSPSNFSPAPSIDIYNPIYGQIDFDSLSDNGYFYRKQRWNGIYIQDQITLGGRLHLLLGGRYDWTKSGQNFSPTSVGDAKSNRDDLTNNQFSPRAGLLYELTDALSTYASYSKSFGINNSLAADGSTFDPEQAEQYEIGLKGGWFDRRLTGSLALFELTRDNLRTADLSNPGFQVLAGKAKSTGLEFDLAGQLTDHLKLLATYAYTNVRYTRNNDGLEGNRFENAPRHQGSLWANYQLNAELNGALGVIALGKRKGDRANSFQLPGYGRVDAMISYAPRLGPSRMRLQLNIYNLLDKKYYANSGGSRWNIMPGAPRSILGSVRFEF

SEQ ID NO: 15072 - protein, 412 aa, Helicobacter acinonychis
MLYKSSLAVAISVLIAGQVSAAGFQVAEHSASGLGRAFSGEAAVADNASVLARNPAAMMLFETAQFSGALSIVDPEVNVDDLSNNQSMKDVAPLQIVPAAYYIRPINDQWAWGLAMFTTYGVATDYPNEIYAGDLAGDTSLISVNLNPNIAYRVNPELSLGFGLDLVAAKAKLTRHKGGLAPFIGGGNPSDNLIGMTGETLALGWNIGALYELDEQNRIGFGYRSRVKLNFDDGEFSSYDSGIATSAVVPGQLKIELPAIWELSGFHQLNEQWAVHYSYQQTDWSSFEELTATSSQCKNGTCFQKIEQYQDNGRWSVGATYTLNTTWTLRAGLAFDEQAGKATLSIPDSDRFWYSAGLTYTLTPQLTMDAGFALVQSRKGSFTEKNQIGQNLQFESEAVAYISALQFNYRFH

SEQ ID NO: 15073 - protein, 966 aa, Helicobacter acinonychis
MNDFRGVPMSFSLPLRPVRSPSFLSLSVAAALGLTVGADLHAQQTPAAGDATQTLDSVVVTGSRLRRVDTETANPVVTVSQEQIAATGKATVGDLLQELPSIAGNATNPYTNNGGGTGASAVSLRGLGDKRTLVLVNGIRLAYNDVNAIPASMIERIEVLSDGASAVYGSDAIGGVVNFILRTRFDGVQFSSDFGTSKERDGNRRNFALTAGKTFERGSLIAGLSYHNIDPVSAAARDYSKDALALTDGVPVKQGSSATPTGTVNFNDGSDASSQLRQANGCTRVTLNGGVSGRAGPGDFHCYDAAADSYNYQPFNLLQTPQKRTNAFVLGTYRFSDSVEGYVNTWFSKTESASIIAPIPIFSNGDNILVSSQSYYNPFGVNFGTDRSSGTSYNDFNTRATVLGNRSYQYNTYNFQISPGLRGRFGDSSWQWDATFNYGKVKQKSINNGFLDYATFNQAIGPSFLDSDGVVKCGSAGAAIAGCTPLNFFNLNDSSNLATLQGMVVNPIVTSVYTVKQFEANANGTLFDMPAGAASLAAGLSYRKERSTTTSDPLWTGDEDGLCGVIEYCASTLSGSFDVKEAYAEALFPLLKDLPGINALNITLGTRFSDYSSVGSKTNSKVSLEYRPIENLLLRGTVSQVFRAPNINELYAGVAGDAATVNDPCNGYTGGSSVACANVPTDGSYQQSDGQVSGKVSGAAVAGYQLKPETGKSYDVGLVYDPQWIDGLSLSADWWRIDLEDTITTVSAQTVLNQCYANSASAFCPLIHRNGNGTINYIAEPTVNLGKLWAKGIDFNLTYRLPETAWGNVNVGLNGTYLTRYDVLPDTTDPSSVTIHNVGRYTQAYGNFPRWRGLGTVSWALGDWSATWRIRYVGNTAIGNSDPDQSLSADSSQPTVVRKIGAYVYNNLQLGYEVQPWHTRFEVGVDNIADKQPPLYYSNNVGNANTDVATYDLLGRFYWARATVKF

SEQ ID NO: 15074 - protein, 413 aa, Helicobacter acinonychis
MNIKKSVLTLAVLSTLSVSAMANTPTNEEIYQMMKEMKEEMAELKKENETLKGEVEDVAGSVEEVADATDEAIKAQVKLSNKTTIGGYGELHYNGLRDQKGDGHKNQIDYHRFVLFINHEYNDKLRFVSELELEHSLAGDGKPGEVELEQAYVQYDLTEKTALVGGLFLTPVGILNETHEPPTFYGVERNDVEKNIIPTTWWEGGAMLQHEIIDGLAADVAITSGLNATAAKSFVPRSGRQKVAEAEAKTFAYTGRLKYTAVPGLELGGTINYQDNYCQNNVDGCDSAVLYEGHVVYNKDAFGLRALYAAWDISGSAVSDVGADKQYGYYIEPSYRFNNAIVNGQDIGIFARYATWDNADGNSSDTDLKQYNLGFNWWVDKDVVVKMDYQIQDVGDAISTEMDGLNVGLGYQF

SEQ ID NO: 15075 - protein, 152 aa, Helicobacter acinonychis
MKRFIPLLLLGATTSAQATDTLHQIYIQPSLANLKIDGSHVDGLMTQVGYNYHFAPMVALDLSYYMTESMDNVTSNNDSAAVDGASIAAKMYFPMSYYGSFYGKMGLNRTNVEYKNTVGNQTMKQDSTTTKPYVAVGGVMKLYPSVTFNVEC

SEQ ID NO: 15076 - protein, 924 aa, Helicobacter acinonychis
MDIVGRSLFCLLINMYLNNMKYVGALKNKRSFIFVFVALFHPLESYAQETVEQTQNQAKPDKVVRVAVTGSRISKAQKDGPTSVTVITAADIEKQGFSNAFDALNNLTQNTGFVQGADYGNTFTPAANAISLRGLGPNHTLTLINGHRVADYPVPYDGSVNFVNLANIPTAIIDRIEILNGGASAIYGSDAIAGVVNIILKKKTDGTQFNIKAGGTKKGGENLRLQLSGSKTLDKLSLVYGVELSGREPIWAADRDFMKSRTRLGEKPDTIVGRKNADTGKYLSIGGCQAFNGLFNGSVNNIGQAGADNCASGLARPTYWTVQTQNRSQNGYLGLDYELNDKTQLFADFLIGANQIENNTRSPIWTSLAATSGYFLNQDSGNYEIWNRRFAPEELGGVERINKKWKELSSNLNFGIRGDIGETSWSYEAAYNGSIYTSQLNRQGLLRSNVDEYFLGQQLGTDADGIPIYSPHLDRLSRPLTASEFESISGTTKEKDKSWAQSLTLSANGDVFKLPAGMAKLAAVAEIGRQGFSIKPDQAVENGEFYNTSSSGEYSGTRTRQALGAELFLPLAKPLNLTLSGRYDRYALSDNSIDKLTFGSGLEFRPHPTLLVRGNYATSFRAPDMNYLFLNKQKGYFASTTDYLRCNQTGQPLDKCTFKDYSPGANYTLTGNKELKPEEGKSYGAGFVWSPTNKFDISVDYWDIKIDNLVTNLSADKILRLEADCRLGNQDINSAACIDALARVERNPANAVVDPNVIKNINIVPINAASDHTRGIDFTTRWRWKTDSFGNFLWTVNYSRVLEHEYQQSKDGEKDDYLKDLSIPDWRDRFNTSLSWSFGDWASTVLVNRYGKIPNGDQTAYLSPTYLVNWSGTYQISPKASASIIINNLFDKVKRDDTGGWPYYPVGSYSPFGRQGWLEFNYKF

SEQ ID NO: 15077 - protein, 300 aa, Helicobacter acinonychis
MKRVITLFAVLLMGWSVNAWSFACKTANGTAIPIGGGSANVYVNLAPVVNVGQNLVVDLSTQIFCHNDYPETITDYVTLQRGSAYGGVLSNFSGTVKYSGSSYPFPTTSETPRVVYNSRTDKPWPVALYLTPVSSAGGVAIKAGSLIAVLILRQTNNYNSDDFQFVWNIYANNDVVVPTGGCDVSARDVTVTLPDYPGSVPIPLTVYCAKSQNLGYYLSGTTADAGNSIFTNTASFSPAQGVGVQLTRNGTIIPANNTVSLGAVGTSAVSLGLTANYARTGGQVTAGNVQSIIGVTFVYQ

SEQ ID NO: 15078 - protein, 938 aa, Helicobacter acinonychis
MALGQVTPQPPAAQEDDVADIVVTGIRGSLQSATNAKKNAVAFGDSIFAEDIGKLPATNLAETLNRMPGVRLNRDINGEGTQVAIRGLGPSFTRVLLNGSQLQVASDGGTNGGSANREVDLDFFPSELFTRLDLAKTPSPSTLEGGIAGTVNLRNARPFDKPGTHVTVVAQGQYTDSNDKISPRGAIVASHTTDTFGILLGVAGVKTKTRVDGYETLGYSDGNLGAGDPGGNNFSYASIVPNNAGHGLVAGQPVDVVATSGLTRDQLSTALIPRLGRQALTQGDRSRISALASLEWRPSDELHFALDGIWAKSKRNYDRLIMNWQVRNSGPGTSAQSTGGMIPIDLTVDDNGVVTSGTFANSSFFLEASQFRQTTKFWNINPSLSWQPSDLLKVDLSANYSKSRFFREQPSWVFQTAPQSGVDVYYDNSGQGDYPSITTNVDLNDPNNGLWEWYRQNVALVRRKTETKGAHLDVTYGDDVFNVKVGAAFDRAQRSIRAYDNSPAYQLSVCGTGCTGDTGSIPTSAIPQYLMPGSVKNFGHLASGNIGFTRYIMPDFGAIRDVTDYESYRDSAPETRGAVTGGATGDMDEEVWGAYFELNGVTTIAGRDLRINTGMRYARTRQEVVGPSQIGSEIVDITSRSTYENFLPSINLTYDIADNIKLRASASRTMTRPDASQILPGITFSDPSALVASAGNPDLKPYTSDNYDLGGEIYTGGIGYVGLSLFMKNIQGFTVTTSQEVSFGSLNIPFDSLIPTQQNALNDRSLQTGIPVGQLPITVNRPINLSDLKIKGLEITWVQPLDFLMKGLGFSANGTYLDQSSSSGLVATGVSKYSYNLQGFYEDDRLSVSLNYVWNDDAIAVNRPQNGIQNASLRSKARGQLDLSAGYQLPFLNDGVRLTLDALNMTNEPIRTLFEYDNAPYSVYYPGRTILAGIRANF

SEQ ID NO: 15079 - protein, 877 aa, Helicobacter acinonychis
MLRNQFRIVFVSCIVASSLQAQETTHTLGKVTTKGERTFEYNNKMYIDRKELQQRQSNQIRDIFRTRADVNVASGGLMAQKIYVRGIESRLLRVTIDGVAQNGNIFHHDANTVIDPNMIKEVEVIKGAANASAGPGAVAGKLSFTTIDANDFLRKNQTYGAKAEAAFYTNFGYRMNATAAYRGKNWDILAYYNHQNIFYYRDGNNAFRNVFHPNYDLQDPSNSEMSVGTPSEVNSVLAKINGYINETDSISVSYNLTRDNSTRLLRPNTTSALSKANDPGSQPAPFVIDFGKELAHTINFNHNLSLKYKHEGGPNFNQPRVESTAFLGVRGGNYNPVVNPFAYNSNEPANPDYIPEVREWCNNPDNISQCTQGAIRPSNGGYQIGYGTPNSINWQGDSDSSGGAQAGYGQLNAISASANVYHGLVPKNPDYDMTPPNAQNPSANDWTLGNADAEGTLARRIFLINSGVNFKVTHPISEDYGNVFEYGMIYQNLSVFSGLDKGKNGYYKNNIDPNDPNGPGLPYRHYYTDQSSQYPQNLNTPNPLYRNMPQNSHAIGNIIGGFMQANYNILSNVIVGAGTRYDIYTLLDKNGRTHVTSGFSPSATVLYNPIESIGLKVSYAYVTKGALPGDGVLMRDPTVIYQRNLRPAIGQNVEFNVDFNSKYFNVRGAAFYQVINNFINSYGQDTSKNGGGNATAKNMSGNLPETINIYGYEVSGNVRYKNFLGTFSVARSWPTARGHLLADTYALAATTGNVFILKADYDVRRWGLTLTWLSRFVTNMYYEGYSIYYPQYGLIKIHKPGYGVHNVFINWTPPSKKWQGLRISAVFNNILNKQYVDQTSVFQASADAPASDMIPKGKRMALPAPGFNARFEVSYQF

SEQ ID NO: 15080 - protein, 810 aa, Helicobacter acinonychis
MRHFRYSVLAIACASTFLATNVYAEQTDESLDNVERITVYGRQNQVVMNSGLATKSDMSLMETPAAVVIVDQELIQAQALTNLQDLVRNISGVTQAGNNYGIGDNLVIRGLGANYTYDGMYGGAGLGNTFNPTRSLTNVESVEVLKGPATGLYGMGSAGGVINLIEKKPQFESKHVFTAEVGQWNTHSLEVDSTAAITDDLAYRVVAKTARSDGYREIGTDRDEIYTSLKYVLDDSQDLMLSASYIRDAIAVDSIGHPIRIFNSASVGGKTAGEVTWEDLINDPNNAGIQLTEAQRKQLADSLASNDGLTPYAFGNAGIISPMAKDNEGEELRFKLTHNIYFTDNLFLNQQLQYRDYTSGFARQTGAYNYVYWDRRGAINADPRAPLVEDGVLYPFAARRQEYRKVDADESSWQYFADLRYDFQIGDIDNELLINANFEDRNIAFKQYSIYDADKVIKNKAGEVIYQGRLPYIYDIRNPNWAEGSFEDHDPLLTSNYDKKVSAWGVGVQHVGYLGYGFTSRIGVAFNQIKQAYEHLGVDSRYSASRAQPTPEADTTDDGMTYNLGLTYMPTDDLSFFVNHSKGRTAYSILGSIAGNDTDRDDSESVSDDLGMRFKAFDDQMLTSIVFFKSSRTNLQYSNVDYEEGVSGPSVPKYFYNGSEETTGVELDMNAHLNEQWMVNVNAVYQDARDKKDPNRSSYDTRQKGVPYVSASAWVTYGADWFSLASPINISLGGKYVDDRSTNSTSFGIPDGYVSSYTVLDSAISYDVDNWKLQLNVNNLFNEEYYSKAMFLGGMPGEERNAKLTLSYRL

SEQ ID NO: 15081 - protein, 357 aa, Sphingopyxis terrae
MRRKMKKTAIALAVALVGFATVAQAAPKDNTWYTGGKLGWSQYQDTGSIINNDGPTHKDQLGAGAFFGYQANQYLGFEMGYDWLGRMPYKGDINNGAFKAQGVQLAAKLSYPVAQDLDVYTRLGGLVWRADAKGSFDGGLDRASGHDTGVSPLVALGAEYAWTKNWATRMEYQWVNNIGDRETVGARPDNGLLSVGVSYRFGQEDAAAPIVAPTPAPAPIVDTKRFTLKSDVLFGFNKANLKPEGQQALDQLYAQLSSIDPKDGSVVVLGFADRIGQPAPNLALSQRRADSVRDYLVSKGIPADKITARGEGQANPVTGNTCDNVKPRAALIECLAPDRRVEIEVKGYKEVVTQPQA

SEQ ID NO: 15082 - protein, 196 aa, Wolbachia endosymbiont
GPISDEETSYYVRLQYNGEILPLFTKIDGITNATGKEKDSPLKASFIAGGGAFGYKMDDIRVDVEGLYSWLNKDADVVGSTVADNLTAISGLVNVYYDIAIEDMPITPYVGVGIGAAYVSNPLAKKVTDDKASGFGVAYQAKAGVSYDVTPEVKLYAGARYFGSYGANFGKATKDDAGIKVLYSTVGAEAGVAFNF

SEQ ID NO: 15083 - protein, 198 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYRAKAGVSYDVTPEIKLYAGARYFGSYGANFGKTAKDDGGIKVLYSTVGAEAGVAFNF

SEQ ID NO: 15084 - protein, 1617 aa, Rickettsia massiliae
FAGSAMGAAIQQNRTTNNGVATTVDGVGFDQTAGLVNVAVAPNAVITANANNGINLNTPAGSFNGLFLNNANNLAVTVSEDTTLGFINNANNANHFNLTLGADKTLTITGQGITNVQAAATHNAQNIVAQFNGGAAIANNDLSGLGTIDFGAAASTLVFDLANPTTQKAPLILADNALIVNGANGTLNVTNGFIQVSDKSFATVKAINIGDGQGFMFNTNATNANTLNLQAGTTINFNGTDGTGRLVLLSKNGAATDFNVTGSLGGNLKGIIELNTVATNGQLIANAGPANAVIGTNNGAGRAAGFVVSVDNGKAATINGQVYAKDMVIQSANANGPVNFRHIVDVGIDGTTAFKTAASKVAITQNSNFGTTDFGNLAAQITVPDTMTLTGNFTGDANNPGNTAGVITFDANGTLASASADANVAVTNNITAIEASGVGVVQLSGTHTAELRLGNAGSVFKLADGTVINGKVNQTPLVGGVLAAGAITLDGSATITGDIGNGGGGAALQGITLANDATKTLTLGGANIIGANGGTINFQANGGTIKLTSTQNNIVVDCDLAIATDQTGVVDASSLTNAQTLTISGTIGTIGANNKTLEQFNIGSSKTVLNGGNVAINELVIGNNGSVQFAHNSYLITRTTNAAGQGKIIFNPVVNNNTTLAAGTNLGSAANPLAEINFGSKGVHADTVLNVGEGVNLYATNITTTDANVGSFVFNAGGKNIVSGTVGGQQGNKFNTVALDNGTTVKFLGNATFNGNTTIAANSTLQISGNYTADVIASADGTGIVEFVNTGPINVTLNKQAVPVNALKQITVSGPGNVVVNEIGNAGNYHGAMTDTIAFENSSLGAVLFLPSGIPFNDAGNIIPLTIKSTVGNETAKGFNVPSVIVSGVDSVIADGQVIGDQNNIVGLGLGSDNGIIVNATTLYAGIGTINNNQGTVTLSGGIPNTPGTVYGLGTGIRASQFKQVTFTTDYNNLGNIIATNTTINDGVTVTTGGIAGTDFDGKITLGSVNGNANVIFADGIFSNSTSMIVTTKANNGTVTYLGNAFVGNIGDSDTPVASVRFTGSNNGAGLQGNIYSQVIEFGTYNLGIVNSNVILGGSTTAINGKIDLLTNTLTFAGGTSTWGNNTSIETTLTLANGNIGHIVIAEGAQVNATTTGTTTINVQDNANANFSGTETYTLIQGGARFNGTLGGPNFTVTGSNRFVNYGLIRVANQDYVITRTNNAENVVTNDIANSPFGGAPGIGQNVTTFVNATNTAAYNNLLLAKNSADSANFVGTIVTDTSAAITNAQLDVAKDIQAQLGNRLGALRYLGTPEMVGSEAGAIPAAVAAGDEAVDNVAYGIWAKPFYTDAHQSKKGGLAGYKAKTTGIVIGLDTLANNNLMIGAAIGITKTDIKHQDYKKGDKTDVNGFSFSLYGAQQLVENFFAQGSAIFSLNQVKNKSQRYFFDANGNMSKQIAAGNYDNMTFGGNLTVGYDYNAMQGVLVTPMAGLSYLKSSDENYKETGTTVANKQVNSKFSDRTDLIVGAKVAGGTMNITDFAVYPEVHAFVVHKVTGRLSKTQSVLDGQVTPCISQPDRTAKTSYNLGLSASIRSDAKMEYGIGYDAQIASKYTAHQGTL

SEQ ID NO: 15085 - protein, 1794 aa, Haemophilus influenzae
MLNKKFKLNFIALTVAYALTPYTEAALVRNDVDYQIFRDFAENKGKFSVGATNVEVRDNKNNNLGSALPKDIPMIDFSAVDVDKRIATLVNPQYVVGVKHVGNGVGELHFGNLNGNWNPKFGNSIQHRDVSWEENRYYTVEKNNFSSELNGKTQNNEKDKQYTSNKKDVPSELYGQALVKEQQNQKRREDYYMPRLDKFVTEVAPIEASTTSSDAGTYNDQNKYPAFVRLGSGSQFIYKKGSHYELILEEKNEKKEIIHRWDVGGDNLKLVGNAYTYGIAGTPYKVNHTDDGLIGFGDSTEDHNDPKEILSRKPLTNYAVLGDSGSPLFVYDKSKEKWLFLGAYDFWGGYKKKSWQEWNIYKPQFAENILKKDSAGLLKGNTQYNWTSKGNTSLISGTSESLSVDLVDNKNLNHGKNVTFEGSGNLTLNNNIDQGAGGLFFEGDYEVKGTSENTTWKGAGISVAEGKTVKWKVHNPQFDRLAKIGKGKLIVEGRGDNKGSLKVGDGTVVLKQQTTTGQHAFASVGIVSGRSTVVLNDDNQVDPNSIYFGFRGGRLDANGNNLTFEHIRNIDDGARLVNHNMTNASNITITGAGLITNPSQVTIYTPAITADDDNYYYVPSIPRGKDLYFSNTCYKYYALKQGGSPTAEMPCYSSEKSDANWEFMGDNQNDAQKKAMVYINNRRMNGFNGYFGEEATKADQNGKLNVTFSGKSDQNRFLLTGGTNLNGELKVEKGTLFLSGRPTPHARDIANISSTEKDKHFAENNEVVVEDDWINRTFKATNINVTNNATLYSGRNVESITSNITASNKAKVHIGYKAGDTVCVRSDYTGYVTCHNDTLSTKALNSFNPTNLRGNVNLTESANFTLGKANLFGTINSTENSQVNLKENSHWYLTGNSDVHQLDLANGHIHLNNVSDATKETKYHTLNISNLSGNGSFYYWVDFTKNQGDKVVVTKSAKGTFTLQVANKTGEPNHNELTLFDASNATERSGLNVSLANGKVDRGAWSYTLKENSGRYYLHNPEVERRNQTVDTPSIATANNMQADVPSVSNNHEETARVEAPIPLPAPPAPATGSAMANEQPETRPAETVQPTMEDTNTTHPSGSEPQADTTQADDPNSESVPSETIEKVAENSPQESETVAKNEQKATETTAQNDEVAKEAKPTVEANTQTNELAQNGSETEETQEAETARQSEINSTEETVVEDDPTISEPKSRPRRSISSSSNNINLAGTEDTAKVETEKTQEAPQVAFQASPKQEEPEMAKQQEQPKTVQSQAQPETTTQQAEPARENVSTVNNVKEAQPQAKPTTVAAKETTASNSEQKETAQPVANPKTAENKAENPQSTETTDENIHQPEAHTAVASTEVVTPENATTPIKPVENKTTEAEQPVTETTTVSTENPVVKNPENTTPATTQSTVNSEAVQSETATTEAVVSQSKVTSAEETTVASTQETTVDNSGSTPQPRSRRTRRSAQNSYEPVELHTENAENPQSGNDVATQLVLRDLTSTNTNAVISDAMAKAQFVALNVGKAVSQHISQLEMNNEGQYNVWVSNTSMKENYSSSQYRHFSSKSAQTQLGWDQTISSNVQLGGVFTYVRNSNNFDKASSKNTLAQANLYSKYYMDNHWYLAVDLGYGNFQSNLQTNHNAKFARHTAQFGLTAGKAFNLGNFAVKPTVGVRYSYLSNANFALAKDRIKVNPISVKTAFAQVDLSYTYHLGEFSITPILSARYDANQGSGKINVDRYDFAYNVENQQQYNAGLKLKYHNVKLSLIGGLTKAKQAEKQKTAEVKLSFSF

SEQ ID NO: 15086 - protein, 190 aa, Wolbachia endosymbiont
  misc_feature (30)..(30): Xaa can be any naturally occurring amino acid
EETSYYIRLQYTGEILPLFTKVDGITYKKXNSDYSPLKASFLAGGGAFGYKMDDIRVDVEGVYSYLNKDNVTDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGYTVLYSTVGAEA

SEQ ID NO: 15087 - protein, 821 aa, Wolbachia endosymbiont
VLSILFVSRRQRVAQRVLAASLAFSGGLLAPAAGAQTAVGSYDIAAGPLAEALTRYAQARGVVLSFEPSRLRGLSSPGLKGEYGVAEGFARLLAGSGMQARQGADRVWTIHAAPQHGTQTLAPIAVTTMDSALMPTVGYVAKASMTATKTDTPLIETPQSVSVVTREQIREQGAHTLNQVLRYTAGVTPESRGATATRLDQFTVRGFSASSYLDGMRVFGGRDALPQVDAYRLERVDIIKGPSSVLYGQGGPGGVVNQVSKRPLDERLNEIELQAGNFHHRRVNMDFGGPIDEGGEFLYRLTGSAYGADGQVEHTKEKRYFIAPAFTWRPNADTSLTLLANFQRDPDMGSYGALPAMRTVLSAPDGRKLPSNFYDGDANFEESDRRSHSLGYVFEHRFNDTVKVSQSLRYLHSEGVYRSVYGASTNYYGYTGPDYRYQKRASIATDVDVDALTLDNNLQANFNTGPLAHTLLFGFDYQHVRTNTLAGYGTAPSLDVFNPDNSMTIAVPAYSSDQTQRQVQTGLYAQDQIKLDRLSLVLGGRYDWARTHTGTDNLATGRHSSSALAAEAFTGRAGVIYNFDNGLAPYASYSESFEPQSGAGWNNSPFKPIKGKQYEMGLKYQPPGSNTLITLAAFDIRRSNMLTTDPDPSHMCGTGRCNVQAGEVRTQGFELEGKAEPLRGLSVTAAYTYLDNRYEKANPNAVGFNLQGKRPYGVPEHQASVWTRYQLQEGPLAGLGVGAGVRYLGSSWGNDKNTFKVPSATLVDLMLDYDLGRLTASLKGMQVALNVSNLFNKEYVASCYDDSWCWYGYQRSVKASLRYRW

SEQ ID NO: 15088 - protein, 696 aa, Escherichia coli
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 15089 - protein, 742 aa, Burkholderia cenocepacia
MSSAFPRSRRHLLVHATALVSTCLVVLPAAAQSRSSDSSLPPVTVQAPDQAARPAPVRPKPRAASQSTRAVRSAAPAAQPSAAPAASEVARGPALTVLTAQQALRDIEQTPGGVALVPANAYRNSTVSNTIKDILDYVPGVFAQPKWGDDTRLSIRGSGLSRNFHLRGVQLYMDGIPINTADGYGDFQEIDPTAYNYVSVYKGANALQFGANSLGGAINFVTKTGRDPFPNGVSVDAGAFGYRRLQANAGGVNGAWDGYITASAQAADGFRNHSDGQAYRLSGNVGYQITPDIETRFYLNANSVRQKIPGSVTKDVALNSPQTAAANNIALDQQRNIDTVRLANKTTIRFEDTVVDFGAFGVDRHLMHPIFQWLDYRYQDYGGFAKVTDDRIIGGYRNRLVAGVNLLNGRIDNKQYVNVAGNKGALASSSLDKSTNTSVYIEDSFYFLQNVALVGGTQFLHATRDRRDRFLSDGDQSGSTEFNLWSPKGGLLWQIDPNWQAFANVSRSAEVPSFGESASGPGIPFIPFTSIRPQRATTYEIGTRGRRPDVTWDLSLYRAEIKDELLCLYSAFGNCNVTNADRTMHQGVEAGLGVTLFKHLFERAGAPDRLWLNMAYTLNDFRFDGDAKFGNNLLPGAPRHYLRAELLYTNPNGFYMGPNVEWVPQAYYVDSANTLQTEPYALLGLKAGIDNGGPYSIYIEGRNLLDKTYIASASIIDKANANSPLFEPGTGRAVYAGFKARW

SEQ ID NO: 15090 - protein, 370 aa, Burkholderia cenocepacia
MPGSLQAFRCSSWVPQPHSPSKACILQVKAAPASTRTRPRACPPVFPSGRDHYQAGVTGIGSLGYGLGNGFRVEVEGNYRNNRLQQFRSSTFPSSVGGRQQGYGVMANALFDMDIGKSWVFPYFGAGIGYGWQAMNTYVHAPNGAFDQHVGGTTGNFAYQGIFGLSFPVPWVVGLSATAEYRFYTLMGPNGHHATATGIYGGWDKTKEFGVSSGNRDTRTDFNHSLMLGLRYEFNPAPPPPKPVAAPRPIPGPAPTRTYLVFFDWDSAELSTRAKAVVAAAARNSTSVQVTHIEVSGYTDTSAAHPGHRGEAYNMALSQRRANTVKEELVRDGVAAGLITTQGFGESHPLVVTAANTREPQNRRVEIDFK

SEQ ID NO: 15091 - protein, 385 aa, Burkholderia cenocepacia
MNKKLLTIAALAATAGTAHAQSSVTLYGVIDAGISYVNHSKTANGGTGKLFKYDDGVAQGSRWGLRGTEDLGGGLKAIFVLENGFNSGNGTIGQGGAIFGRQAYVGLSQSQYGTVTFGRQYSFSTDILGSNYSTGGNTVAGNYAYHVNDIDQLTSSRINNAVKFQSANYSGFTFGALYGFSNSTDFAGAPATTTGTTTTAGSSRAYSFGLNYANGPVSVGAAYTDIRYPSQSTPGFSTTIANLSTGNVRDLRTYGVGGRYVWGPATAWLLWTRTQFSTVSGAGGTFYNAYEAGAKYAFTPALSGGLGYTYTNATQNGNSWHWNQVNGIADYALSKRTDVYGLVVYQQASGKGVQAQIGSSTSYFNTSGTGSKNQIAARIGIRHKF

SEQ ID NO: 15092 - protein, 384 aa, Burkholderia cenocepacia
MKKLALSTLSLALLGAAGAAQAQSSVTLYGVIDTSITYVHGNDGKANNAWLMGSGNLQGSRWGLKGTEDLGAGLKAIFQLENGFNSNDGTLGQGKRMFGRQAFVGLQHDQYGTLTLGRQYDPLVDLVQPVTADNYFGSLFATPGDVDNNDNSLRVNNTVKYTSPVFAGFQFEALYGFSGIAGSPGQGQTWSAAAAYNNGPIGVAAGYFYTSNPSPTAGSRSTWSGSSDAIFDGAINSGYTSAKSIGIAQVAGQYVFGPVTVGLGYSNAQYKPDGFSGFSSTEKYNTGRGFVTYQATPALLLGLGYAYTKASGDTDAKYHQVSIGADYALSKRTDVYLAGAYQHASGTQRVDATTTQTAQASIGSYGVNGTKSQEMVALGLRHKF

SEQ ID NO: 15093 - protein, 800 aa, Burkholderia cenocepacia
MKAPNLLFLLFFVSFSAFSQGVIRGKITNPVNGEPVAYANILVLGTETGAISDEEGSYEIMDLKPGLYNVRASFVGFKPQTQYEIKVTLARATQLDFELEEDASELNEVVVSSEFSRSEETPLSVRRLNSNEIERYPGGNRDISQVIQSMPGVASTPSFRNDILIRGGAPNENKFYVDEIEVPVINHFATQGSSGGPVGILNVNLIKNVDLITGGFPANRMDAMSSFFEIQLKEGNREAMQTQMTLGASELTLSNNGPLGENTTYSLSARRSYLQGLFKILGLPFLPTFNDFQLKTTTKLNEKTELTFIGVGAIDKFVLNEEIPEDETGEELENRLYLLDVLPVQKQWNYTTGLKLKRYRENGFWTFVLSRNMLNNEAEKYFRNEETPESNLLYRYISQESENKFRAENSIFGDEYTLKYGFNYEYARYYINNYDRSTLANSSEVIEVESTSNYNKYGAFISASRYVFQERLLLSGGIRMDGADFGETAQNPLNQISPRVSLSYQLKPNLFATANAGVYYQKPPYTVLGYQNNEGELVNQANDVRFIQNKQLIAGLEFLVPEKNRRFTLEGFYKRYDKYPSSVRNGIALANLGADFGVIGNEPVVSNAKGKAYGLEFLAQQRLFQNFYGIASLTLVRSEFTNPNTEGYIPSSWDNKVIVSLTAGKRFSKDWEIGARWRYLGGTPYTPYDEDESSLISNWDLRGQPVLDYTQINAIRLDAFHQLDLRIDKKYYFPKWNLNWYVDIQNVYNYEAEQPPLLVPVRDAQGTIQVDPTDPSRYQLKYISNTAGTILPTVGIIVEF

SEQ ID NO: 15094 - protein, 380 aa, Burkholderia cenocepacia
MKKTLIAGAGAAALLTPLAHAQSSVTLYGLIDAGIAYTNNVNGASQWRMTTGTINGSRFGLRGTEDLGGGLKALFVLENGFNANNGGLGQDGKLFGRHAYVGLSRAGYGTLTLGRQYDTMVDFVAPLSATSGDFGDTGFAHPFDNDNLNHSLRINNAVKYTSDTIAGFKVGALYAFSNSANFSANRAYSVAASYTNGPLKLAGAYLQMNGTKGSTSASPGATDSAEAKSLNQGGWSIGSDRMRTYGGGVSYVFGPATVGFVYTRSQYDNTGAFGSSGQIAFNNYDVNVRYAVTPAVSVGAAYVYTDASVSNPDSKHGTDPKWHQANLQAVYKLSRRTDLYAEAMFQHASGRGYQAFINTSGGASSTANQVVGTIGMRTRF

SEQ ID NO: 15095 - protein, 985 aa, Burkholderia cenocepacia
MPFPPQRLSFAIALLIATSAAHGKTVQIDTATTASQTLGGKDTLTISAPGSITNSGKAVSLKDGTSGVGVIIDNAGKIISSGGRAIDSSGDLTQARNYAIYNRSGGQILGSNDAIRIDSNFVSGSLLIDNSGTIRSITGQGLDLDALRSDGVKTTIINRAGGLIRGDASDGMKTGANATISNYGEISTGDSHNADQKFDGIDIDTATGVSVTNYGVISGGRHGITTDLGATLVNYGQITGRNGSGFGSDGDGTVINHGTITGAYSGLQANGDGDGVDIDKIAHIENYGTIQGVGAGGVDKGGFANGSEGIALGGGYILNAKDALVSGANSAILVDDGSGGSGLAATSLENYGTIQGLDGFGVKFVGEFADSVINGGAISGSNGLALDLGGGNDSLTLRSGSRFVGTVDGGSGYDRVVMDDAAGGSFGASRNFEWLEVKQGAWTLTGSGDFSDGGAVRNGATLVNQGGIAGNLIVDAGGVYAGGGSVGNLNVNGTLRTDTRFGTATVVHDLNMSSTSTLAYGVNADGSSAPVQVGGTANLNGATLAVNPGSGTYPWQSHYTVLQAARVNGTFGAVTSDYAFLTPTLAYTPTQVDLTYTRNDVAFNEFAATGNGSNAANSLASIGKNNALYNALLNTTQSSAGAAIEQLAGASNANLTSATLGASSQVGSSMLSAMQQIGGSPGLLVGLDQRDTPILAANGVPSEARNLNDPNARGRLWLQAIGGYGKLDGEHGSSGLEQRTKGSVLGADWALNPQWRLGVLGGYSKTDLDATGVDGNVESWHAGVYAQHQNGPLALRLGAAYSGHQGESKRTIAFNGFSDRPKGDYDADSQQAFAELGYAMGTGRLSAEPFASLGYQRYHRERYQEKGGAAALQVDSQTQDNFSSTFGLRLAHLGSLDNGMSFTPRMAAGWKHTYGDVSSSTRQAFVVGGTAFSVDGSSLDRDSLVLEAGLDLGISARHTLGLGYSGEIGSNSRNHGLIGQWQMSF

SEQ ID NO: 15096 - protein, 367 aa, Burkholderia cenocepacia
MRLKYFAWLIAAATPAAAFAQTSVTLYGRIDGGIEYLNHIATPNGSKSRWSAESGDWGTSMFGLKGVEDLGGGLSTVFNLETAFQVMNGQTGGGRMWSRRAYVGLKSNTWGQLQAGRNLFIDSDGVWEFDPFVQQAFSSASLVRGRNWQQSSNNIEYHSPVIGGFDVQAQYAFGNQSRGFNYGAADDFGRSDGIMISYHSPVLDVRGIYDELRDNNGKFSNIFTASREYFVGANVKVSKFKIQGAYTHYQAPDSPAGVADRADHYWLGATYSATPQWAVTGGGYYVKVGDGGGDASHDPSGHAIMYVLGTTYNLSKRTFLYGTVAYARNGGNSNFSLLATPRDATSGTSPMTGESQTGAYVGMMHTF

SEQ ID NO: 15097 - protein, 747 aa, Burkholderia cenocepacia
MKSRPDELKLGKFTTLCSVLAASPAFADGTPPAAPASTEGHLAPIEIQGKTEHSYKADFSASAKFTAPLVDTPKSVTVIPQELIQSSGAATLTEALRTVPGITFGAGEGGNPLGDRPFIRGYDTQGSMFVDGMRDTGATTREIFNTERVEITKGSDGAYGGRGGAGGSINLITKAPHLGTTAAASAGLGTDRYRRFTADGNWQFAEHAAFRLNLMSHNNDVAGRDAVNNERWGVAPSIAFGLGTPTRVTASYYHLQTDDMPDGGIPYFYTTSNKPANVGTIYPAPVDRHNFYGLIDRDFRKTTSDISTIKIEHDITPNLTVRNTTRYTESTQDYIWTQPDDSQGNVVNGKVWRRNNNRNSSINSLANLTELFGEFRTGPFKHSFTTGIELSREWGKRDSYTVATDKGTICQKGIGAASGYNCTSLWSPNPNDPWAGSITRNNDYAHARTTTKSIYGFDTIEITPRWQVNAGVRVDDYSTRFTDTKANGGKTYTRDDTLFNWQAGLVFKPAQNGSIYASYATSSTPAGMMLGEGSETQSLTPGRGGVGPNADQLSPEKNRSIELGTKWNVLNDKLSLTAALFQIDTTNARVTLPNNQYAMVGNKRVQGLELGLAGQITKQWQVFGGYTYMKSQLRDNGKDAANNGNRFPNTPKHSLTMWSNYDVTPKFTVGGGAFYMSEVFGDPANLRAVPSYWRFDAMAQYRINKKLDLQLNVNNLFNRTYFDQAYPAHYASIAPGRSAFVTLNARY

SEQ ID NO: 15098 - protein, 707 aa, Burkholderia cenocepacia
MTVSLARPPVRPRRVAAALACLAASLAHADDSSGDAAVLPALNITAAHDSPQHLTDTISTGALGTRRQLDTPFSTTIVTSEELEARQPYKLGDVFANDASVSDNSGAYSAWASYMTVRGMQLDWQNGYKIDGLPFVTYGITMPYEQLERVELLKGLGGFLYGFVTPGGVVNYVTKQPGAEPVRSVDVNYRSTNVWTEHVDLGQRFGPNDMFGARLNATHEEGKTYNDGNIRRDSVSLALQANLTRDLSVSFGALYQDRRTTGQTPSIFTGSYPGGALPATISGGSTNLGGKDQYLNTNLQLYTAGLQYQLAPDWQLDVAYSYSKATRRRNESTLYLQDAAGNYTDSRYVGMEDHRFSQWRAMVEGKVRTGPFSHQIVLGASWQKQANDYSANSVFVPLGAGNLYAPNPYRYESPHGFIQYRTSEIVQKSLFASDTVQLTERWSVLAGVRYMNYEQRAFQASGAEDPGYRQNGVVTPTFAVMFKLAPTTTAYASYAESLEPGSRVNDVYANAGQVLKPLRSKQYELGIKSEHARWSATAALFRIERSAEYANAANVYVQDGESIIQGIEVGARAKFGAHWNAGVDAMLLDAWYANGIGNNGNRVAGAPRFVLAGDLGYAVPGVPGLTLGVDAKFTGATPLRAAGGLDAPGFLVVNAGARYLTRVGRHDVTLRASIDNVLNRRYWEYQYADYVKPGDPRTVSLSAKIDF

SEQ ID NO: 15099 - protein, 736 aa, Burkholderia cenocepacia
MNANADSCTDYTVTDICEQSKYGAGEFHNIKLGDGVTAGSEDHHFVFNGEGYELYNSNANFSAQIASGTIRYTEVNNSHFTVNAHHFPDDTIYAGRAENTTLNDSLMWVATSADQTLAKGNSMVVVSTQMAMVDQIFVTTLNDGSLPFDPVITNSRYEDTSYEMLWGMKNEAKGWDTKATSHDSVFVDASKQSIEANGHSIGATFYGRATQVVKAGGESQDTHLFDHSYSWVYAEAKLTGLTEVNDAATVYLNAAATQGAYAENVVLNGEDTTLMVRASLDNNAYATVDNLILNGGEVVFQQSSGDQYASLNIGTLSGSGSFLFNTSIAEGKGNFVTIANASGEHKVIVNDSGHEITSPDMTTLDLIHDLSGDATFTLASISGANIIEVDGGTYVYSLNTWDNSARAGGNLWYLGSGLNTGTELEPEPEEKTTPSTDAVLSMASSNQFIFDGEMQNLRFRKGDLNNNKGDGASVWGRYLTNNTRVNAAHDAAYRLQQDGFEIGADKVLEMSSGQLVLGGFTSYSNNRVKHARGGNSTVDSYSLGAYGTYFDNSGYYVDAVVKANRFKNSLNAHMTNGGSVQSDYNQNAIGGSLEAGYHYSLSNNWFVEPYVRTSYYTAQDKDIALNNGMTANIDNNRSAKGEIGTHLGTKIDLNNGAIIRPYAKVAIEREFIKSNTVTINQVNDFNNDLSGHTAKYGLGMDINLTKQTSVYAEANYRNGTHVESPIMANIGFRINF

SEQ ID NO: 15100 - protein, 821 aa, Burkholderia cenocepacia
MSGVDMKQVLHRARASSAAPGFCPLALAIGGVLLSGTIQAQEKTFEDERRTLSTVVVTGNRGAEQRTVTSSPVPIDVVSAKQLQSTGKPGLMEALSAVIPSLTLPEKTGWDASGIARAPNLRGLSAAEVLVLVNGKRRHTSATLSINGINTGAAPADLDLIPISAIDHVEVLRDGAAAQYGSDAIAGVINVILKADTSGTSVTNAGLGYDGKKQTVQQSLNKGFEIGDGGIVQLALDARSQNDDNKASANGYSYEQAYDLAGKSTYGGYGTPKTNLLTLGYNAELPIDDSFSLYSFTTYSRRKGEQGQNFRLPTITNTIPTGPNGYPAGYTPTWYIDEDDFQAAFGGKGTLGEWDWDLSTTYGRNEAEQGTTHNQNPSLGQATPNSFTSGTWISTELTTNLDFKRGFDVGLQKPLDVSYGFEHRRDTYEVQAGDYESYANGGYCVAPGNCASSGAQVTNGISPDEESSASRNSVASYVDVGFNPVPDWYVGSALRYEHYNQGVGATRSGKLTTRYDFTPQFAVRATVSNGFRAPSLANSLFSARSTTYGVVDGVYQSINYGVLPTGSGAARALGAEDLKPERSTNFSLGFTLTPNDQLSLTADAYVINLRDRITLTGTLLGNEVTQVLLNNGVDSTSGGQYFINGADTRTKGLDLVSNYRQDLGQYGSLTWTAAFNWNQTKILGYKESTSILGTSYELMDREARNLITGVQPHTKLILGGDWSIGRFNLNLALTRYGAYKEVNSSANRDLDRVYSAKWITDLDLDYNLSKNLNVAIGAKNLFDIYPKKQGVPSSTMVSSYGTYSPYGFTGGYYYTRLTYAF

SEQ ID NO: 15101 - protein, 660 aa, Burkholderia cenocepacia
MIIANVIRSFSLTLLIFAALLFRPAAAEEFSASFKGTDIQEFINTVSKNLNKTVIIDPSVRGTITVRSYDMLNEEQYYQFFLSVLDVYGFAVINMNNGVLKVVRSKDAKTAAVPVASDAAPGIGDEVVTRVVPLTNVAARDLAPLLRQLNDNAGVGSVVHYEPSNVLLMTGRAAVIKRLLTIVERVDNAGDRSVVTVPLSWASAADVVKLVTELNKDTSKSALPGSMVANVVADERTNAVLVSGEPNSRQRIIAMIKQLDRQQATQGNTKVIYLKYAKASDLVEVLTGISSTMQSEKQAAKPVAALDKNIIIKAHGQTNALIVTAAPDVMNDLERVIAQLDIRRPQVLVEAIIAEVQDADGLNLGIQWANKNAGMTQFTNSGLPISTAIAGANQYNKDGTVSSSLASALSSFNGIAAGFYQGNWAMLLTALSSSTKNDILATPSIVTLDNMEATFNVGQEVPVLTGSQTTSGDNIFNTVERKTVGIKLKVKPQINEGDSVLLEIEQEVSSVADAASSTSSDLGATFNTRTVNNAVLVGSGETVVVGGLLDKSVSDTADKVPLLGDIPVIGALFRSTSKKVSKRNLMLFIRPTVIRDRDEYRQASSGQYTAFNDAQSKQRGKENNDAMLNQDLLEIYPRQDTAAFRQVSAAIDAFNLGGNL

SEQ ID NO: 15102 - protein, 666 aa, Yersinia pestis bv. Antiqua
MGGLVHGGNGTAIGIHRLENVQTSATLELQSGYALEGVTQALVFTGSYAEINDAALDLANSHLVLGGTGDAVFDLTRIDNREEAILDGDPNRITGFGTLTKTNNSIWTLTGANMADGDANAFLSANIAGGILVLDNATLGLTPATTILNRLSAADIAADPTLVATETGALTLAEGGALSSLGDSVLSGNLISAGGILLSNTYTGGNGAATDDRLTVTGTYLGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 15103 - protein, 3098 aa, Yersinia pestis bv. Antiqua
MNTIFKVIWNASLNVWVVVSELAKGRIKTKSSRNLISEGVLPKFEQSMVSKLFRKNLLALSLGSIVFLSTGPVFAADITVSTQAELSAALSNGTYDKIILGADITLIGSLTVNMTSNQVVIDGQGKFGLTVNNTTNYGLVVSSGSGTLTLQNMSKIDSANYYSMVVLNGANTAVNVIYNNIDFLGSSQLIYMGAYGAATNSIMTFGDILNDVVVNDRAQEIGEVNKLAFTGRFHVTHTGSSVTSFVSTGGANNTSTMDFASGADVKIDRTGSTGDLTSTGVNAFAYTFADGASFELIANQNVFSGTTTNRGLEIGSYNSIDGFGSGVKIVLQSRSDGSIISGNGIDNATTNAAGINNNASGDANVIYNLGTGSILKATNTGILATKNANNASDIYIRSAGDITAATGISATHNGTGTVKIKNDGTITSTTAGIAISSASIKEISVDNTDGTITATAGTGVNVLASAILNLFGGTINTSATANGITFAGTEGGHTLTDLTINLLGTGIALSNVAGVNLTLSNVTLNTLNGTALNSLTGLTLVDSLNGRNTINIEGAGIGIAATNTELNTFDAEALDINVNGAGIGIQATGGGVNLSASNLIINVANTLGTALQITDGIDNTTTIGNEIQLNAENATAINFLGSSSKTLNNNGTIKGSVIFAGVADHIINNNGTLDGTLTTGAGNDTLVLDSSSQSNDVINLGDGNNSVTIQNGATVSSIITGNGNDTFTINGMSVGSTYLGSLDAGTGLNTLNFNASTDELAAATSLQGFTNINLVDSHITLVSDDNIGSGMVNIDSSSELLFGSTFDGILHATLGAGTGSAIVNNSANVSLEQASMFAGTWQVNQGGALTASNSNQLGSAKIGLDGTLNLDNIALFNHVLTGNGTLNVAKNLATTAFDFGSTVGGAFSGIVNLTKTTFALSADNAAALASATLKLSDDSVTTVGTTDRTLHGLDLSGGTLIFDGAVPQSQTSGVVTVTDLALNSGTVNITGSGSWDNTDPLATNVSILEQDRAGSTLELINATNVTGDIDALDLLVNGTAITSGTQGVQSAIQQGGSTVANAIHNYGLASSNSNGDSGLYVNYTLSALELLADGADALLLATESGLTANRVLNAELFGVGGLVVDAQNGALTLANGSNRYEGTTTVTAGELILGANGAFGQTSLLDIASGASANINGYSQTVGAVTNVGTVTLGSGGVLTSGLLTNGGILDLTGGALNLTAGGASTVAGGLTGAGTLNINGGNLSVSAANSGLSGQTHIADVASVTLTDTGTLGTSAVEVLGTLNLNGANAAMTNVLSGDGTINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVGNTVKVDIADATLNLNDIALFDHVLTGNGTLNVAKNLATTAFDFGSTVGGAFSGIVNLTNTTFALSADNAAALARATLKLSDDSVTTVGTTDRILHGLDLNGGTLIFDGSPPQSQANGVVTVTDLALNSGTISITGAGNWENEHPVTPPNVSLLEQDRGDILLQLIDADNVTGNANDLELMINGTTISAGQGVQSTVQQGGYTVANATHNYGMTSNGGSGLYVNYTLSALELLADGANALLLATESGLTANRELNAELSGVGGLVVDAQNGALTLANGNNRYEGTTTVTAGELILGANGAFGQTSLLNIASGASANINGYRQTVGAVTNTGTVTLGNGGELTSTDTLINTGMINVTDGILNLENGGASSISGGLTGNGILNIKGGDFTISIDNNGLAGQTNISDGASVTLGNGGTIIGTGNLGSSVIDVLGDLNLVADNSLANVISGDGTINTTATVTLSGNSSFSGAHQIGTNGELTVGQASNLGASSATVNLGTLTSHLILNGVSESIANVLSGVAGSTVDIIGGADTALTANNSGFLGQYALAGNSKLTVASTNNLGASSSVALAGTGDTLSLSGFNGTFGNSVTGSGVLQVTDDAEVTLTSSNGVSNAVTIDIADATLNLDDIALFNHALTGNGLLNVAKNDASTAFDFGATVGGAFTGTVNLNNSTFDLSGNNTTVLAQATLKLSSGNLTSVGNGVQNIGTLAMNGGTLLFDNIVDNAGIITSDGTIAANSINTTGGGEVRVNLPSNLAPSLDGLSVMELDEGEIIVTLATGAATGTGHELTLTDENGDPISAVTYQGVHNAGSTSAAATGSFNYGMTTGEDYDGLYVNYGLTALELLSTGSEALVLTAILANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGGGELVLSGGLLNVSYDNAGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILDTGSVWELTNTISGTGTLVKRGSGTVKIEGDTVSAGLTTIEEGLLQLGSSAVTQTLSLEESLQERALLVSFASNMANLTSNVLITANGSLGGYGQVTGNVENYGNLIMPNALTGGDFGTFTIDGNYTGDEGMITFNTILAGDTSVTDRLVITGDTAGQSYVTVNNIGGVGARTFEGIKIIDVGGDSAGQFTLNGRAVGGAYEYFLYQGGASTPDDGNWYLRTEADDRRPEPASYTANLAAANNMFVTSLADRMGETLYTDVFTGEQKTTSLWLRNEGSHNRSRDDSGELKTQDNRYVMQLGGDVAQWSRNAQDLWRVGVMAGYANSSSSTVAQVAGYRSTGSVDGYSVGIYGSWLADNADDTGAYVDSWVQYSWFDNRVSGQDLATEKYDSKGFTASVEGGYAFKVGESVNQSYFIQPKAQVVWMGVKADDHTETNGTVISGDGNGNIQTRLGAKAFINPSDKAKVSGPAFKPFVEANWIHNTKDFGTTLDGVTVKQAGTANIAELKLGVDGQVNSQLNLWGNIGQQVGNKGYSETSVVLGVKYNF

SEQ ID NO: 15104 - protein, 740 aa, Yersinia pestis bv. Antiqua
MLGIDLRQMAGRGIAVGCVIFSSGLSSATAQEQTPRAPVETLPQIAVDAPPRVARSAVRRPVRPSATFPERRVPAPAPAAIADAALAAASSGPAPLSAPQNQAASARVISGAEINAMPVARVGEVLEAVPGLVVTQHSGEGKANQYFLRGFNLDHGTDLAITVDGMPVNMPTHGHGQGYADINFMIPELISALTLRKGPYFADVGDFGSAGAVGIDYFRAMPKTIAEVTMGSFGYRRLLGTGSTKAGEGTVLAAFEAQTYNGPWDVPDNVRKLNGVLRYSQGTVTDGFSLTGMAYANRWTSTDQVAQRAIDQGVIGRYGSLDPTDGGNSSRFSLSGRFARSSDIGQTDLNAYVIRSSMQLYNNFTYYLDDPVDGDQFNQYDRRMVIGLNGTQRFDYRFAGLPVETRVGLQSRADSIDLGLTKTLQRNWLSTVRADDVTEQSLGLWTDTTVRWTDWLRTTAGVREDYVGGRVRSDTPANSGSASATMTSPKVGIVLGPWLATEFFGNAGTGLHSNDIRGATITVDPTDKITPADRVPLLVRSKGAELGVRNRLVPGLTTSLAVFVLDFDSELLFVGDAGTTEASRPSRRVGVEWTSQYRPLPWLGFDFDVAYTRARFTDVDPAGDLIPGAPAWVASTGLTFGRETGWFGALKGRYFGPRPLIEDGSERSLASLIFNARAGYRFENGLRFQLDVLNLFNAKTNQIEYYYLSRLPGEPLDGVGDRHVHPAEPLAVRLTLAGAF

SEQ ID NO: 15105 - protein, 732 aa, Yersinia pestis bv. Antiqua
MSNKKTFLAASILVALSPTLQAETSSNKETTMFDEVVVSATRTEQSIKDTSSSISKVTSDDIEKTMATDIQDALKYTPGVSANGGGRFGLSGFTVRGMSDSRIKMLVDGVQQPTPYNPGANEQRKYPSTIEIDTLKAIEVNKGPSSTLYGSDALGGTVLMETKNPEDILRTDGDENAFEVKTSYNSIDTSSKTTGTWAMRAAELETLIMLTYKKGNESQTHSNGADIEGPDRGAANPADAQIGNLLAKAFYQLNDSHRIGATVEYFTSQYDEDELSQNGYSMMSRGTPIITYYDNYNKDTNTRLRVGLEHEWQANNLLFDTLESKLNVQQTESLSENYDTSTGPYGSGRRMRERIATDDSIQFDAQFDKIAEFGEGFHQITYGVSFRQNKFATENTDYKYDKGTVGPGHTDMPDATMTQYGIFAQDQAFLFNEQLVLTAGLRYDSFKAEPETNEGFKTEYPDSQNDAFTAKLGSVYHINNNFSVLGQISQGFKAPTLQDMYYFYDSGAVIDANPDLKAESSISYEAGIRAQSNAAQLELIAFYNDYSDFINQQYLGKVVGGPNDGKEHYTKENIDSAEIYGIEFSSTYLLDEAFNAPQGTYSKLSIAYAEGRDKKTGAPIDSVAPLTSNLGLGYDSVGYTYGALLNINMVAGKDKWSNVGHENINVAGYTLVDLTAYYKPMKDLTLRGGLFNAFDKQYWLYNDMIGTESGDDGIDRKAQAGRNWGIELDYKF

SEQ ID NO: 15106 - protein, 671 aa, Yersinia pestis bv. Antiqua
MEWGAEKVVDPRRLKLAVLGLGVLLAFPSEAGAAQDDLTALPFEELLLRDFVSASRLARQVSDSPAAVAIVTADDIRAYGYRTLADVINGMRGLYTTDERTYHYMGGRSFGDVEDYAGRVMLLIDGYAVQDNLFDQAYIDESGLIDLELVDRVEYVPGTGSVTYGNNALLGILNVVTRRGRDFDGARVSAEISSRGASRQRATWGKHFNNGAEVLLSASTLDVDGRNLYFPAYDTPATNFGVAEGLDGERNQRVFGKLSWSGWTVQAAWVEREKSVPTNPSAYTAFNTPFPTRDESAFLGVRHETDLGLQLYSSSSLMLGRYAYWNQREYALDEDGEYDDGEKYGVRDYHGAWWRFDQKFVGRWFVDHTLVFGAELRDDHRQSFHRRFLSPAGEVTDRDDGELSRRTFSLYVADDYRLNQQWTLNLGVRHDDADDLDGNLSPRAALIWQQDPATTWKASYSEAFKMPNANDRWTSDDTAVPEYVAATELVLQRQLAPHTRFTGSLYRYRRSDLPIENADGDEVPEGSSRARGVETEIEHVWERGARARASVAWQRSRDVYGRDAVNSPDLLGKLAFTFLLPGEALRAGLETQYLGPRLTRERRMLGGVTLSNLTLSTERDWHGLSASLSVRNLFDRDYETVSGFDWRPGDVAQDGLRMDGRSVWLQVGYAL

SEQ ID NO: 15107 - protein, 360 aa, Yersinia pestis bv. Antiqua
MMKRNILAVVIPALLAAGAANAAEIYNKDGNKLDLYGKVDARHSFSDNNKQDGDKSYVRFGFKGETQITDQLTGYGQWEYNIQANNAEDTGAQDGNATRLGFAGLKFAEFGSFDYGRNYGVIYDVNAWTDMLPVFGGDSISNSDNFMTGRSTGLATYRNNNFFGLVDGLNFALQYQGKNDRSEVKEANGDGFGIGSTYDIGNGINFGAGFSSSNRTLDQKYGSTAEGDKAQAWNVGAKYDANNVYLAVMYAETQNLTPYGSFSDTIANKTRDIEITAQYQFDFGLRPSLGYVQSKGKDLNDVDANHDLLKYVSVGTYYYFNKNMSTYVDYKINLLDEDEFTIANGLNTDNVVAVGLVYQF

SEQ ID NO: 15108 - protein, 423 aa, Yersinia pestis bv. Antiqua
MLPSSGPCAPAEDIHCDRHGRTPGPFSLPKTIPMRLNLFVLAVAAAIVPAAANAATSIENWPTKYTFGDGTELGLTGNYVYDDNNFSGDDRLEDRNDFRRKEFGATIKKKGVYDAMVSYDFKSKLWLDVFYRFETKALFGQDYGRVRLGYMKVPVGLEAVQSSRAGSFMELGLPIQAVFEGRRTGAEWTLERQQYLLQAGAYGGKDLQGDNPGTTQAVHVAWTPFKAEGDVLHLGIAGSIETPRGYSDGRGVSFSPRVRLRARPEAGLTDVRLIDTSTILDVDHVIRTGLEAVWIHGPFSLQSEALRAEVARNENKPNFIAQGQYIYGTWTLTGESRSYAGGVPGNIKPMHDYGAVELTARYSRLNLEDNNVHGGRQHDTTIGANWYLTSHFKFQANYSWVDASRNGVHATPHVMELRAQVQF

SEQ ID NO: 15109 - protein, 420 aa, Yersinia pestis bv. Antiqua
MGGLRDVLGDHGVTLSLQETSEYLYNAAGGTNRGGAYQGVTQFGFTVDTEKAIGLPGGTFNVSGLQIHGTNLTQRYLQTLQTATGIEANSTTRLWELWYQQAFLDGKADVKVGQQSVDQEFMVSQYAATFMNATFGWPVLPATDLPAGGPAYPLSSLGVRLRVKPADAWTAMVGVFDGNPAGRSDGDAQSLNAHGTNFNLRSGAFVIGELQYALNAPPADPKAPQPTGLPGTYKLGFWFQSQHANDPRFGTDGLSLANPDSNGIAAAHRGNYGFYAVADQMVWRPSADSPRSVGVFARVMGSPGDRNVVDFAANAGITLKAPFAGRDNDTAGIAVGYTKIGSHARALDGDTGAYTTPGYPVRRAETVIEATYQYQVTPWWQLQADLQHFFRPGGGIPNPNAAGARIGDETVVGVRTTITF

SEQ ID NO: 15110 - protein, 1052 aa, Yersinia pestis bv. Antiqua
  misc_feature (904)..(904): Xaa can be any naturally occurring amino acid
MKSRHHLNTRLLPLSILISALIPAAVLAAPSVAIPPPVQDLINQVQSYANAHVISPEQAETLIKRLTVTPEKLKEEEARVKQELAAVEKKQKEANTEIITTSIEKDQFNKALNNKQKAKLAAETVFINANSKQNEAIKAVNKNWSLADENISTKLSVIVNGESKTQAILAEKIKLTETANINQQEQVIKAQQLDTEIQKNQSELDDAINNKTTGTIVLQEKLTQAETKLETAKNNPKSKLSLAEAKHKRTSKNLKNPKKQAKSEALRNQKDYERELKNLQTPITTATEELKVSQEKVEVLTQEKALISTKKIASDAITDNLQGEINRAQQAQLQAEQDAQQAKDATLAQQAMAKAAAAEKSLQEAEQKLAAIAVIAQEAEAKLTAAQRAKADAELQLADKMEQLANINLDLTALNNLDPKVISQQTLAKGEAQPVADGELAVATKVAGGEQNITTGGVVLASVVTEDGVVNLSDSALAHDSQLINGTLNNTRAHDVNTQVGAQGKLLINGTQEAAATSEGATVAAGGSVTAGTNTLVTKMVSAGTVTGNDGALFTETTLNDGQFSLNNGAIAKNTKVNGGQFNVNEGATAKDTEVSAGAVTGNDGALFTETTLNDGQFSLNNGAIAQNTKVNGGQFNVNEGATAEGVTVKGGEFNLRARAQAMKLTIEFGEAQIAGTLTDVTLRGGNTTLASTADVAGTIHSISGSALKVYQGAHTAQADLNLAGRVVLFADDVAPAAALPSRAVRAADNRLSAPFTFRRVNMSGGTLDLRNVKKAQLVMDSLAGNGTFKLGSMLQQDASAPVNVTGNADGDFILQIDGSGIDPTNLNVVSTGGGDARFTLTDGPIGLGNRVYNLVKDASGKVTLVANESTVTPGTASILAVANTTPVIFNAELSSVQQRLDKXSTEANESGIWGTYLHNNFAVKGRAANFDQTLNGITLGGDKATALADGVLSVGGFASASTSSIKTDYQSKGNVDSHSFGAYAQYLANNGGYVNGVVKANKFNQDIHVTSADNSASGNTNFSGMGVAVKAGKHINHNHLYVSPYVAIERL

SEQ ID NO: 15111 - protein, 182 aa, Yersinia pestis bv. Antiqua
MVFMNKILLVSSLIACLSIASVNVYAEGESSISIGYAQSRVKDDGYKLDKNPRGFNLKYRYEFNNDWGVIGSFAQTRRGFEESVDGFKLIDGDFKYYSVTAGPVFRINEYVSLYGLLGAGHGKAKVSSIFGQSESRSKTSLAYGAGLQFNPHPNFVIDASYEYSKLDDVKVGTWMLGAGYRF

SEQ ID NO: 15112 - protein, 242 aa, Helicobacter pylori
MKKFFSKPLLALVVSINALLAMDGNGVFLGAGYLQGQAQMHADINSQKQATNATIKGFDALLGYQFFFEKHFGLRLYGFFDYAHANSIRLKNPNYNSEAVQVAGQILGKQEINRLTNIADPKTFEPNMLTYGGAMDVMVNVINNGIMSLGAFGGVQLAGNSWLMATPSFEGILVEQALVSKKATSFQFLFNVGARLRILKHSSIEAGVKFPMLKKNPYITAKNLDIGFRRVYSWYVNYVFTF

SEQ ID NO: 15113 - protein, 842 aa, Helicobacter pylori
MLHKKVLLALTASLICQESLFAKEKDYTLGKVSTAGKKDRSDYSGQVNLGYSGITAPKSWQDEEVKKYTGSRTVISNKALTQQANQSIEEALQNVPGLQIRNATGVGAMPTIQIRGFGAGGSGHSDATLMLVNGIPVYMAPYAHIELDIFPVTFQAIDRIDVIKGGGSVQYGPNTYGGIVNIITKPIPNQWENQAAERITYWAKARNAGFAAPPDKTGDPSFIKSLGNNLLYNTYVRSGGMINKHVGIQAQANWVRGQGFRDNSPSNISNYWLDGVYDINENNGIKAYYQYYDFAIAQPGSLSEQDYKINRFANLRPLNQKGGRSQRFGAVYENRFGDLDKVGGTFSFTYYGQLMTRDFQVSSSYNSANMVTCFSEAACRAAGLPAGYNLAVPYYATNYNGWAEVENPVRSINNAFEPKVNLIVNTGKVKQTFIMGLRFMTTTFLQRQYLNTNECATKTSGEGAGFLCEGANVMSGWKPHIKHGVYRNWNNWRNNYTAVYLSDRIEAWDGRFFIVPGLRYAFVQYNNENASNWMQIPEKDLRKIKHMNNWMPSTNIGFIPVQGDHNVLTYFNYQRSFVPPQLDVLSYGGAEYFTQHFDTVEAGARYTYKDKFSFNADYFRIWARDFATGQYSVYTSGPMKGNVRPINGYSQGVELELYYRPIRGLQFHAAFNYIDTRVTSHGPLTDLNGDVLKGTSYNKHFPFVSPFQFILDARYNWRKTTIGISSYFYSRAYSGISNSAAGGYYGMQYYSGGNNYESVLNSGYQCEAWCMTQHEGLLPWYWVWNIQVSQIFWENGRHRVTGSLQINNIFNMKYYFTGIGSSPAGLQPAPGRSVTAYLNYTF

SEQ ID NO: 15114 - protein, 745 aa, Helicobacter pylori
MFKKIAFLLFFVSSFVYSQETIKGIVTDENNQPLLGANVFWFNTSIGTTTDENGNFSIKKPLETSSLVISYIGFETKKIEITSNTISVVLKEVKTLKEVTITKTKKGTEHSLYKVQNVQVMGQKELLKAACCNLSESFSTNPSIDVNFSDAVTGNRQIKMLGLTSPYILITEENIPSVRGASQAYGLSFVPGTWVESIQITKGAGSVINGYESISGQINYEVLKPINDIPFFLNAYGSQDGRYEINTHFNNKFSDKLSSTLFLHGNTRQNKNDMNDDGFLDGPVGKQVNVLNRWQYNDAENGIVSFLNVRYMNDEKQAGEMDFNPDTDRLTTNAWGSEINTEKIEISNKTGYVFPDMPYQSFGFQNSFQSHKQESYFGLSQYDIQQKSFYSNLLFNSIINNTKNKFTTGLNFTYDDYNEFVNVNFSRDFSRIDNSVGAFFEYTFDNTDNFSLVAGARVDNHNRLGTFITPRLHIRYNPWKEAVIRASAGRGKRAANIFAENQQLFASNRNFSILNTDGKLYGLNPEIAWNYGLSFIQKFKLAGKDAEVILDYYRTDFQNQAVVDVDNSPQDVLFYNLKGKSFANSFQAEFSIDLMTHLTFKTAYKYYDVQTQFTTGQLQRALQAKHRVFGNLAYETHIKDKGQQWKFDVTYNWLGEQRLPFTQSNPVQYRLDEYAPAFGVLNAQITRTFSSVFEVYIGGENMRNYKQKNGIVQNENPFGTYFDSSMIYGPTFGAMYYAGLRFKIK

SEQ ID NO: 15115 - protein, 1031 aa, Helicobacter pylori
MLKRLQSVSMVLFLGTLFSGTISTATASGANSFATTQQAGICKGLVKDATGESVIGASVVVKGTTNGTITDFDGNFSLDGIKKGDVIVISYVGYQTQEIKWNGSPLNVILKEDSKTLSEVVVVGYGTQKKANLSGSVAMVDSKELENRPIQNVSSGLQGLMPGVAITGTNGAPGQDAGKIRVRGIGTLNEAGPYILVDGIETGTLSAVDPNDIESISVLKDAASAAIYGSKAANGVVLITTKRGKTGQTKISYSGYLSFQNATNMIERMGSYEYASLLNQALEAEGMSKRFNDTELQKFKDGNDPLYPDTDWYDLAYKTGVQHRHNVNINGGSENVKYMASLGYLNQTGILPNTGREQFNARTNLDMKINKRLSARMNLSFIKNDYSDASSAYYGGSSDQIIRQLNLIAPWIVARYDDGTWGTISDGSPIAWLDSGMKVNRDNYNFSGMAAVDYEIFDGLKLTLQGAYVNNLQNYNYFQKYIKYNENKESDPSQLDERFYKWDRTNYDALLNYNKNFGKHNIKGLLGWHTEKYNYKYQKAVRKKFPNNELTDMNAGDASTQSNEGYTAELAMISWFARINYDFAGKYLLEANIRADASSRFAEGHRWGYFPSFSGAWRISEEAFMESAKDSWLSGLKIRASWGQLGNQDALSGSNNDYYPALNTYNLDSKYAFGGSLNSGYYQRKYRLETISWEKASTWGVGVDFTLFNKLNGSLDYYNRKTTGIIMDVTVPKEFALDAYKDNVGSMRNSGIEINLSYNTKIGQVDFGIAGNFSYNKNEILDLGGGDPNKYLDATDGYSQRNKVGEAMNSYYIYRADGFFNSQEEADAYTAKYGNPFGKTFKAGDLRYVDTNKDGKLTADDREYCGSSDPKIIYGFNINAGWKGIDLSLMFNGAAGVKRLFDGYEVYGNFSGDAAHPATIWRDAWTPDNHDASMPRIFYDTNSASSSRSVQSDFWLQDTSYLRLKNLQLGYTLPKGWLNSVGVENIRIYYSVENLLTFDKMKINIDPESTSQRLSSYPLLRTHAFGVNVTF

SEQ ID NO: 15116 - protein, 182 aa, Helicobacter pylori
MVFMNKTLLVSSLIACLSIASVNVYAEGESSISIGYAQSRVKEDGYKLDKNPRGFNLKYRYEFNNDWGVIGSFAQTRRGVEESVYGFKLIDGDFKYYSVTAGPVFRINEYVSLYGLLGAGHGKAKVSSIFGQSESRSKTSLAYGAGLQFNPHPNFVIDASYEYSKLDDVKVGTWMLGAGYRF

SEQ ID NO: 15117 - protein, 467 aa, Helicobacter pylori
MLRNFTLILVASTAVGACTLAPQYERPVLPVAQTWSTPAPEAATTVSAADLDWRQVLVDPRLQGVVDLALQQNRDLRVAVLNIEKARAQYGVQRSALFPGVSGAVSEQRGRTPASTSPTGQPFETDVFNATIGFTAYELDLFGRVRSLKDAALQSYLATEQTSRSVRVSLIAEIANAWLTLAADQERLALAKTTLATREDSLRLVRQRVDGGAGSLLDLRNAETLAETARADVAVYTAQVAQDRNALTLLAGGDLPVDLLPPGRLDADSVLADLPAGLPSDVLARRPDVLAAERQLQAANANIGAARAAFFPRISLTGSAGSASTDLDGLFKSGTSIWSFTPQISLPIFAGGANVANLNISKADRDIAVATYEKTVQTAFREVSDALSVRATVADRLTAQERLTAAAADSTRLSQQRRDAGLDSALTLLDAQRSLYTAQQGLISARLAQATNLVTLYKTLGGGAPAT

SEQ ID NO: 15118 - protein, 211 aa, Helicobacter pylori
MKFFSKDLFKKVTPLFLSVYFLNPTIMQAKSRFYVASQYQVGKMIMKKYNDLKRTIEGASFSLGWEINPTNYWFYSRYYFFMDYGNVILNKRTGAQANMFTYGFGGDLIVEYNKNPLYVFSLFYGMQVAENTWTISKHSANFIIDDWRSIQGFSLKTSNFRMLGLVGFKFQTVLFHHDASIEVGIKWPFAFEYNSAFVRLFSVFISHTFYL

SEQ ID NO: 15119 - protein, 740 aa, Helicobacter pylori
MLKLASKTICLSLIGSFTALEAYQKHQKDGFFIEAGFETGLLQGTQTKEQTIATTQEKPKPKPITPQSTYGKYYISQSTILKNATELFAENNITNLTFYSLTPVYVTAYNQESAEEAGYGNNSLIMIQNFLPYNLNNIELSYKDDQGNVVSLGVIETIPKQSQIILPASLFNDPQLNADGFQQLQTTTTRFSDASTQNLFDKLSKVTTNLQMTYINYNQFSSGNGSGSKPPCPPYENQENCVAKVPPFTSQDAKNLTNLMLNMMAVFDSKSWEDAVKNAPFQFSDNNLSAPCYSDYLTCVNPYNDGLVDPKLIAKNAGDEYNIENGQTGSVILTPQDVIYSYRVANNIYVNLLPPRGGDLGLGSQYGGPNGPGDDGINYGALGILSPFLDPEVLFGKDLNKVAIMQLRDIIHEYGHTLGYTHNGNMTYQRVRMCEEGNGPEERCKGGRIEQVDGKEVQVFDNGHEVRDTDGSTYDVCSRFKDKPYTAGSYPNSIYTDCSQVPAGVIGVTSAVWQQLIDQNALPVDYTNLSSQTNYLNASLNTQDFATTMLSAISQSLSSTRSSATTYRTSKTSRPFGAPLLGVNLKMGYQKYFNDYLGLSSYGIIKYNYAQANNEKIQQLSYGVGMDVLFDFITNYTNEKNPKNNLTKKVFTSSLGVFGGLRGLYNSYYLLNQYKGSGNLNVTGGLNYRYRHSKYSVGISVPLVQLKSRVVSSDGATTNSITLNEGGSHFKVFFNYGWVF

SEQ ID NO: 15120 - protein, 1294 aa, Helicobacter pylori
MQVTNHTHLVRCALTLASALCLTAGAARAQTAAPPASSAAEGEDDQLVVLSPFEVSASDDRGYAAAHTLAGNRLNTDLRDIGNAVTVITSQLLKDVQATNNETLLQYTAGTEVGSIRGNFAGLGDGAVLNEADRFTRPNANTRVRGLAAADNTRDFFLSDIPWDSFNLDRVDLQRGPNSILFGLGSPAGLLNAGLKQAGFRDTNEVGVRVDNWGSVRWVGNFNKVILPNELAARVDVLHEKNQFQQEPAFEDNRRAYGAFRYEPNFLKKGSARTILKANFENGNVRSNRPRSLPPLDRITPWFYTGTYNGVYKGTGQAIIDGVSTPVTFGQTRVFNNLNRETFNPFQLQDDNTGRPNHGQVRPVINGGPDAGKFNPGYNPWVGNFANQFSGIDSFYVNGGAALPGSNVVWEDYKTRGISSTGAIDGSLGRSFQRPGGVATYDAFATNAGLPYYQYGLYKAVSLTDPTVFDFYNNLIDGPNKDEWNDWNAYNVSLAQTFMDDTFGFEANVQHEDFKRGQLALLTGSQQAIFIDINSVYNDGTPAGKNGEPFLDGTPNPNVGRPFISDSGQGGNTEYVSRRDALRLTGFFSHDFNRNGHKNLLTRILGKHILTGLYSKDKQETDNRTWARYSARDPNYLNFIGRTNFRFNAPDVSVNRIIYLGDSLSGRNTAAGSNIPRATARVEVPATLNVRTFDSTWTATNVNPADYWANEYYPNIPPFNLFDNPATTANERGAYNSFQSENPANYRGFVNIPVNIVDSEWGPNYRALLTTDAQRNKTEVTSKALVWQSYWWDKSIIGTLGYREDTAKAWGKSLTAGNTPVPGYLDLDKNGGYALPSDPINTIKAISRSYSVVTHVNDLPYLSKMLERLPIDITLFYNSSSNFQPDARRVDVYGEPLSPPSGKTIDRGILLETKDGKYSLKINKFITTLKDASSSTLGNSGFIGTSQQYGGNWANQFEYDLAIDNQSYIISHQANNRPAGAANPPGYTSTFIPGNPDFDPTNTLYNYGTDIGETIDQAQSREKAAVDAWRVWQKQVDPRFYAAWGINLNDLTKPIAAAQPQGFTVTEDSESHGYEIEFNANPTRNWRLTFNATQVNATRSNVGGANLREFITAYEKAIRTTAAGDLRIWWGGAGNDTTLRQWFNSVGSNWAQKALSEGTKASELREWRFNAITNYAFDEGALKGFNVGGGVRWQGKNALGNRPVGDPLGSDIAFDLANPYYGPAEAYFDLWVGYRRRLPRKVFSQDIEWNVQLNVMNVGKGNELIPVTVQPDGTPATYRISPHQQITLTNSFAF

SEQ ID NO: 15121 - protein, 658 aa, Helicobacter pylori
MKKSLFALSLSLIASLSRAEDDGFYTSVGYQIGEAVQQVKNTGALQNLADKYDNLSNLLNQYNYLNSLVNLASTPSAITGAIGNLSSSAINLTSATTTSPAYQAVALALNAAVGMWQVIAFGISCGPGPNLGPEHLENGGVRSFDNTPNYSYNTGSGTTTTTCNGASNVGPNGILSSSEYQVLNTAYQTIQTALNQNQGGGMPALNSSKNMVVNINQTFTRNPTTEYTYPDGNGNYYSGGLSTSIQLKISSVNDAENLLQQAATIINVLTTQNPHVNGGGGAWGFSGQTGTVMDIFGDSFNAINEMIKNAQTALEKTKQLNANENTQITQPDNFNPYTSEDKGFAKEMLNRANAQAEILSLAQQVADNFHSIQGPIQQDLEECTAGSAGVINDNTYGSGCAFVKETLNSLEQHTAYYGNQVNQDRALAQTILNFKEALNTLNKDSTAINSGISNLPNAKSLQNMTHATQNPNFPEGLLTYSLDTNKYSQLQTITQELGKNPFRRFGVIDYQNNNGAMNGIGVQVGYKQFFGKKRNWGLRYYGFFDYNHAYIKSSFFNSASDVWTYGVGMDALYNFINDKNTNFLGKNNKLSVGLFGGFALAGTSWLNSQQVNLTMMNGIYNANVSASNFQFLFDLGLRMNLARPKKKTAITPLSMALN

SEQ ID NO: 15122 - protein, 742 aa, Helicobacter pylori
MKKTLLLSLSLSFLLHAEDDGFYTSVGYQIGEAAQMVTNTKGIQQLSDNYEKLNNLLTRYSTLNTLIKLSADPSAINAVRENLGASAKNLIGDKANSPAYQAVLLAINAAVGFWNVVGYVTQCGGNMNGQESTSSTTIFNNEPGHRSASITCSLNGYKPGYYGPMSIENFKKLNEAYQILQTALKQGLPALKENNGTLKEVTYTYTCSGKGNNNCSEQATGINRQNGGSKTTIQTIDGKTVRTTISLKVVDSTASGNTSHVSYTEITNKLDGVPDSAQALLAQASTLINTINEACPYFHANNSSEANAPKFSTTSGKICGAFSEEISAIQKMITDAQELVNQTSVINEHEQSTPIGNNNGKPFNPYTDASFAQGMLANAQAQAKMLNLAEQVGQAINPERLSGAFKNFVTGFLATCNNPSTAGTSGTQGSAPGTVTTQTFASGCAYVEQTITNLTNSITHFGTQEQQIQQAENIADTLVNFKSRYSELGNTYNSITTALSSIPNAQSLQNAVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKDSDHAAQHGIELGLKIPTINTNYYSFMGAELKYRRLYSVYLNYVFAY

SEQ ID NO: 15123 - protein, 640 aa, Helicobacter pylori
MKKTKKTILLSLTLASSLLHAEDNGVFLSVGYQIGEAVQKVKNADKVQKLSDAYEQLSRLLTNDNGTNSKTSAQAINQAVNNLNERAKTLAGGTTNSPAYQATLLALRSVLGLWNSMGYAVICGGYTKSPGENNQKNFHYTDENGNGTTINCGGSTNSNGTHSSNGTNMLKADKNVSLSIEQYEKIHESYQILSKALKQAGLAPLNSKGEKLEAHVTTSKYQQDNQTKTTTSVIDTTNDAQNLLTQAQTIVNTLKDYCPMLIAKSSSGSGSGATTNTPSWQAAGGGKNSCETFGAEFSAASDMINNAQKIVQETQQLNANQPKNITQPHNLNLNTPSSLTALAQKMLKNAQSQAEILKLANQVESDFNKLSSGHLKDYIGKCDASAISSANMTMQNQKNNWGNGCAGVEETQSLLKTSAADFNNQTPQINQAETLANAIVQELGHNPFKRVGIISSQTNNGAMNGLGVQAGYKQFFGEKKRWGLRYYGFFDYNHAYIKSNFFNSASDVWTYGVGSDLLFNFINDKNTNFLGKNNKISVGLFGGIALAGTSWLNSQFVNLKTISNVYSAKVNTANFQFLFNLGLRTNLARPKKKDSHHAAQHGMELGVKIPTITTNYYSFLDTKLEYRRLYSVYLNYVFAY

SEQ ID NO: 15124 - protein, 1237 aa, Helicobacter pylori
MIKKAKKFIPFFLIGSLLAEDNGWYMSVGYQIGGTQQFINNKQLLENQNIINSITQSAINIAGPTTGLITLSSQTVIDALGYGVSNTVGNQLEGISNILNQIGKRKDFYSSRQISSISQQIIGLKGSSDPLKAHSSQITAKLLSNTQSAFDQGIALSSNIISAVNSLNPSNNSQEVKAQLQNTAQSMAELLQQIEHSITKTTSTTYAQSLLSNLTDAVNASSNNTTYVSALVNALNTLGVGVFPTTTSTHVVLNPPGQVVFYPTNSLLGSTSSNSNNQQQYNNTLLMNTLQGELSTNNQNNPNGCANQIQCLEQFIQNLTPLAATPTSTNQANQQVQAIAQKLQSVAINALDNNAINNTTYNLNNLHNALNFQAYQSTIEQYNNALKQISWISFSEPKNLLKNTSNNYQIGTVTNDQGQNISAYDCTSATGSLSSDASSGISCSATSSTNNTNSFDNSLVATSKVQTINGKEQIGVNSFNLVSQVWSVYNSLKTSEENLQKNAKILCNNGSQSGTSPCNSSSGGLSISGNAQLQNILSPTNGTTTNTQAKSNASKLKAMVMVNNEEEAKTTNFNQSSGPTTQSSNSTVMGALNTVLQNVSNFQQSIQSAFQNQENNIQAWANALYNTSNPNGNQSQNLTTNNNQDLRIQLRANFYQLINTINQQVPTDMNALINQSQQTQQTSGSASTTNNACASGMGSSGNWCYQQWSDSKAYYSGLQSALGYQTQATTQNGSSGGSNITYNVQQITLTSGGLLNQIITNLKSVNGGSNGGSSGNGTSQINTAYQMLTDASDGKLGTYNSSNSSNSSNSGNNNGYTPCNSTNGSNGTSGSNCYEPNKQQNATTATTTTDSNLQKVYNDAQKIANIIASSGNNKGVENGLKQFFEALKSNSSSLSNLCGNGSSGSSSTCSGGLINLLGAIPTNGVSDTNNLINLLTEFIKTAGFIQNKDSNVSTSLTSAFQAITSAISQGFQALQNDISPNAILTLLQEITSNTTTIQSFSQTLRQLLGDKTFFMVQQKLIDAMINARNQVQNAQNQANNYGSQPVLSQYAAAKSTQHGMSNGLGVGIGYKYFFGKARKLGLRHYFFFDYGFSEIGLANQSVKANIFAYGVGTDFLWNLFRRTYNTKALNFGLFAGVQLGGATWLSSLRQQIIDNWGNANDIHSTNFQVALNFGVRTNFAEFKRFAKKFHNQGVISQKSVEFGIKVPLINQAYLNSAGADVSYRRLYTFYINYIMGF

SEQ ID NO: 15125 - protein, 694 aa, Helicobacter pylori
MQNFIFNKKWLIYSSLLPLFFLNPLAAEDDGFFMGVSYQTSLAVQRVDNSGLNASQDASTYIRQNAIALESAAVPLAYYLEAMGQQTRVLMQMLCPDPSKRCLLYAGGYQQNAQNGDTGNNPQRGNVNATFDMQSLVNNLNKLTQLIGETLIRNPENLSNAKVFNVKFGNQSTVIALPEGLANTMNALNDDITNALTTLWYNQTLTNKSFNSGNSVNFSPEVLQHLLQDGLATANNNQTICSTQNQCTATNEAKSIAQNAQNIFQALMQAGILGGLANEKQFGFTYNKAPNGSDSQQGYQSFSGPGYYTKNGNTTQAPLKALPAGATIGSGNGQYTYHPSSAVYYLADSIIVNGITASMIFSGMQNFANKAAKLTGTSSYSQMQDAINYGESLLNNTVSYGNFITNWVAPYLDLNNKGLNFLPNYGGQLNGANHQTPQLTPQQAQQEQKVIINQLEQATNAPTPAQINRILANPYSPTAKTLMAYGLYRSKAVIGGVIDEMQTKVNQVYQMGFARNFLEHNSNSNNMNGFGVKMGYKQFFGKKRMFGLRYYGFYDFGYAQFGSNPSLVKATLSSYGAGTDFLYNVFTRKRGTEAIDIGFFAGIQLAGQTWKTNFLDQVDGNHLKPKDTSFQFLFDLGIRTNFSKIAHQKRSRFSQGVEFGLKIPVLYHTYYQSEGVTAKYRRAFSFYVGYNIGF

SEQ ID NO: 15126 - protein, 277 aa, Helicobacter pylori
MKRALWLILGLFYALNAESFKDVLTKGDYTFFNKKVVSPIKRYADRSAFYLGLGYQLGSIQHNSSNLNLSQRFNKSQIIFSDSLSPVFKNSYVSNGLGVQVGYKWVGKHEETKWFGFRWGLFYDLSASLYGSQESQSIIISTYGTYMDLLLNAYNGDKFFAGFNLGIAFAGVYDRLSDALLYQTLLQNTFGGKVNLNGFQFLVDLGVRLGNEHNQFGFGIKIPTYYFNHYYSMNNISNNSENVLKVLRFLEYGINSLLYQVDFRRNYSVYFNYTYSF

SEQ ID NO: 15127 - protein, 184 aa, Helicobacter pylori
MEQAWSYGASALDVALYDRVDVVRGATGLLTGSGNPSASINLVRKHAVSRDFTGTVSVGGGDFNKTRGVADVTVPLRPEGTARARVVGVYRDGESDMERYSLRKKIGSAIVDFSTREVIGIGHRHLARDVCVFCVPDSERIAAIAQEVRRLFFCANTASRVHAVFALRQRAVSTEQPPCGTVVI

SEQ ID NO: 15128 - protein, 700 aa, Helicobacter pylori
MLRFVSKTICLSLIGLFNPLEAFQKHQKDGFFIEAGFETGLLEGTQTKEEVITTQKIYENPLTHPQTKEQPKEQNKSDTATPQSAYGKYYIPQSTILKNATALFTTDKIENGLTFYSQNPVYANMVNGSVTIQNFLPYNLNNVELSFKDAQGKVVNLGVIETIPKQSQITLPASLFNDSEFEQADSFNYQQLQATATQFSDANTQSLFQKLSKITTNVTMSYENADTNNFKGNCHDCVSDFTPQTAEELTNLMLDMIAVFDSKSWEEAVLNAPFQFSNSSSECGSDFPKCVNPFNNGRVAPIYEKYVLTPQSVIDAFRRTINLEVNILKSGFVGLGYELDDNDGNLGIEASALNPEKLFGKTLNKVDIVELRDIIHEFSHTKGYTHNGNMTYQRVRLCQENGGAIQECEGGKEELVNGKEELKFTNGKEVKDQDGYTYDVCSFYKDNHQVYTASNYPNSIYTNCAQVPAGLIGVTTAVWQQLINQNALPINFANLNSPTNHLNAGLNAQNFATSIVSAIAQNFSTTSTTTYRSSSKNFRSPILGVNVKIGYQHYFNDYIGLAYYGIIKYNYAKTNDEKIQQLSYGGGMDVLFDFITTYANKKQDNPTKKVFASSFGVFGGLRGLYNSYYVFNQVKGSGNLDIVTGFNYRYKHSKYSVGISVPLIQSGIKIASNNGIYANSVVLNEGGSHFKVFFNYGWIF

SEQ ID NO: 15129 - protein, 514 aa, Helicobacter pylori
MRQEKYFLTSSLSLLSFLLCPAEAFDYRFSGRVENFSKIGFNNSQINTKKGIYPTESFIDIVTLAQVKVNLLPKGTENHRLSVSLGGAIAAIPYDKTKYDINQANGKIFGSIVENFIGGYHGYFFNKYLGPAYAGTSQSASYHARPYVVDTAFLRYDYKDVFGFKAGRYEANIDFMSGSNQGWEVYYQPYKTETQRLRFWWWSSFGRGLAFNSWIYEFFATVPYLKKGGNPNNSNDFINYGWHGITTTYSYKGLDAQFFYYFAPKTYNAPGFKLVYDTNRNFQNVGFRSQSMIMTTFPLYYRGWYNPETNTYSLEDSTPHGSLLGRNGVTLNIRQVFWWDNFNWSIGFYNTFGNSDAFLGSHTMPRGNNTSYIGSEISITTRHAGMIGYDFWDNTAYDGLADAITNANTFTFYTSVGGIHKRFAWHVFGRVSHANKNALGQVGRANEYSLQFNASYAFTESILLNFRITYYGARINKGYQAGYFGAPKFNNPDGDFSANYQDRSYMMTNLTLKF

SEQ ID NO: 15130 - protein, 367 aa, Helicobacter pylori
MQKALLHSSFFLPLFLSYCIAEENGAYASVGFEYSISHAVEHNDPFLNQERIQTISNAQNKIYKLNQVKNEITNMQKTFNYINNALKNNSKLTPTEMQAEQYYLQSTLQNIEKIVTLSGGVASNPQLAQALEKMQEPITNPLELAERLKNLELQFAQSQNRMLSSLSSQIAAISNSLNALDPNSYSKNVSSMYGVSLSVGYKHFFTKKKNQGLRYYLFYDYGYTNFGFVGNGFDGLGKMNNHLYGLGIDYLYNFIDNAKKHSSVGFYAGFALAGSSWVGSGLGMWVSQMGFINNYLTDYQAKMHTSFFQIPLNFGVRVNVNRHNGFEMGLKIPLAVNSFYETHGKGLNASLFFKRLVMFNVSYVYSF

SEQ ID NO: 15131 - protein, 2506 aa, Helicobacter pylori
MAFKKARLISRFISKGSFKLNKISKKIFKLNQILKREKPLKRHKKALKPIKKLSDRNKSFLKVSVLLIGALGGLSHLRANECRYWSWSSWSYQDNIESGPNSPTHNSYCLFSSTQGSGTYYLNTLTTYSAGGASFTQKFNGGTLNVGGNIRFGGAGINGGDVGYITGTYDAQTINFNSSHLTTGNSYADGGGATLNFNATNNLTINQASFDNSDAGTQHSYMNFKGSNIKVSGSRFKDDTNGGFNFSGNNNNSAISFNQTNFNQGTYHFNSAQSTFENSNFNQGTYNFNGNASFDNDTFNQGTYNFNTSKVSFSGINTLNSSSPFASLKGSVSFNSNAVFNLNQTLNNNQTYDILTTNGAIQYGVYQSYLWDLINYKGDKAISHVGVGNNTYDVTFDINGQDETLQETFNKQSIITQFLGDDLQQQAQKTYQEDLTHSQNALNNVTSDNTIANNDTSYTQSKNATIAKDAQGLENTNQKIAQDEQALEKDLAQIKQLANSTTGFSEQAFTQAQKQEQQDEQTLQNEEKTFNSEQEGLKQAIQQAQAQQQKQEQQQAQQTYQQDLSNSQSALNNAASDSKIANSDTDYTKNKNTAIATDAQNLENTNQQIAQDEQALEKDLAQIKQLANSTTGFSEQAFNQAQSTEQQDEQTLQNEEKTFNAEQEGLKQALANAKPTSPTPSPTPTPTKHTAPNTPPNKVSPTPPTQNLPTTNVWNGVYNLQNQTYSNKGIYYIDPNLSGQSGQSGNTLSTYTANLFGRSFSVNIQNGTLIIGNNTESVNDNGLIWIGHGGFGYITGTFNAANIYLTNNFKTGEGVSNSDGGGANITFKASDNITMDGLNYNDAETVTKMIQTRASQHSYATFDALNNISVTNSSFSDMTWGKFSFSAKNISFSNASFSGFTNPGGSSVISANAANSLSFINSRLNGGAIYNLQANSLIFNNTQAVFNVLYSRGTSNFNATTQLLGNTNFTLSSQSLLNFNGDTTLQNNANITLGNKSQADFKNSLTLDNNSNLSLDNQSVLNANNTSAFNNQASLNIYNGSQATFSSLFFNGGTLSLNASSKLNASNASFSNNTTINLDDSVLSANNTSSLNANINFQGASQADFGGNTTIDTASFNFDSASSLNFNNLTANGALNFNGYAPSLAKALMSVSGQFVLGNNGDINLSDINIFDNITKSVTYNILNAQKGITGISGANGYEKILFYGMKIQNATYSDNNNIQTWSFINPLNSSQIIQESIKNGDLTIEVLNNPNSASNTIFNIAPELYNYQASKQNPTGYSYDYSDNQAGTYYLTSNIKGLFTPKGSQTPQTPGTYSPFNQPLNSLNIYNKGFSSENLKTLLGILSQNSVALKEMIESNQLDNITNINEVLQLLDKIKITQTQKQVLLETINHLTDNINQTFNNGNLIIGATQDNVTNSTSSIWFGGNGYSSPCALDSATCSSFRNTYLGQLLGSTSPYLGYINADFKAKSIYITGTLGSGNAFESGGSADVTFQSANNLVLNKANIEAQATDNIFNLLGQEGIDKIFNQGNLANVLSQVAMEKIKQAGGLGNFIENALSPLSKELPASLQDETLGQLIGQNNLDDLLNNSGIMNAIQNIISKKLSIFGNFVTPSIIENYLAKQSLKSMLDDKGLLNFIGGYIDASELSSILSVILKDITNPPTSLQKDIGVVANDLLNEFLGQDVVKKLESQGLVNSIINNIISQGGLSGVYNQGLGSVLPPSLQNALKGNDLGALLSPRGLHDFWQKGYFNFLSNGYVFVNNSSFSNATGGSLNFVANKSIIFNGDNTIDFSKYQGALIFASNGVSNINITTLNATNGLSLNAGLNNVSVQKGEICVNLANCPTTKNSSSTNSSVTPTNESLSVHANNFTFLGAITSNGAIDLSQVKNNSVIGTLNLNENATLQANNLTITNAFNNASNSTANINGNFTLNQQATLSTNASGLNVMGNFNSYGDLVFNLIHSVSHAIINAQGNATIMANNNNPLIQFNTSSKEVGTYTLIDSAKAIYYGYNDQITGGSSLDNYLKLYVLIDINGKHMVMTDNGLTYNGQAVNIKDGGLVVGFKDSQNQYIYTSILYNKVKIAVSNDPINNLQAPTLKQYIAQIQGVQSVDSIDQVGGNQAINWLNKIFETKGSPLFAPYYLESHSAKDLTTIAGDIANTLEVIANPDFKNDATNILQINTYTQQMSRLAKLSDTSTFASADFHERLEALKNKRFADAIPNAMDVILKYSQRNRVKNNVWATGVGGASFINGGTGTLYGINVGYDRFIKGVIVGGYAAYGYSGFHGNITQSGSSNVNMGVYSRAFIKRSELTMSLNETWGYNKTFINSYDPLLSIINQSYKYDTWTTDAKINYGYDFMFKDKSVIFKPQIGLAYYYIGLSGLRGIMDDPIYNQFRANADPNKKSVLTINFALESRHYFNKNSYYFVIADVGRDLFINSMGDKMVRFIGNNTLSYRDGGRYNTFASIITGGEIRLFKTFYVNAGIGARFGLDYKDINITGNIGMRYAF

SEQ ID NO: 15132 - protein, 815 aa, Helicobacter pylori
MNDKRFRKYCSFSIFLSLLGTFELEAKEEEKEEKKTERNKDKEKNAQHTLGKVTTQAAKIFNYNNQTTISSKELERRQANQISDMFRRNPNINVGGGAVIAQKIYVRGIEDRLARVTVDGVAQMGASYGHQGNTIIDPGMLKSVVVTKGAAQASAGPMALIGAIKMETRSASDFIPKGKDYAISGAATFLTNFGDRETIMGAYRNHHFDALLYYTHQNIFYYRDGDNAMKNLFDPKADNKVTASPSEQNNVMAKINGYLSERDTLTLSYNMTRDNANRPLRANFTGTFLPYSCGDFNAFPNEKNPSDCLFENDASLFKTYSVNLVHNVSLNYEREGGSRFGDPKLKINGYTSIRNVQIDPLFRPSDIATTIPFTPNPQLSQGEENQCVAQGGIYDALKQTCSITFKSLGGGSVVANKNLFIINSGFNANVIHTIDHKNDNLLEYGLNYQNLTTFDKAIPDSELVKPGDAPDACLRVTGPDDPNMNGRCQRNGATANVVGVYAQANYTLHPMVTLGAGTRYDVYTLVDKDWQLHVTQGFSPSAALNVSPLENLNFRLSYAYVTRGPMPGGLVWMRQDNLRYNRNLKPEIGQNAEFNTEYSSQYFDFRAAGFVQLISNYINQFSSTLFVTNLPAQDIIYVPGYEVSGTAKYKGFSLGLSVARSWPSLKGRLIADVYELAATTGNVFILTASYTIPRTGLSITWLSRFVTNLSYCSYSPYRNGPTDIDRRPSNCPKTPGIFHVHKPGYGVSSFFITYKPTYKKLKGLSLNAVFNNVFNQQYIDQASPVMSPDEPNQDKYARGMAEPGFNARFEISYKF

SEQ ID NO: 15133 - protein, 1043 aa, Helicobacter pylori
MKQNKLYDCLCVFKFLFKKGIFLLAVVLAPLVSAQAQESKTITGTVLSSNGNMPIPGVNVLVEGTTTGAVTDFDGNFSIQASANDVLVFTYLGFQEQRITVGDQTSLTVTLEEALSNLDEVVVVGYGTQRKSDLTGAVSVVDTEEMTKQASNDVTQMMQGRVAGVTITSDGQPGAAPSVRIRGVATFGIGASAEPLYVVDGVPVDGIRDVNPNDIESIQVLKDASAGAIYGNRAGNGVIIITTKGGKKGQKLTFNLSSYYGVQNITQKLPLLDREGYQTINRELINNGNAQLPAGAALTPIPLGNDPNSPSFIDDINTDWQDEGYTSGFIQNHNLNAAGGTENTTYFVSLDYLDNQGTLVGQGPNYTRYSFRVNTEAEVGKFTIGENMFFVRSDENPLFNTASINLPGGRPTLVNDLLQAAPTIPLRDPNRLGGFGGADATVHQSITLNVPGINTLVENESKVNRLNANLYLQFEPIEGLALKSSASYNTTNIEGQLFVPEYDLGYFFPNPLAQLRVVNTNIDRFLIENTINFNKEFDKHNLSVLVGQTYQKDNFRAITTVGGGLTAPYIKNLENATDFSVFDNIQESALYSYLGRVNYSFDDKYFFTGNIRYDGSSRFNPDVRYEFFPSVSAAWKIHNEFELPDFITSLKLRGGWGEVGNQEIGNYLFQRTVNRGIPYQFSGGPTVIGSAVTQLIDEDIRWETRRTSSIGLDASLFNGGLDFTAEYYRNTSEDVLVNIPVPFTNIVGAFNSEILSNAGSIRNSGIELSAVYRQFIGDDFSFEIAPNFYTVKNEILDIGNQDFISGTGSRNIVGRSLGEHYGWVYDGIFQTNDEIANSPTQQPGTRPGDIKFRDISGPDGTPDGVINDADRTFLGQGLPTYYYGINITARYKNFDFTIFGQGSGGNLINSNLYRGLMPTSGYTNWHEDILNRWTPDNTNTTVPRVVFGDPNQNGRNSNRPGWLQDGDYFRINTISLGYSLPNDFISKISMSSARFYVTLQNVAVLSKYKGYNPDFQAGVLNPGFDFGTYPRPMTTMLGVQLKF

SEQ ID NO: 15134 - protein, 520 aa, Helicobacter pylori
MIKKNRTLFLSLALCASISYAEDDGGFFTVGYQLGQVMQDVQNPGGAKSDELARELNADVTNNILNNNTGGNVAGALSNAFSQYLYSLLGAYPTKLNGNDVSANALLSGAVGSGTCAAAGTAGGTTLNTQSACTAAGYYWLPSLTDRILSTIGSQTNYGTNTNFPNMQQQLTYLNAGNVFFNAMNKALEKNGTATANSTSSTSGATGSDGQTYSQQAIQYLQGQQNILNNAANLLKQDELLLEAFNSAVAANIGNKEFNSAAFTGLVQGIIDQSQLVYNELTKNTISGSAVNNAGINSNQANAVQGRASQLPNALYNVQVTLDKINALNNQVRSMPYLPQFRAGNSRATNILNGFYTKVGYKQFFGKKRNIGLRYYGFFSYNGASVGFRSTQNNVGLYTYGVGTDVLYNIFSRSYQNRSVDMGFFSGIQLAGETFQSTLRDDPNVKLHGKINNTHFQFLFDFGMRMNFGKLDGKSNRHNQHTVEFGVVVPTIYNTYYKSAGTTVKYFRPYSVYWSYGYSF

SEQ ID NO: 15135 - protein, 736 aa, Helicobacter pylori
MKKHILSLTLGSLLVSTLSAEDDGFYMSAGYQIGEAAQMVKNTKGIQDLSDRYESLNNLLTRYSTLNTLIKLSTDPSAINGVRNDLGASAKNLIGDKTNSPAYQAVLLAINAAVGFWNVVGYVTQCGGNANGTKSASSTTIFNNEPGYRSTSITCSLNGYNPGYYGPMSIENFKKLNEAYQILQTALKNGLPALKENNGTVSVTYTYTCSGEGNDNCDALKDNRNGGSKTETQTIDGKSVTTTISSKVVKPSNGAAYTEITNQLNGVPDSAQALLAQASTLINTINEACPYFQAPHNQSNGPKWEWPSNKLCGAFSQEISAIQKMITDAQELVNQTSAITSNEQSTQVGANNNGKPFNPFTDASFAQGMLANAKAQAEMLNLAEQVGQAINPERLSGTFKNFVTGFLATCNNPSTAGTGGTQGSSPGTVTTQTFASGCAYVEQTLTNLNNDIAHFGTRAQQIQQAADIADTLVNFKSRYNELGNTYNSITTALSNIPNAQSLQNAVSKKNNPYSPQGIETNYYLNQNTYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKDSDHVAQHGIELGLKIPTINTNYYSFMGAELKYRRLYSVYLNYVFAY

SEQ ID NO: 15136 - protein, 1294 aa, Helicobacter pylori
MEIQQTHRKMNRPLVSLVLAGALISAIPQESHAAFFTTVIIPAIVGGIATGTAVGTVSGLLSWGLKQAEEANKNPDKPDKVWRIQAGKGFNEFPNKEYDLYKSLLSSKIDGGWDWGNAARHYWVKGGQWNKLEVDMKDAVGTYKLSGLRNFTGGDLDVNMQKATLRLGQFNGNSFTSYKDAADRTTRVNFNAKNISIDNFVEINNRVGSGAGRKASSTVLTLQASEGITSDKNAEISLYDGATLNLASSSVKLMGNVWMGRLQYVGAYLAPSYSTINTSKVTGEVNFNHLTVGDKNAAQAGIIASNKTHIGTLDLWQSAGLNIIAPPEGGYKDKPNNTPSQSGTKNDKNESAKNDKQESSQNNSNTQVINPPNSTQKTEIQPTQVIDGPFAGGKDTVVNINRINTNADGTIRVGGFKASLTTNAAHLHIGKGGVNLSNQASGRTLLVENLTGNITVDGPLRVNNQVGGYALAGSSANFEFKAGVDTKNGTATFNNDISLGRFVNLKVDAHTANFKGIDTGNGGFNTLDFSGVTDKVNINKLITASTNVAVKNFNINELIVKTNGISVGEYTHFSEDIGSQSRINTVRLETGTRSIFSGGVKFKSGEKLVIDEFYYSPWNYFDARNVKNVEITRKFASSTPENPWGTSKLMFNNLTLGQNAVMDYSQFSNLTIQGDFINNQGTINYLVRGGKVATLSVGNAAAMMFNNDIDSATGFYKPLIKINSAQDLIKNTEHVLLKAKIIGYGNVSTGTNSISNVNLEEQFKERLALYNNNNRMDTCVVRNTDDIKACGMAIGNQSMVNNPDNYKYLIGKAWKNIGISKTANGSKISVYYLGNSTPTENGGNTTNLPTNTTNNARSANYALVKNAPFAHSATPNLVAINQHDFGTIESVFELANRSKDIDTLYTHSGVQGRDLLQTLLIDSHDAGYARQMIDNTSTGEITKQLNAATDALNNIASLEHKTSGLQTLSLSNAMILNSRLVNLSRKHTNHIDSFAQRLQALKGQRFASLESAAEVLYQFAPKYEKPTNVWANAIGGASLNNGGNASLYGTSAGVDAYLNGEVEAIVGGFGSYGYSSFSNRANSLNSGANNANFGVYSRIFANQHEFDFEAQGALGSDQSSLNFKSALLQDLNQSYHYLAYSAATRASYGYDFAFFRNALVLKPSVGVSYNHLGSTNFKSSSNQVALKNGSSSQHLFNANANVEARYYYGDTSYFYMNAGVLQEFARFGSNNAASLNTFKVNTARNPLNTHARVMMGGELQLAKEVFLNLGVVYLHNLISNIGHFASNLGMRYSF

SEQ ID NO: 15137 - protein, 791 aa, Helicobacter pylori
MFLRSYPKLRYALCFPLLADTCYSEERTLNKVTTQAKRIFTYNNEFKVTSKELDQRQSNEVKDLFRTNPDVNVGGGSVMGQKIYVRGIEDRLLRVTVDGAAQNGNIYHHQGNTVIDPGMLKSVEVTKGSANASAGPGAIAGVIKMETKGAADFIPRGKNYAASGAVSFYTNFGDRETFRSAYQNAHFDIIAYYTHQNIFYYRSGATAMKNLFNPTQADKEPGTPSEQNNALVKMNGYLSDRDTLTFSWNMTRDNATRPLRSNAIGLAYPCEAPFSPDSDQGCPNVLDSFTRYMYHSINSANNLSLQYKREAGNSFGDPRLDFTLYTSIRNAKFDPLFDPNGVYAKFPTSQASAWEKENYPCVEGGYCTPSFSDVDKPSSQPRDLFLNNTGLNLKIAHVIDEATDSLFEYGFNYQNLSVFDARIPKSELYRPNQVYTDDKGQKQIACSLVDNNPNDPTLCQRGKANGNIYGGYVQANYSPHKIITFGAGVRWDAYTLYDKDWNHRYTQGFSPSAALVISPIEPLSLKITYSQVTRGVMPGDGVYMRQNDLRYAKNIKPEVGSNAEFNIDYSSQYFSGRAAAFYQALDNFISQYAQSLIVTNLSQAIRIYGYEVGGTFKYKGVSLNVGISRTWPTTRGYLMADSYELAASTGNVFIIKLDYTIPKTGINLAWLSRFVTGLDYCGFDIYLPDYGTAEKPKTPTDLAKCGSQLGLVHMHKPGYGVSNFYINWSPKTKSRWKGLLLSAVFNNVFNKFYVDQTSPYVMSPDMPGTDAIKRAIAEPGFNARFEVAYKW

SEQ ID NO: 15138 - protein, 587 aa, Helicobacter pylori
MKNFSPLCCFKKLKKRHLIALSLPLLSYANGFKIQEQSLNGTALGSAYVAGARGADASFYNPANMGFTNDWDENRSEFEMTTTVINIPAFKFQVPTTNQGLYSVTSLQIDKSQQNILGIINTIGLSNILKALGNTAATNGLSQAINRVQGLMNLTNQKVVTLASKPDTQIVNGWTGTTNFVLPKFFYKTRTHNGFTFGGSFTAPSGLGMKWNGKGGEFLHDVFIMMVELAPSMSYTVNKHFSVGVGLRGLYATGSFNNTVYVPLEGASVLSAEQILNLPNNVFADQVPSNMMTLLGNIGYQPALNCQKAGGDMSDQSCQEFYNGLKKIMGYSGLIKASANLYGTTQVVQKSNGQGVSGGYRVGSSLRVFDHGMFSVVYNSSVTFNMKGALVAITELGPSLGSVLTKGSLNINVSLPQTLSLAYAHQFFKDHLRIEGVFERTFWSQGNKFLVTPDFANATYKGLSGTVASLDSETLKKMVGLANFKSVMNMGAGWRDTNTFRLGVTYMGKSLRLMGAIDYDQAPSPQDAIGIPDSNGYTVAFGTKYNFRGFDLGVAGSFTFKSNRSSLYQSPNIGQLRIFSASLGYRW

SEQ ID NO: 15139 - protein, 792 aa, Helicobacter pylori
MNGYLMVKTPYFLASVVLTFWTFNSFMSAKDKHHFLKKVTTTEQKFNSSAPLSWQSEEVRNSTSSRTVISNKELKKTGNLNIENALQNVPGIQIRDATGTGVLPKISVHGFGGGGNGHSNTGMILVNGIPIYGAPYSNIELAIFPVTFQSVDRIDVIKGGTSVQYGPNTFGSVVNIITKEIPKEWENQAAERITFWGRSSNGNFVDPKEKGKPLAQTLGNQMLFNTYGRTAGMLGKYIGISAQGNWINGQGFRQNSPTKVQNYLLDAVYKINATNTFKAYYQYYQYNSYHPGTLSTQDYAYNRFINERPDNQDGGRAKRFGIVYQNYFGDPDRKVGGDFKFTYFTHDMSRDFGFSNQYQSVYMSSQNKILPFKGKGKISATNPNCGLYSYSDTNSPCWQFFDNIRRFVVNAFEPKLNLVVNTGKVKQTFNMGMRFLTEDLYRRSTTRKNPSMPNNGSGFDAGTSLNNFNNYTAVYASDEINFNDGMLTITPGLRYTFLNYEKKDAPPFKEGQTGKTIKDRYNQWNPAVNVGYKPIKELLFYFNYQRSYIPPQFSNIGNFVGTSTDYFQIFNVMEGGSRYYFNNQVSFNANYFVIFANNYFTGRYGDNREPVNARSQGVELELYYTPIRGLNFHAAYTFIDANITSHTMVTNPANPKGPKKDIFGKKLPFVSPHQFILDASYTYAKTTIGLSSFFYSTAYSDVLNTVPFTEYAPTIKNGAITTRTAGMTPWYWVWNLQISTTLWERKNQSVHASLQINNIFNMKYWFSGIGTSPNGKEAAPPRSITAYVSYNF

SEQ ID NO: 15140 - protein, 703 aa, Helicobacter pylori
MSVYAQAAVQPKEETITVTAAPVAQESAWGPAPTIAAKRSATTTKTDTPIEKTPQSVSVVTNEEMQMHQFQSVKEALGYTPGVTVSSRGASNTYDFVIIRGFSSVGLSQNNYLDGLKLQGNFYNDAVIDPYMLERVELMRGPTSVLYGKSNPGGIISMVSKRPTTEPLKEIQFKMGTDNLFQTGFDFSDSLDDNGEFSYRLTGLARSTNEQQKSSESQRYAIAPSFTWRPDEKTNFTFLSYFQNEPETGYYGWLPKEGTVEPLPNGKRLPTDFNEGASNNTYSRNEKMVGYSFEHGFNDTFTVRQNLRFVEMKTAQKSVYGTGIAADGHTLNRGTIVDNERLQNFSVDTQLESKFATGDIDHTLLTGVDFMRMRNDINATFGSAPSIDLYNNYHPEYFAFGGAEPYQMNESKQTGLYVQDQAEWNKWVFTLGGRYDWSKQATTVRQNSTTPTEGYIERNDHQFTWRGGVNYVFDNGISPYFSYSQSFEPSAFDLWSTPRVSYKPSKGEQYEAGVKYVPKDMPVVVTGAVYQLTKTNNLTADPTNPLAQVPAGEIRARGVELEAKAALTANINMTASYTYTDAEYTKDTNLKGNTPEQVPEHMASLWGDYTFNDGPLSGLTLGTGGRFIGSSYGDPANSFKVGSAAVMDAVVKYDLARFGMAGSSIAVNVNNLLDREYVASCFQTYGCFWGAERQVVATATFRF

SEQ ID NO: 15141 - protein, 554 aa, Helicobacter pylori
MGRIATTGLAGAAIAVTAVMAVDAARAADLPVRKAVPIEFVRVCSASGAGFFYIPGTDTCLRVSGRARFEAGYIPVQNRTNSAGDLSQYRGLMRMNVDARTQTGYGTLRAFLRVEAASRTGVTMASGTQQRIGNAFPATGQDALGRVQNYVVADKAFVQFAGLTAGRASSFFDFYAHDYELIGSTAGSDMPSTNLLAYTSKMGEGWSATLSMEDPNLRKNPFYAASAAPTGTIPGQSGVNNVFVTAPSPVILGTNANGTASTAVFVDAVQRSRMPDFVGALRYDAGWGSIQLSAAVKDVNIGGFIANSGISTLTAAPGSATGPVGAGTAAALLATRGITSGSQTDHGWAVQGGLKLNLPWIAAGDGLYLQGAYGEGALIYTGFSFFTGNYSSQLTPVQGGPFVQALADAVINPLTGRIDLSKSFTATASLLHYWAPEWRSAVFGSYGEVGFRRGTREAFSLVNNLVGSSAPPTGAAFASNPILRDNYQIIAGASLIWSPFKDLDIGIEGTYIGTGLLGGRDADATRPVTVNGLPAYTEKHYDTTQIRIRVQRDF

SEQ ID NO: 15142 - protein, 650 aa, Helicobacter pylori
MKKTILLSLSLASSLLHAEDNGFFVSAGYQIGEAVQMVKNTGELKNLNDKYEQLNSYLNQVASLKQSIQNANNIELVNSSLNDLKSFTENNYNSTTQSPIFNAVQAVITSVLGFWSLYAGNYLTFFVGNKDTKQSANVQGNPPFETIIRNCSGLENCAMDQTTYDKMKKLAEELQAAQQNSATKGNNLCALSGCATTNGQTLPSSTVSNALNLAQQLMDLIAKTKTAMMWKNIVISGVSNVSGAITSTNYPTHYAVFNNIKAMIPILQRAVTLSQNNNSLSSKLQVQATGSQTNPEFAKDIYNLAQNQKQVLSYAKDIFNLFNSIPADQYKYLEKAYLKIPNLGKTPTNPYRQVVNLNKEVQTIQNNVSYYGNRLDSALSVAKDVYNLKSNQKEIVAAYSGAKNLSQEISQLPYNQINTKDIVTLSYDKNAPAAGQYNYQINQVQASNLSQALAAMSNNPFKKIGMIASQSNNGALNGLGVQVGYKQFFGESKRWGLRYYGFFDYNHGYIKSSFFNSSSDIWTYGGGSDLLVNIINDSVTRKNNKLSVGLFGGIQLAGTTWLNSQYVNLTALNNPYSAKVNTSNFQFLFNLGLRTNLATAKKEDSEHSAQHGIELGIKIPTINTNYYSFLGAKLEYRRLYSVYLNYVFAY

SEQ ID NO: 15143 - protein, 150 aa, Helicobacter pylori
MHADTATRQHWMSVLAHSQPAELAARLNALNITADYEVIRAAETGLVQIQARMGGTGERFFAGDATLTRAAVRLTDGTLGYSWVQGRDKQHAERCALIDALMQQSRHFQNLSETLIAPLDADRMARIAARQAEVNASRVDFFTMVRGDNA

SEQ ID NO: 15144 - protein, 661 aa, Helicobacter pylori
MKKLFIPLLLFSALEANEKNGFFIEAGFETGLLEGTQTQEKRHTTTKNTYATYNYLPTDTILKRAANLFTDAESISQLNFSSLSPVKVLYIGGKLTIENFLPYNLSNVKLSFTDAQGNAIDLGVIETIPKHSKIVLPGEAFDSLKEAFDKIGPYTFFLPKFEATSTSVSDANTQRVFETLNKIKTNLIMKYSNENPSNFNTCPYNNNGNTKNDCWQNFTPQTAEEFTNLMLNMIAVLDSQSWGDAILNAPFEFTNSSTDCDNVPSKCVNPGVNGRVDTKVDQQYILNKQGIINNFRKKIEIDAVVLKNSGVVGLANGYGNDGEYGTLGVEAYALDPKKLFGNDLKTINLEDLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIVKYNYSKALNQKFQQLSYGGGIDLLVDFITTYSNKNNPTGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 15145 - protein, 273 aa, Helicobacter pylori
MEFMKKFAALGLLSSVLSSSLLAEGDGFYMGTNYQIGQARLNSNIYNTGDCRGSVVGCPPGLTANKVNPGGTNINWHAKYANGALNGFGLNMGYKKFFQFKSLDMTSKWFGFRVYGLFDYGHADLGKQVYAPNKIQLDMVSWGVGSDLLANVIDKDNASFGLFGGVAIGGNTWKSSAANYWKDQIRKAKGPNVCNMDYCNPNAPYSTNTSTVDFQVWLNFGVRTNIYKHNGVEFGVRVPLLINKFLSAGPNATNLYYHLKRDYSLYLGYNYTF

SEQ ID NO: 15146 - protein, 767 aa, Helicobacter pylori
MKRILVSLAVLSHSAHAVKTHNLERVEASGVANDKEAPLSWRSKEVRNYMGSRTVISNKQLTKSANQSIEEALQNVPGVHIRNATGIGAVPSFSVRGFGGGSSGHSNTAMVLVNGIPIYVAPYVDISIPIFPVTFQSVDRISVTKGGESVRYGPNVFGGVINVITKGIPTKWESQVSERATFWGKSENGGFFNQNSKNLDKSLANNMLFDTYLRTGGMMNKHFGIQAQANWLKGQGFRYNSPTNIQNYMLDSLYQINDSNKITAFFQYYNYFMADPGSLGIEAYNQNRFQNNRPNNNKSGRAKRWGAVYQNFFGDTDKIGGDFTFSYYGHDMSRDFQFDSNFLNVNTNPKLGPVYTDQNYPGFFIFDHLRRYIMNAFEPNLNLVVNTNKVKQTFNVGMRFMTMDMYFRLDQSTCEKTDIFNGVCRMPPFVLSKKPSNNQNLFNNYTAVWLSDKIELFDSKLVITPGLRYTFLNYNNKEPEKHDFSVWNITKKRQNEWSPALNIGYKPMENWIWYANYRRSFIPPQHTMLGITRTNYNQIFNEIEVGQRYSYKNLLSFNTNYFVIFAKRYYAGGYSPQPINARSQGVELELYYAPIRGLQFHVAYTYIDARITSNADDIAYYFTGIVNKPFDIKGKRLPYVSPNQFIFDMMYTYKHTTFGISSYFYSRAYSSMLNQAKSQTVCLPLNPEYTGGLEYGCNSVGLLPLYFVLNVQVSSVLWQSGRHKITGSLQINNLFNMKYYFRGIGTSPTGREPAPGRSITAYLNYEF

SEQ ID NO: 15147 - protein, 306 aa, Helicobacter pylori
MKKALLLSLFLSFWLHAERNGFYLGLNFAEGSYIKGQGSIGKKASAENALNQAINNAKNSLFPTTQNTKAIRDAQNALNAVKDSNKIASRFAGNGGSGGIFNELSLGYKYFLGKKRIIGFRHSLFFGYQLGGVGSVPGSGLIVFLPYGFNTDLLINWTNDKRASQKYVERRVKGLSIFYKDMTGRTLDANTLKKASRHVFRKSSGLVIGMELGASTWFASNNLTPFNQVKSRTIFQLQGKFGVRWNNDEYDIDRYGDEIYLGGSSVELGVKVPAFKVNYYSDNYGDKLDYKRVVSVYLNYTYNFKH

SEQ ID NO: 15148 - protein, 650 aa, Helicobacter pylori
MIDHLSFKTTKAKSLHTQNIAQRTLKAVAHTYRPLSMAIALMGLSSIATAQEFSQTVFFGDSLTDTGRLVQIGKNSLASSVFNQAQPSFTTNTDPVWSSILAKSYGHTADANDGTTLTGTNYAVGGARTKEDVVKNAPVPFFTIPLFTIPSAQTQINRYLTLNNHQADPKALYTVWTGANDLFEAAKAPTQLQAAEIITTAANDQANLVGQLGQAGAKHILVPSLPDVGVTPEYAQDPTKSATASLSAHIYNQTLYQSLNNQTTNVIAANTFALLKEAVSNPAGFGFSNVTEPACQNLDANLSSLACKPSDWQQTAANANETYAFADKIHPSGRTHRILAQYYRSIIDSPTQMGQLPQHLIKHGQQSQQQLVRRLDSLNNHQQSLWIDGSISNQSLDTRNKIDRPTIKLGLDIARPNQHTGAYLTYQQQDHHLSDSITADVKQTGIGLYHRHDFDHLRISANLGVDHLSTQSLRQIMWDGENRNHQAHATGKRRYASVQGSYGFTQNNVTYRPYVGIHAQDIKQNRFFENQPNLSTALSFKLPDHQSLQADIGVNIDYAMNDKLNLLAGLGYQHEFKDNNKTVETAVLSNRDYHRSFVTTVPFDKKHTTHAHLGATLALGNNTHLNAGIQANHQDHDTKVGGFVGAQMAF

SEQ ID NO: 15149 - protein, 189 aa, Helicobacter pylori
MKKIAFILALWAGLLGAFEPKKSHIYFGAMVGLAPIKITPKPASDSSYTAFLWGAKGGYQFAFFKALALRGEFSYLMAIKPTAFHTINTSLLSLNMDVLSDFYTYKKYSFGMYGGLGIGYFYQSNHLGMKNSSFMGYNGLFNVGLGSTIDRHHRVELGAKIPFSKTRNSFKNSYFLESVFIHAAYSYMF

SEQ ID NO: 15150 - protein, 186 aa, Helicobacter pylori
MIKKIACILSLSASLAMASETNGFFMGAGYQQGRYGPYNSKYSNWRYGNDLYGLNFKMGFVGFSNKWFGGRVYGFLDWFNTAGTQNRKTNLLTYGGGGDLIFNIIPLDKFALGLIGGVQLAGNTWMWPYNFRQTKFQFLWNVGARMRLGEHSAFEGGVKFPMINQGSKEVGLIRYYSWYVDYVYTF

SEQ ID NO: 15151 - protein, 1189 aa, Helicobacter pylori
MIYFNRKGLLYSFIQKETRVMNLALFMLTFMLSGLYATESYSQTVRISLNMKNSTVKEVLKKIENCSEFTFFYNDEIIDVDKRVTLNAEDLSISDILTTILPNCSYTISNKNIIITVKEAGVHQQGKIVTGVVRDVNGEPVVGANVSVKGTTNGTITDMDGKFTLEGVSADSKLSVSYIGYMAQEIVVGNKGAFEIVLKDDTQALEEVVVVGYAAQKKVNLTGSVASLNFTDEKLSRPVTTIAASLSGMAAGVNVMNTSSQPNAEGSSILIRGVGTMNDAGPLILVDGMEMSLNEVNPNDVASISILKDAASCAIYGNRGANGVILVTTKRGSDGKINVTYSGKFSYQTPAKLIRQVTDYADYMEFVNEGYLNTNQAAKFSQSTINEWREAANNPNATNVAGIPNYVTHPNTDWYDVVYDPKWMQEHTISLTGAEKRTNYAISGTYLNNPGLVIESGVKKYYLRSDIESRVTDFLTVGMRAWGYNADQDRNNLGDMWGLNMQKVTPGVYPYYDGKYGGIETNEEDGQAGNPLLNMSNSYGYYKQNKYFVNPYIEVKFLKDFKFTANFYYDQFTNHHRWQPSDYKEQYSFNRTMTLSTPPTSTDMATYKVYDWERREKYWKTNMLVSWAHTYGKHDVGALIGYEESRNWGDEVDICKEGMSSVNLTDFDAMTDPYYIKGSSYEYSSRSWFGRINYAFDNRYLFEMNMRYDGSSRFSPDSRWGLFPSFSAGWRISEEEFMKDIDWLSNLKLRASWGKLGNNSIGNYEWQALYGSGYNYAFNSNKSNGLAMTTFSNYALEWEETAITNIGLDFGVLNNRLNGTIEVYDKKTDGILYRPTLPESLNQFTSPLQNLAGVNNKGLEITLGWNDRVGDISYSVSGNFTYNKNKVTKYKGELVREWRTDANGKKVWYQNVGTVANGSSNLIVEGHEMNEYYMMNPYKGNGSYFNSDGTVNINGGPKDGMIRTEADMKWLQAMFDAGYKFYPNQAIGKDKIWYGDMIYADYNGDGIYGNDDDRDFQGVSWRPKYYFGLQASMTWKGFDLSMNWAGAAGFKIDYYKQTQNSVSVTHGYGLGYDIAYDHYFFDPENPNDPRTNIYSETPRLVGYQNSGQASATSSWHLKNGNYIKLKNLTIGYTFPKEWMKVAFIQNARVYLSGENLLTITKFEGSDPERMAGDGYMPIRQYTVGVNVTF

SEQ ID NO: 15152 - protein, 232 aa, Helicobacter pylori
MGILKSLFTLGKSFISQAEESIEETQGVRMLEQHIRDAKAELDKAGKSRVDLLARVKLSHDKLKDLRERKASLEARALEALSKNVNPSLINEVAEEIARLENLITAEEQVLSNLEVSRDGVEKAVTATAQRIAQFEQQMEVVKATEAMQRAQQAVTTSTVGASSSVSTAAESLKRLQTRQAERQARLDAAAQLEKVADGRDLDEKLAEAGIGGSNKSSAQDVLARLQRQQGE

SEQ ID NO: 15153 - protein, 240 aa, Helicobacter pylori
MGLKKRAILWSLMGFYAGLNALDYDTLDPKYYKYIKYYKAYEDKEVEELIRDLKRANAKSGLILGINTGFFYNHEIMVRTNSSSITGNILNYLFAYGLRFGYQTFRPSFFARLVKPNIIGRRIYIQYYGGAPKKAGFGDVGFQSVMLNGDFLLDFPLPFVGKYLYMGGYMGLGLGVVAHGVNYTAEWGMSFNAGLALTVLEKNRIEFGFKILNNFPFLQSSSSKETWWGAMANIGYQYVF

SEQ ID NO: 15154 - protein, 200 aa, Helicobacter pylori
MYYLRILILSISFLNILNAENLSYMSSSYQVGMVFMRPLNANKLLQGASILQGYEVNPKNDWAYSRYYFFIDYGNVLFNNDSTLQANMFTYGVGGDFMVAYAKNPINRWAFFFGLQLAANTWILNNKVKDLVVNTWDSLKDFNFHNTYFRAIGKFGVQFRTIVLYHKVDVEIGMKIFLTPERRSLFERSFLFFVSHSWHF

SEQ ID NO: 15155 - protein, 254 aa, Helicobacter pylori
MKLNLQEIQLRTLLKMLVGASLLTHALIAKEESAAPSWTKNLYMGVNYQTGSINLMTNIHEVREVTNYQTGYTNIITSVNSVKKLTNMGSNGIGLVMGYNHFFHPDKILGLRYFAFLDWQGYGMRYPKGYYGGNNMITYGVGVDAVWNFFQGSFYQDDISVDIGVFGGIAIAGNSWYIGSKGQELLGITNSSAVDNTSFQFLFNFGLKALFVDEHEFEIGFKFPTINNKYYTTDALKVQMRRVFAFYVGYNYHF

SEQ ID NO: 15156 - protein, 278 aa, Helicobacter pylori
MMKKTLLCAAAGAAAVAPLAAHAQSAGSNVVTLGWFHIMPQQSSTPMTTNVAPTPINTPLRLPPSFTSPGTGLHTSGADTVGLTVSHFLTDHIAVTSVAGVPPVFKVSGQGTIKPPGPAGALGTQNIGLGSVNPIVKSVRQWSPAVILQYYFGQATAKFRPFLGLGVSYNWFSDLQLNTNFIKQTQDNLGAILAAGAGKPGTTSVEAKASSSWQPVFNAGLQYNMTEHFGLVASVTYIPLKTTSTVTIKAADGSVLAESKSDLKADPIISYVGMTYKF

SEQ ID NO: 15157 - protein, 189 aa, Helicobacter pylori
MKKFIPVIAGSIAIASFSAAAKAEDMAENNSGFYVGGNYGYLKVESDDDFDDDNDVVQGIVGYRFNSFLALEGSYIDFGSYGNSVANAETTGYTAALKGTIPITQTVELFAKAGQLWHETDYNIASVKGSSDDRSLFAGAGVNFKVTENLLVNAQYTWYDVDLNADNVDSDSDFDSDFKQASVGAEYRF

SEQ ID NO: 15158 - protein, 366 aa, Helicobacter pylori
MMKNTLKVVLLTSMLPLAASASQELTPWYVGAGLGVNNYEHIATQNGDDNPYAWDIFAGYMFNDYFGAEIGYRDLGNADWTTSGISNDADVKGATLGLVGLWPLANRWSLSAEAGAMYYTLENSQRDTISGARSSYSSDDFAPYFGAGIGYNFTDNLKLQAKYRRYENLDDKYNIVEADSNYWGLELSYRFGTPVAAAAPVVAAVVAAPVDSDNDGVYDDKDQCPATPATHKVDSVGCTIYENVKNKEDVGSIQFANDSAVVKNVYYKDIERLANYLNKNPEFTVEIAGHASNVGKPEYNMVLSDKRADAVANILVEKFGISRSRVTSNGYGITQPLVAGDSKEAHAANRRIEAIVTTTTKQPVLK

SEQ ID NO: 15159 - protein, 473 aa, Helicobacter pylori
MKNHSFKKTIALSLLAGMSLCNAEEDGAFFVIDYQTSLARQELKNPGFTQAQELKQLIRDGAVRLQTSAIPLSYYLDILGNKTKILLSESVKDNAQPPQALVNLEQSLGILGKLLDLSQQYANQGVIKPLVVDVGKEQIGITDSMLSVAQNIVLALGQVDLSKIQQNNNGQLYENIMKVMLLGAGGTNGAYNGVTVGDIATGMQNFSSQTGLIGANSTVSELNALIKSGISLDRETLGLGSFIEKNICSSASSCFSGSQLIYKKGLDRTINIINTVLDQFENSASSLYKISYIPNLFSLKDYQSASMNGFGAKMGYKQFFTHKKNIGLRYYGFLDYGYANFGDTNLKVGANLVTYGVGTDFLYNVYERSRRRERTTIGLFFGAQIAGQTWSTNVTNLLSGQRPDVKSSSFQFLFDLGVRTNFAKTNFNKHKLDQGIEFGVKIPIIAHKYFATQGSSASYMRNFSFYVGYSVGF

SEQ ID NO: 15160 - protein, 483 aa, Helicobacter pylori
MKKTILLSLMVSSLFAENDGVYMSVGYQIGEAAQMVKNTGEIQKVSNAYENLNNLLTRYNELKQTASNTDSSTAQAIDNLEKSASRLKTTPNTANQAVSSALSSAVGMWQVIASNLANNSLSSSEYEKLKATSQLLQNTLENKNNNLKIENDYDQLLTQASTIINTLQSQCPGVDGGNGKPWGINTSGNACAIFGSTFNAINSMIDSAKKAAADARRTAPESPNQQNAFTNADFNKNLNQVSSVINDTISYLKGDNLETIYNTIQKTPNSKGFQSLVSRSSYSYSLNETQYSQFQTTTKEFGHNPFRSVGLINSQSNNGAMNGVGVQLGYKQFFGKNKFFGIRYYGFFDYNYAYIKSNFFNSASNVFTYGAGSDLLLNFINGGSDRNRKVSFGIFGGIALAGTTWLNNQSANLKITNSAYSAKINNTNFQFLFNTGLRLQGIHHGIELGVKIPTINTNYYSFMGAKLAYRRLYSLYLNYVLAY

SEQ ID NO: 15161 - protein, 389 aa, Helicobacter pylori
MKKSLFALSILGTFAATVHAQSSVTLYGIVDEGVMINTNAKNVVKGKNVGGRQFSVDSNAGTQGSRWGIRGAEDLGGGLKAIFVLESGINVSTGAFGQGGTAFGRQAYVGLASSSFGSVTLGRQYDSINDYVGNYGYAAAYGGSTTEHPGDLDNVNHTFRANSTIKYASPNFNGLTFGGTVSLGGVAGEISQSSGYSLGANYGHGPFGIGVAYELFKNPSALGSLLNSNANAATFNSLNSGYLGTKPANSLQIITTGGSYDFGPAKIGAVYSNTKYMNIGAFGGATATLNSYELNALYRFTPAFSVSGEYNYTKGNAVRGDLGDQKYNQFSLLLDYALSKRTDVYFLGTFQTASGTSSTGAAAVADIGGLGDSSNNHQAVARVAIHHKF

SEQ ID NO: 15162 - protein, 1176 aa, Helicobacter pylori
MGAIVMNAVGRSAGTAHGGAMSRGSRRAMRRAWLAVMLASVALPPAAHAADALTWSMYNSYSQSYFIEYARGLSGALSNATTMNFNVSVAGHTLYPTMDTGSTGLVISANVLGLSTTAPVNAQAGWVFYNSSGLLLTGYFSQQNVQFSGKDANGAATPVVSNVPVLVVTQAQCLGVGANSSTCDAATSVNGVQMMGIGFDRNTMGTGVVNTSNPTAAAARLDAAPTTPQIYNPFLNVVTSGSGAYRNGYIITPTGVYLGLTEANTSAQAYSYAQLALAPKQTAGAPQWLATTVTVTVTTPAGASTPASSASGKGTLLMDTGVEDAFIGIPNGGSITPASNTVVTLQLGNGIGTYSFTVPSSTSPASTNPQTPTRVSFFDSSSGFINSGLHTYAGYNVLYDADGGFIGLALNNYPGSTAQVTQMIAAQGTLNLTSDFATNLPVLLIANATVATASGSTATFNSDFTGTGQLTLQGGSVTLNGQLTHSGGTVVASGTTQLGGTLIGSLSVLAGATFLDASGGYTVAAGRTLSNAGTFTGPSSVSVSNAGTVVNSGTFAVSFSNSGTATNTATGAFTANIANSGVFLNAGSIAGNVTNTGQFTSAATGTIAGTVQNSGRFTNNGSIGPGAATPPAIVANTGVFVNAGGITGNVSNAGQFTNNGTITGTVENTGTFGGNGTVGHLLVRTGGALSPGNSIGTHVVRENATFEPGAVLLAELGTPGTSDRLIVGGTLTAGGAVLVPIPGEGFAPALGAGYRVFSAGTTASNFTVGGPYFGTAGAVYPFLSASLGSGADSGLLTLNRSAVSYAALAPTANAAAVGRAADTVALAQPLGQALAVMPGAAAPAALASLSGEIYASAQGVLQVQSSYVRNAVTGRLAQAEGAPGTAQLAPVDGFGTTLWGQAYGGWGSTASDGNASAVTRSLTGFLIGLDGRLSDWRVGVAGGYSQSDFSTDSLPGSGTSDNYDLALYAGRTFGGDANGAFALRAGAAYGWHDLSVSRTVTAPGLVAGYGTGYSAGTAQVFGELAYTYAPRTEGLPVSLEPFAGLTYTALSTNGFTEPFGPAALRAQSASFDTLSTTLGLRARTTVQVGAVPVALTGSVGWQHAFGDVTPTTTFTFAAGSLPFTVAGAPLATDALLLGLGAGAKLADNLDLSLAYNGQIASGFTETAVKGILSWRF

SEQ ID NO: 15163 - protein, 286 aa, Helicobacter pylori
MKKSVIVGAISLAMTSLLSAETPKQEKAIKTSPTKKGERNAAFIGIDYQLGMLSTTAQNCSHGNCNGNQSGAYGSNTPNMPTASNPTGGLTHGALGTRGYKGLSNQQYAINGFGFVVGYKHFFKKAPQFGMRYYGFFDFASSYYKYYTYNDYGMRDARKGSQSFMFGYGAGTDVLFNPAIFNRENLHFGFFLGVAIGGTSWGPTNYYFKDLAEEYRGSFHPSNFQVLVNGGIRLGTKHQGFEIGLKIQTIRNNYYTASADNVPEGTTYRFTFHRPYAFYWRYIVSF

SEQ ID NO: 15164 - protein, 714 aa, Helicobacter pylori
MKTLFLLLSITFSISSLAQTTISGQVLDEKNVPVLGANVYLQGTYDGATTDIDGKFSFETSETSIVTIVASFIGYEDYVQQSTVNELNDIKIRFRESVNSLNSVILNAGTLNAGDSSKASALKPLDIVTTAGAVGDFVGALQTLPGTSANPDDGRLFVRGGSGDETQVFIDNSRVFRPFVPVTGNIPTRGRFSPFLFDGISFSTGGYSAEYGDALSSVLLLNTTDIPTEEKTDLQIMSVGGGVGNTQIWGKNSVSVNASYINLGPYNQLIPQNNQFEDPYESISGEAVYRHQLEKGMFKAYSAYSYSNFSLIQEDIDVEDGIFFALKNGNYYGNLNYEQRLDNNWKMEAGLSLAHDRNDINVAGTDVDTRENALHAKFKLHKRYNNYFKINYGLEQFVINYKEDVTIDENAFESSVNSSNSGVFTEAELFLSKDLAFKAGVRADYYGLSKELLISPRLSAAISVSKNWQASLAYGQFYQQAQNNILQYDEQLAPESAEHYILNFLYQKDGRMLRAETYYKNYSSLLTYDTDRPQPDSSYGLDGDGYATGLDLFWRDEKSIKNLDYWVSYSFLDTERQYRNFQETATPNFASAHNFSVVGKYWVENWKSQIGVTFNYTSGRTFTNPNRNGFLNDQTGSFQSLNLNWAYLIDQQKIVFLSVTNILGRENIFNYQYSSTPNSMGDFNRRSIGQAADRFIFVGFFWTLGSNDNQLDNL

SEQ ID NO: 15165 - protein, 1081 aa, Helicobacter pylori
MKKSFILFVFLLCSIVVVAQKKSITGIITDTAGEAVIGASIVEVGTTNGTVSDVDGNFTLSVSDNASIQVSFIGFSSQTLSVQGKMNFKIILKEDSELLQEVVVTGYGGKVSRAKLTNSISTVSPQILEKGIYTNPSQALSGSVPGLKVSLTSGNPTSSPKVILRGGTEFDGSGGPLVIVDGQLRDNFDDINPQDIASMDVLKDAGATAIYGARASNGVILITTKSGRAGHREINFRANIGLGYVNNPYDFLGAEDYITVLRTAYKNTPWAATANLTGSTPFGTGNKLGANMVWNIMGKTDENAYLLDMGWREMLDPLDPSKTIIYKGTKPEEYNLRNPVVTQDYTVSMSGGNDKGTYYASLGYNDSPGAPITTEYKRYNFTFNGSYKIADWLKTTSNATFSRANYVWLNNAWGTESDYFGRVMSTPPTVRFEDEDGNPTLGPSPGDGNQTYVAKSYDQDNERTKFTLIQSLEANLFKGLVLRASASWYYFHTVQESMRKDYETVPGQWNRTRSTSASYSRQFSQTYNAVLDYTTVFSAVHNLNIMFGSEFYDQYNNGFSASGSGAATDDFKDLGLTDAGEGKRQIDSNHSRYRILSYFGRLNYDYEGKYLFSGVFRYDGYSSLLGKNRWGFFPGVSGGWVFTKEDFVKESLPFLYYGKLRASYGLNGNASGIGPYTLQGSYNSNKYHGNNGFLIGTLPNPSLRWEKTASFDIGLNVGLLGGRLNLDIDYYNRLTSDKYADFTLPSTTGFSSVKNNNGKLRNSGIELQLSGKVLDVNDFTWDASFNITYNKNKIIALPDNGQVRNRQNGQQVYTGRKVVNPGTGKLEDEKVYVGGFQEGMEYGILVGYQAEGIYRSVDDIPGNLVVTSGNIQGKYQYGPEAWNKLSDNERAKGIELKPGDVKWKDVNGDGVIDQYDQVVIGNTTPRWYGGFNTTMSWKGLSLYARFDFALDYWVYDDKTPWFLGCMQGTYNTTKDVFNTWSESNPNAKYPRYVFADHVGAANYYRTSTLFASKGNYLGIRELSLSYTLPQELSKRLYMQKLQFSITGQNLGYLTSARTVSPEISSGYPLPRTVIFGVNVTF

SEQ ID NO: 15166 - protein, 688 aa, Helicobacter pylori
MKKKFLSLTLGSLLVSTLSAEDNGFFVSAGYQIGESSQMVKNTKGIQDLSDSYERLNHLLTSYSALNTLIRQSTDSNAINNARTNLNASAKNLISDKANSPAYQAVLLALNAAAGLWQVMSYAISPCGPGKDSSKNGGVQTFENTPTNQWGGTTITCGTTNYEPGPYSIISTENYAKINKAYQIIQKAFGTSGKDIPALSDTNTELKFTINGSNNNNNNNKEEIVTKNNAQVLLEQASTIITTLNSACPWINNGGKGGASSGSLWEGIYLKGDGSACGIFKNEISAIQDMIKNAQIAVEQSKIVAANAQNQHNLDTGKAFNPYKDASFSQSMFANARAQAEILNRTQAVVKDFERIPAAFVKDSLGVCHEVQNGHLRGTPSGTVTDNTWGAGCAYVGETVTNLKNSIAHFGDQAEQIHNAQNLAYTLANFSSQYKKLGEHYDSITAAISSLPDAQSLQNVVSKKTNPNSPQGIQDNYYIDSNIHSQVQSRSQELGSNPFRRAGLIAASTTNNGAMNGIGFQVGYKQFFGKNKRWGARYYGFVDYNHTYNKSQFFNASSDVWTYGVGSDLLVNFINDKATKHNKISFGAFGGIQLAGTSWLNSQFVNLANVNNYYKAKINTSNFQFLFNLGLRTNLARNKRRGADHSAQHGMELGVKIPTINTNYYSLLGTTLQYRRLYSVYLNYVFAY

SEQ ID NO: 15167 - protein, 703 aa, Helicobacter pylori
MVKNNSGWAAGLAVALMGLPYVGEVSAQEVDLPATTASGQRQAAGYRARESSVATRTDADLMEIPFAVSSVNTELMRTVAAGRGDDLYDWVAGVARQNSFGGLWDNYAVRGFAGDGNWAGTDYLLNGFSWNRGNSVPRDTASLERMEVLKGPASALYGRGDPGGIISYTTKQPQFKSANTISVSAGSYGTTRETLDSTGALSPTLAYRLNLMNEDNGSFRDTVSSKRYLVAPGFTWKAGPDTVVHYEMEAARQSAPLDRGVVAVNNQLGAIPASRFLGEPRDGDYEVRNLGHQFTVDHHINADWSVNAGVAQRETDLYGRSSEALALQADGRTLWRRYRHVDFHTNDLQGRLELAGKLQTGAVGHTLVMGADAYRFTYDQLVERSTPTAAAPYAIDIFNPVYGQATPALRTVTNALERDEGQGAYVQDTLALGERWKVIAGLRWDRYRQSIDDRQSGTTTSQQQTAFSPRLGVVYQWSPAFSVYANTAYSFRPNSGTDANGNAFDPEKGRGYEVGAKWAGSGWLATVAAFNVTKRNVLTADPANDGFSRAAGEVRSRGVELEWNGELGGGFRGIANLAYVDAEVTRDTVLTPGARLVNIPRVNGSAMLMYEFAPGFAQKAGVGAGVVYVGRRAGSTANTQDGFQLPAYTTVQLNGYVQIDKHLRASVVLNNLFNRTYYVSSYNSVWVTPGAPRSILGTLSYSF

SEQ ID NO: 15168 - protein, 952 aa, Myxococcus xanthus
MSKTPPKFLFYLGNFTACMFGMTPAVYSLQTDSLEKFALERDEEFRTSFPLLDSLSTLTGFSPITTFVGNRHNSSQDIVLSNYKSIDNILLLWTSAGGAVSCNNFLLSNVEDHAFFSKNLAIGTGGAIACQGACTITKNRGPLIFFSNRGLNNASTGGETRGGAIACNGDFTISQNQGTFYFVNNSVNNWGGALSTNGHCRIQSNRAPLLFFNNTAPSGGGALRSENTTISDNTRPIYFKNNCGNNGGAIQTSVTVAIKNNSGSVIFNNNTALSGSINSGNGSGGAIYTTNLSIDDNPGTILFNNNYCIRDGGAICTQFLTIKNSGHVYFTNNQGNWGGALMLLQDSTCLLFAEQGNIAFQNNEVFLTTFGRYNAIHCTPNSNLQLGANKGYTTAFFDPIEHQHPTTNPLIFNPNANHQGTILFSSAYIPEASDYENNFISSSKNTSELRNGVLSIEDRAGWQFYKFTQKGGILKLGHAASIATTANSETPSTSVGSQVIINNLAINLPSILAKGKAPTLWIRPLQSSAPFTEDNNPTITLSGPLTLLNEENRDPYDSIDLSEPLQNIHLLSLSDVTARHINTDNFHPESLNATEHYGYQGIWSPYWVETITTTNNASIETANTLYRALYANWTPLGYKVNPEYQGDLATTPLWQSFHTMFSLLRSYNRTGDSDIERPFLEIQGIADGLFVHQNSIPGAPGFRIQSTGYSLQASSETSLHQKISLGFAQFFTRTKEIGSSNNVSAHNTVSSLYVELPWFQEAFATSTVLAYGYGDHHLHSLHPSHQEQAEGTCYSHTLAAAIGCSFPWQQKSYLHLSPFVQAIAIRSHQTAFEEIGDNPRKFVSQKPFYNLTLPLGIQGKWQSKFHVPTEWTLELSYQPVLYQQNPQIGVTLLASGGSWDILGHNYVRNALGYKVHNQTALFRSLDLFLDYQGSVSSSTSTHHLQAGSTLKF

SEQ ID NO: 15169 - protein, 348 aa, Myxococcus xanthus
MTTPRFIRTAAAAATLAACNAAAHAQSALTLYGALDAGVQYLTHADGHRSAVRLQNYGILPSQVGIKGHEELGGGWRALFKLEQGLNLNDGTATVPGYAFFRGAYVGLAGPVGTVALGRQFSVLFDKTLFYDPLWYGSYSGQGVLVPMYANFIDHSVKYQSPTFAGFDVEALAATSGVAGNTRAGRVLELGGQYTSNGLSVSAVLHQAHGEVSAADDASARRRELGTLAARYAFATLPLTVYAGVERLTGDLDAARTIVWGGARYLASNGIGLNAGVYHTDSRTPAIGHPTLFIASTTYALSKRTVAYVNLGYARNSGQSSQTVYEYDPTPLAGASQFGAMVGMYHLF

SEQ ID NO: 15170 - protein, 698 aa, Myxococcus xanthus
MKKTLSLGLVVATGGVALGASAQETGETMVVVGARTPTEISQIPGAVWVVDEAQIQQQLRSGQSLKSALGRLIPGFDFGSSTNRTNYAQNFRGRDALVMINGVSLNNSRSLSRQFDSIDPFNIARIEVLSGASSLYGGGATGGIINIITKKGEQGGPHFESELGLTSGFNASDDLSRRAAQSVSGGNERVQGRLAVAVQENGSFYDADGDIIKPDIAQTGLQENRSVDLMGNIEAKLSDHERLDITAQYYDSAYVGDKGLYYPNYESGAEYSDKIQNSEVRDGYDSDVDPETERLYLNANYHHDALLGQRFYFQAYHREESSVFNPFPGGSTFTVSEQNTDLTGAKAVFTASPSDPLSVTYGLDASREEFDSKRYTLAPSEGGLELDQTDVLDPYYPSFQADTLAAFVQADYQLTSNLQLSGGARVEQTDVEVEPQGGNDGGSNDYDVSLFNLKALYDFQNGQQTWLAYTQGFEIPDIAKAYRDVSFDISDNPVDGIKTQQLEAGWRLTGRDWQSQIAAYYSWSDKAIDYLYTNDGELEIGVTTIDKDVRTYGLEGKVERFVGANWLFGSAFNWVKSEEKVGGEWVDTSVTEASLPTATLYGEWSDVDTRARLQVNRAFGIDDASGNEIDGFTTVDATASQDTAYGTFSLGVENLLDESYVTIWGQRAAVFYEAYDAQSLWDLQGRGRTYTLTWSHAY

SEQ ID NO: 15171 - protein, 915 aa, Myxococcus xanthus
MLGTIGMAQTTISGNIVDQNNEPVPGANVIIVGKAIGAVTDFDGNFTLQTSEIPPFQLKITSIGYTDEFEEITSNNQTITVVMSEASTILDEIVISASRTPERLFESPVSVERFGLKEIQNTASASFYGGLENLKGVDINTNSLTFQSINTRGFASFANTRFMQLVDGMDNSSPALNFVMGNLVGMNDLDVQSVEILPGASSALYGANAFNGILFMRSKNPFDFQGISSYFKTGITSQDAAGDNEYYDIGIRAAHAFSDKLAVKASFSYMEGTDWHAANEEDLNNPGLTRADPGYDGLNVYGEAVSTTLNFDALAGLPSGTLGSAFVTRTGYAERDLTDYGAESVKFDGAIHYRPFADDFEIIFNSRIGRGATIYQGANRYYINNFSLQQHKLEFKNDNFFVRGYITSENAGDSYDTRLAAVNVNRKWKRDAPNPNDPSEASWFGDYAATYIGAKLGVGTGVQLDDATAHAAARAAADTGRLIPGTPAFQSAFNTVIADGNVSTGARFIDNTKLRHVDANYNLSHLTSDFADIQVGGSYREYELNSSGTIFTDNDGPIPYQEYGLYTQIQKKFMDERIKFTGSVRYDKNELFDGFVSPRASLTYTVGENRNHNFRGSFQTGFRNPTTQDLYIGLDAGRAHLVGASPDNLDRYVIDVPVSTNGAAIVGSNSVTLVGRAAYENTFSLSSLAAGAPEAVNTPLVKPEKVTAMELGYRGQIGKVVIDVSGYYNDYEDFISQKLVVSPKYGQAGDGGLSLLALQNGDTQVWNAYTNSLADITSYGVTAGIEAKVLGNFDVGVNYTYSDFDFDQSSDPDFQPQFNTPRNKVKASFGNTELFKNVGFNVNYRWTETFLWQNSFATGKVPSFSVLDAQVNLAVPSIKSVFKVGASNLLGDEYTTAIGTGFIGSQYYLSWTINN

SEQ ID NO: 15172 - protein, 758 aa, Myxococcus xanthus
MTPAVLPLGRNRRLLSSVALVPLLWPVDGLAQTASANPRGLDPIVVEGQTVRAAKPRATANAGSSRQRRAAARPVATPGPAPTQPTTTAATAPTFNLGTPSSTGSRLGLTPLQTPASVEVIRAETIAERGQHNVIDAVTQNATGFTASPRPGNGGLAFTTRGFTGNGTVMSLYDGTRLYVGSGTMTFPFDTWTAQSIEVLRGPASVMYGEGAIGGAINVISKKPLDVARNEAEISLDTNMSRRLAVDSGGPINPNVSYRLAAIGNMSDGWVDRDKNSNVAVSGSVRVQAADNLAFTLSEDYADRSPSRYFGTPLVNGRLDEALRFQNYNVGDASIRYRDNWTQLKTEWDVAEGVSVKNVTYYLSTHRHWKDVESYTYNPLRGNIGRSSYIEIFHDQEQIGNRFDTTFKGHVFGLANEFVAGFDVNRIAFTHTNNSPYAGTSSVPAYNFDPGYFLPVSPTRPSFHTLTTQYGVFAENRLSLTDQLSLIGGIRSDNPTVQRTDFLSPSNSFEKTYSAPSWRVGAVYNPIENLSIYGQYSTAVDPVTNLITMTGVNRDFSLSTGKQVEVGIKQQLAGGRAEWTLAAYHIVKNNLLARDPQNPANTNPLQIGQQSSRGIEASAGLKVTETIRLDANVAWLRAKYDDFTQVVGGRAVNYAGNVPNNVPQIVSNIWATWAFAPGWSANAGVQLVGDTWADDANTLVRPAYNVVNAGLMWKPDTRQTLALRVYNLFDTVYTTSGNTTMWQLGMPRTAELSYNVKF

SEQ ID NO: 15173 - protein, 685 aa, Myxococcus xanthus
MRSSPSSPSQALRAALLPLLGTPLLALAQTAPPPDTTLPPVVVTGNPLDSDGIATPNSVLAGPGLVLRRGSSLGETLSGLPGVSSSYFGPNANRPVIRGQDGDRIRVLNNAGATLDASALSFDHAVPIDPLVVERLEVLRGPAALLYGGSAVGGVVNAIDNRIPKAAIDGVGGALELRGGGAARERSAGALVEAGGNGLAIHADVFARKTDDLRVPDFDRPVDGGGTERRDRIVNSASDAKGGALGASMQWDHGYLGASVDTYRNDYGIVAEDDVLIRMRRDKFALAGEWRDLGGPIRSVRARLQATDYQHQEVEGTGEVGTTFKNKGSDGRLEFEHAPLGDLKGVFGLQAEHARFEALGEEAFVPSTTSDQFALFAHEELKLQGASRLSFGARVERHRIESEGDAGAADPKFGDALSRRYTAGSAAVGGVWDLAPAFGSGWQLNGNLAYTERAPTNYELFANGVHIATAAFERGDAELGKEKGSNLDLALEWKSGHDRLRAGAFVSNFSNYIALLRTGEPDFVNDEGEAFQVYAFQGVKARLSGFELEGAWRVLEGARTVDLEAQLDAVRATNRSTGEPLPRIAPLRVKLGAAYGLEGWTLRGEVVRAQKQDRVPDDDEPTAGYTLINLALSKRLAWDGNDALFFVKLDNLTDRLAYNAGSVATVRDLAPLPGRSLSAGLRVAF

SEQ ID NO: 15174 - protein, 798 aa, Myxococcus xanthus
MVGATVVYNTNAQNVVTVTGNSGNFFIEDLKDTKGILKISFVGYQTLEVNLSDGQRNTEVLLLTLIQSTTELKGVEIVGRVKKSYHSDYSFSATKLPIQNKELPQAISSITKELISDQQAFHVGDAVKVASGVVPSSFYNQYAIRGISQNEEGQIVNGLRTRQFYFLQPLTANIERVEVLKGPASITLSSVDPGGSINMVTKKPLPIDRKEVSMAAGSFSTIRGTLDFTGPLNESKTLLYRLNGAIQEAKSYRDLINNKSILISPSISYIPNERTAVNAEIIYNNMQGNLDRGQPIFGAVAGVTNLNSTPISLNLGAPGDFFQSKELLIMGSLSHQFTKNIKINVQYMKQTWTEDLQEHRTINAFAPDINGNTIASLVGMRFVQRKQFWNIDNVNAYFNFDFDLGPTRHVLVAGYDLHSWQKLPGGGQNSARGFLLNDGSVTRSFDPANAADYQTMAYGDVTIPRPNVPHFDLSNPSATIRNVSDYNLNSRFAIPNALTTTHAAYVQDFVKLGKLSLLLSLRAEWFEDITNHNTNKAASFTNTVLLPRVGVTYEIFKNINAYAVYLEGYQPQSNTVTLMPSTGSFFWADQSAAQFEPLISDLKEFGIKASFFDNSIVVNSAIYEINQKNILISANDPNNPDLLVQRGADRSRGFEIDITGFITPDWQVNVSYSYIDASIVEDDDENLMGKRKENTPFNSGNLWTRYNFPQSSALKGIGIGFGMQHQGSKIPWFTRDFEVPAFTIFDAALYYAPAKGNLQLALNLRNLANETYWLGAQTYTRLFPGAPRNYMLTATYIF

SEQ ID NO: 15175 - protein, 426 aa, Myxococcus xanthus
MTQNTRLFKKTLVAVTVAMASGQAMAAGFQINAQSATGIGRAFAGDAVIADNASVMSRNPAAMALFDKMELSLGFETITTDITAKGVQYNGSAAESYDDAGGTSVAPNIHLIVPVNDKFAWGVNAYSNFGTKTDFSNNLSWSEYGGLTDVKSVNVGIAGSYRLNDQWSFGAGIDLIYGAGKLERYAGNGMCIAAISGNCVMPVSQGTTLVKADASGFGVGFNVGTVFELDENNRFGLSYRYSPEIEAEGDVEYSVNADSNGKLHMPLPDIAEFSGYHKIQDTQFAVHYSIQYIGWKAFDTLDATINGSTAPLNEYNWQDGWHYSIGGTYYMNTDWTLRAGYMYDTSAQDETTSISVPDSDRQWFSAGATYHIDNKSNVDIGFTYLLGDDVSVSESTPNPIGGSLSTIEATTRANAILFGLQYSRSF

SEQ ID NO: 15176 - protein, 658 aa, Myxococcus xanthus
MRWSVAAGVALLALETTVQAGMAEEQTVEVDSVEVTGTRDREPVYSSFTVPESAAATVEEFSREDIRAVAPSSIYDIAALSPGAQVTFQGRKGMNALQLRGGDTLGVILDGVYIPWSQASRMLAQFPVDAIESVRVVRDSSAVTLGPLTPFSPAVNHDNAPTPGQGSSNQGFMVITTKRGKGFEVGGIAEYASHNSRNFQLYHGYKKGPLSYRLVGTVSGTDGRDGWNNAASTRSILANGNYDATDLKADFMVYFADSRREIQRSTKESTTSNALWYYDPMKSLQLSVNLHKPWNDVHTTSLSYARGRVTAHEVLRTTKATPDDISQADQSDMLHLWHVAATANNRFVAGLQGFRWESPTGQFFYENIARKEDLVSGYLHDEYRLNDRLTLDGGIRVDAKFIEKGSDKYSPLLGGNKMINDEWQQPAISLSLGGSYKLDRMHRLLARFGYTRQDADSFLATVDGKDLDTEERFKYELGIEANYHPAFNPTLTLFLYDIRKFAYAAATGGSGATAYNIYDSADVIREGVEFSCKGALPWGFGYNTGYSYITTDRGATNKIKPHHMVNLRLSHKINAVESNLILNYVGPYENNFLSTGSVYRPAGGYTRLDMNVSYAFTLRGAQARATLYGRNLLDDHYVTIAGWRDQGMVWGGKMEVAF

SEQ ID NO: 15177 - protein, 456 aa, Myxococcus xanthus
MRRCGRTRAAASSAKRSTRRARRSRPNRLLAQRLHNDSTIYWFPRQRGLRIVHPLVRTHRPTGNPAMKRIGSFALLALPVALHAAGAHAQSSVTLYGIADAGIAYVHNVQDANGGNASNLVKFSSGNLSGSRWGLRGIEDLGSGLSALFQLENGFNIGTGALGQGQREFGRKAVVGLASSTYGTVTFGRQYDPVVDLVQGLTEDNYFGGVFATPGDLDNYDNSLRVSNSVKYTSPLISGFQFAALYGFGGVAGATGSGRTYSFGLSYANGPLSLGAGYFFANGGSTVANGVRTWSSSSDTLFNTVINQGFSSAKSIQIVRAAGQYVLGAATFGLAYSNTQYGADTLSAFRQNAKFNNGSAFFNWQFSPALRAGVGYNYTSLTGPASAHYNQVNVGADYALSKRTDLYALFGYQKASGNTLNASGALVKAAASVGSYGANAGTDTQELAIVGIRHKF

SEQ ID NO: 15178 - protein, 688 aa, Myxococcus xanthus
MPVGQPSAIFRSTVSATAAMTAKHTGFKRSALSLLILNSVAVSFAANAAPAEPQTQLNEVLVTATRENKALSQETRSVAVVTQAQIQQQQPASVAEALKYIPNVDVSGGPRANAQSPSVRGLSGNRILQVVDGVRQNTTSGHVRLTSWDPEMLSSIEVIKGPTSSLWGSGALGGVVAQQTISAPDMLHGDQSVGGYLKQGYASANDETKTSGAVYGLLGDSVDFLLNGYYADANNLRLGNGEHLTDSAYRNQGGLAKFGWQADDAQRLELSVRQAETHQNAPSNPSQMVSTSVPLVQQKTRDFNTTLDYRLNPTDSRWLDARVTAYVNKTEFDEYRVTKKQSDKVDYRTLGLNISNHSQFDLLSLTYGGDIYEDKTQGEREGKNRPIPADGRSKVWGSYVQADIPLGSQWNLLPGLRYDHFTAEDKNIAGSERSEDHLSPSVGLRWAATDWLTLNARYDEAFRAPSMEEMYTTGTHFCMGPMGCNVFKANPDLKPETAKNKEISAQMRFNNVLADDELAFGATYFHNNVSNYIDQQVNMFTTQYVNVTDARLRGVELDARYNWRDLETSLSYAQTEGRDKKTNQPLNNIPAHKWVLGVSHYFMDRDLKAGVNVSHYESQDELPSNVTNVYPSYTLVDLYTTWQPQTGALKAVKVDVGIDNVTDEYYRQAFDQLYSAGRNFKVGVRYSF

SEQ ID NO: 15179 - protein, 843 aa, Myxococcus xanthus
MWAGVAFPSPNLLNLSINGRQRHETMRPNASVLMNEGFLQMNMKHFALATTALVGALSASGAAMAQSTGTEVVEQVIVTASTVRNQNGAIVAQSVPKARSSITQDFISRQIPGQTILDSLNMLPGVNFTNNDAFGSAGGDINIRGFDSQRVALLQDGIPLNDSGNYAIYPNQQMDSELIAKVDVNQGTTDVDSPTAAAAGGTMNYVTRKPYNDFGVTVEGQYGEENFRRFFAVVDTGKVGPWGTSAWFSYANAKNDIFNGPGKIYKRQYNARIYQPIGDNGDFISLIANYNQNRNNFINRMSLAAFQSNTGVGFREDTCARPTPGAGAQIETNPGNCYKYNINPSNTGNLRGQSLFHIGENIIITADPYFQYTLANGGGRALFREDGSNTGSGLVRGSALTGGLDLNGDGDTLDTVLVYGPNTTNTRRYGVTSSLIWKFSDSQSVRAAYTYDDAHHRQTGEYTRFSQDMQPTNVFGGKDGYGEPIKTADGGIMRRRDRVSQATLNQFSAEYRGRFMEDKVLVNVGVRAPFFKRDLNNFCYQADTFNAYCSTQAPTAVAGSDDGAGQTLVTLPGQGTTQYGRPRKFQRKYDDVLPNVGVSYELAKYQTVYISYAETISVPRTDDLYDRKLTRPEPETTQAYDLGYRYQSPTILFAASLYTNKFQNRIERAFNEQDNIAFSINVGDVVYKGFDAQLGYKPEQYLSFYASFSYIDTELKANIPGTTLGSVLPTKGKEVYETPKYQGGVGVNWDITEALSLGVNAKIVGERWTNLTNTEKAPGYSLVNMDVRYELDGLGLKDTYLQINARNLFNERYLGDLAVNPSGTGLGQPGAPRTFVATIHARF

SEQ ID NO: 15180 - protein, 798 aa, Myxococcus xanthus
MSGRNGLRRALLASASIILAAGAMGWGTGAIAQDGGTSNTRAGAAASQAETQGPQLEEIVVQARRVEELQQAVPISISTVTANRLADAAASSVADIQRIVPSLQVGQDSSGQQNFIIRGSFGGFGNDPAVITYIDEVPTESRTLVYSLFDLGSVQVLKGSQGTLFGRNSTGGAVLFFNQRPRLAQTGGYLSGRYGNMNERRLEGAVNLPIGDNLAVRVSGQVERRDGLLKSVTAPGLDFGDRHNQALRASALWQPNDAIENYTQLTHYRQRENAPAQVLYSLAGPCTGPTTPAPVCLYQPPFSSFLGTGNVRAWFDQEQALPAGLTVNNNPNLDSVDRDSVTNAFTADLGKVSVRNIVHYGESTIRFTKDYDGTPVRIFDADHHDEMRNFYTETQLFGRALGDRLNWRVGGVYSHDRDEQAATTIVFPLPASITQPRTGLSDQTNKSSAAFVQGALDLSDWLRGVSLTAGYRHTWDDRKLVQQIHTGQPTPVCALQTLPVPTTGPVPFPSTDLATCTRHLKLKADDSNYNLTLDWKPTDKILFFVSSRRGYKAGSFNLLANDPALVAYAPEVVNDLEAGLKADWKIGAVPVRTNVSVFQSKYTNIQVSTVRVNPANGDISVLILNQDPATGLSNKATVKGFEVEVTAAPTRWLELSGFYSKTDSTYDRFTNPGTTQNLAGQKVSGVIPKTYGATVQAHLPLTGVAEEIALTASYYVRGAPQTNVTSTSFEDKRSSFDARLGLRNLFGSGAELAVFGKNLDDEIACPTNAAVTGAPTRLCGEGRTYGVELTYRFGGERR

SEQ ID NO: 15181 - protein, 506 aa, Myxococcus xanthus
MRARVIGVYQDGESDMDRYNLRKKIGSAIIDADLTDSTLLSVGYEYQKKESDDVTWGGFPLFFSDGTRTNYDRSFNPAADWTFWDTRLQRTFASLQQGFDNGWTLKANVSHEKTEAANHLFYPFYTIFGFDRATGGGVVPYSGNYLTERKADGADVYAEGPFQLFGREHHLVAGASYNRREFTNNGTFDFPAPLDTYFGWNGAYPEPNWSPRTVQSTGTIKQKAAYVAGRFSLADPLTLLVGARYTDWQIDGGNFDAAQGLVPFSDTQTEVTPYAGLVYDINDVWSTYVSYTEIFNPQTLRDANGGYLDPLTGKGYEAGVKAAWFDDKLNASLAVFRIEQDNLGVATGGFVPGSSESAYEAANGVVSEGFDFEISGRVTAGWNTTFGASHYTARDDSGTSINTQLPRTTLKLFNSYTPQGAWSDLTVGGGVNWQNRSYYVDPVYGAFQQSAYALVSAFARYRLSPQFSVQLNIDNLLDKRYYAQFNGGYGAWGASRNGMLTFNYTF

SEQ ID NO: 15182 - protein, 345 aa, Myxococcus xanthus
MKTAFIAMAAALACSGAAYAQSNVQLTGLADMYAGSVKMAGQDRKGVVGSGGMTTSWWGLKGTEDLGGGLKVDFNITAFMRMDTGETGRFPGDTFFSRDANIGLNGNFGRIGLGRDKAPNFLPTILTNPFGDSFTISPLVLHANTPTAAWGGNRLTTPADTGWSNMLVYTTPSFGGLTANVYYQFGEQTTPGNKSKKNVGVNALYFNGPLSLTAFYERDQITNPGSGTVMPTKSDWMVGGSYNFNVVKLYATYGQAKVKDLDSKSKTYSLGLDIPVSGTPGTVKAAVARTKYEAATDATRTTATLGYDHFLSKRTDVYTALMYDRVTDANPKTGTSLIAGIRHRF

SEQ ID NO: 15183 - protein, 686 aa, Myxococcus xanthus
MPTLRPSVVYAALACAFSSLSHADEAAHLSEVTVTAKGYASANVETPASVTAVEREEWLDRGADNVGEALRGQPGLAVASDGAQGQNPVIRGLKKESVVLLVDGMRLNSAQPAGAIASFMSLGLAERIEVVRGPASVLYGTGALGGAINVLLPQARFEAGVQTRAGAEFETANDGVRGTAVMNASGGDHALMLGASLARIGDYRASDGEVDHTDYDSDSFIAQYRFRLDDSQQLRLSLQQHEDRDVSYPGSIKPHPHPQIRSSIIHSPSQTRELVEVGYSRRGSGDTPVNVDVRVYRQEMEREIAARAKGPFGRDFSDTEVTFATDGLDARADWLAHPDHLLSFGVNAWQMEASPERFLSSPPTFARGRNDPFDDGRIEAIGVFMQDDMRFGRLNVLAGLRRDWVEGDADSVNNGAITRGLERSDSATSGSLGAIFEVSKLLRPYANVSRAFRAGEMRERFESSPRSDGYYYVGNPRIEPEIATQFEIGLKGADDDLSYALSAYRTRITDYITGRNVSGAPGTNRCPAANASACKETFNLGRATLVGVEAEARWQAVRGQWLTAAYSRVRGENEDLDEPLFQMPADEMSLGWEGRVAAAWTADATLRLVRKQDRVATVFAAGTENETSGFATADFGATWHGQRQRVRVALKNAFDKPYHEHLTEGVSGMEIDSPGRSLMVSWQGQF

SEQ ID NO: 15184 - protein, 699 aa, Myxococcus xanthus
MDTFKLRQLSLSIKQGFAVGTVALLPFTFPLANAADQSDLEQMETIVVTAQALKVETPAQETPKSVSIITEEELKTRAPQKLDEALRYTSGVTAQPYGSDNDTDWFKVRGFDAATYLDGNRLFRDGYYTWLLEPYGLQQVEVIKGPSAILFGEAPSGGVVNAVQKKPTYTPQGEVKVEVGNNNAQSIGFDISDEANESGSMRYRLVGLMKSADGELDHSESERFYLAPSLEIDISDRTMLTLMATYLKDDGTPTNGFFPAAGTLIDSDFGKIDPSTNLGEPGYDTYERTQISVGYLLEHDYNDTWSLSQNLNYGYNDLLLRSVYAFPNSDPTASELARGVVFRDGHNQSITMDNNAVASWFSDRSEHTALIGLDLQYHETEGEEQDSFAFSSINPWNPDYGNYTPLDPANNIDRKITKSQASIYSQYQIKFDSQWIGLVGARYDWVQTENKSIKGAQDESRDDGQLSLNAGAMYLAENGLSPYASYAQSFEVLSTIDPSTGKLYKPLEGDQVEVGVKYEPSFMNGYVNLAWFDITQKNALVTNPNTFVATQTGELTSSGIEVETVSQVTKSIKVSAAYTYTDAKTNDTGGQGKKQAGLIPEHAASAWVDYNASLAGIQGLNIGTGVRYIGESKDSPASSNLTVPSATLWDAAVTYDITSQWQAQLNVNNIFDEEYVSGCDYYCYYGQSRTVMLNANYRW

SEQ ID NO: 15185 - protein, 419 aa, Myxococcus xanthus
MAWNQPGNNGQDRDPWGSSKPGGNSEGNGNKGGRDQGPPDLDDIFRKLSKKLGGLGGGKGTGSGGGSSSQGPRPQLGGRVVTIAAAAIVIIWAASGFYTIKEAERGVVTRFGKFSHLVEPGLNWKPTFIDEVKPVNVEAVRELAASGVMLTSDENVVRVEMNVQYRVTNPEKYLYSVTSPDDSLRQATDSALRGVIGKYTMDRILTEGRTVIRSDTQRELEETIRPYDMGITLLDVNFQAARPPEEVKAAFDDAIAARENEQQYIREAEAYTNEVQPRANGQAQRILEEARAYKAQTILEAQGEVARFAKLLPEYKAAPEITRERLYIETMEKVLGNTRKVLVNDKGGNLMVLPLDQMLKGGNAPAAKSDNGASNLLRLPPASSSTTSGASNTSSTSQGDIMDQRRANAQRNDYQRQGE

SEQ ID NO: 15186 - protein, 476 aa, Myxococcus xanthus
MKILHVCSELYPLLKTGGLADVLGALPQAQNQIGLDARFLLPAYPAITTGIPNTQVVAEFDNFAGHVVLRYGEYNGVGIYLIDAPHLYGREGNPYHDAYYNDYGDNYKRFALLGWVGAELATGLDSWWRAEVVHAHDWHAGLCVAYLFNKGKPAKSVFTIHNLAYQGQFSYHHLYEIGLPTGMFHVEGLELFGQISYLKSGLFYSDASTAVSPTYAQEITTPEFAYGLQGLLSGLKAQGRLVGILNGVDENIWHPNVDQYIPHHYKLKYMAGKKKNKAELQAYFNLPQDESALAFVMVTRLTEQKGVDLLIESADEIVKQGGQLMILGSGAPHLEQGIRELAERYPQNIAVKIGYDEALSHLMVAGGDVILVPSRFEPCGLTQLYGLQYGTLPLVRKTGGLADTVVDSTSESIKARTATGFVFESATPEALRHCLQRAFALWQKPRAWAMVRTDAMEQDFSWRKAAEQYRTLYERL

SEQ ID NO: 15187 - protein, 833 aa, Myxococcus xanthus
MLGGFALCWVPTQTSFSQDVRTGAVVGTVGVPSGSAAGANVVLRDADDAPAAAGQSRLGDAVGDGGRFRIAGVPPGRYVLRVTLVGYERAEQPVQVRRGDTTSVDVELRRDRARLGEVTVRGGGSLTQQSTEAAAEQVRQVPGGANLVSLQDRELRPIATVASALEDEPGVVVQEFFGGNDQPRISIRGAGLQSNPQSRGLLLMHNGFPLNFADGSFVTGLVEPRMARHAEVYRGGNALGPGGATLGGAIDFVAPTGRSADGPQLKLTGGSYRTASGHAQYGWAGANTDVFVMGTGHRHDGFRQTNDEGERLTGHANVGYRWDDNLETRVYGTVATLGFNIPGPLNKQQLDADPTAVSRGVTPPRSLGPNVPLDRPRRETELYRAATRTTWRTGASASGHEVSVRAGAAYQYVEDDFRFPVGTGVRSTRSHDVTLNLDARRAGAVLGGEGTSVLGVSATLGDMDRGYFANERGRTGRRFADNEMQASTVRAFARQRVQFGTRLAATASISGILARREIDEALSSTSQRARYVAPKDKYVSFASSPATLDETYRGLRPAVGLQYAAAPALDLFAGVTRSYEPPTFNTLLSPSGGNPKKGPGQFQPRVLDAQSGTTVEVGTRRTRGRLQWDVVAYRTWLKNELLTTAALFGGAGSTSNAPVRTIHQGLETHVDLRLLDGMLADGSGAPDQLALEATYNLNDFYFDTDARNQLAGVPRHRLHAQLTYDHPVGLSVTPDLTWMPQRTPTDHANTIYQSPYALLGARAHYTVGPGWLDAGQLAVFVEAENLTGTTYASSYLVRDQVPNPPPAPLTSADVTSFIPGQGRTLQIGVTVGW

SEQ ID NO: 15188 - protein, 824 aa, Myxococcus xanthus
MRAETSWRAIAVALGLSGATLPAMPFVAGPALAQSAQSQAAPEAGGAIELPTVEVVATTPLSGTGIDVDRVPGAVTTISAEEFNRLQSFSTIDALVQYTPSATSTDVQGNAFFQDFRFRGFAASPLQGTPQGIAVYQNGIRVNEAFGDTVNWDLIPEVAIDRAEVFSNNPAFGLNALGGAVSIQMKNGFTYHGFEGSVQGGSFGQIGGSIQYGGEKDGVGLYIAADAVRDDGWRSHSPSELARFYGDLGWKGDKGELHLVASAASNSLGVVGPTPVEMLAADYNSVYTWPQTTQNDMGMLALNGRYDLSDTWQLQSNLYVRRFKQSHVDGNDADLENCSNKWNPGVGNTKMCLEEDQFTGPTGGGNPLSNPQYAAFRSQMVLYDQNGNTIPFNELASNQLYGVINRTWTDTTTYGGSVQAVSTDKLIGHDNYFVVGGSVDYSTVNFKSTTELGITDINTLGVAGTGIYLQNRPNYSLPEEYQVFYLPVNLDATTTYYGLYATNAFDMTDRATLTMGARLNIAKISMQDASGISPQLNGDYTFARINPIIGLTYKITSDVTAYGGYSESNRAPTPLELNCADPNRPCLLENSLVADPPLEQVVSHTYEAGLRGASTLFGGNMSWKLGLYRVDSDNDIIALASEQTGYGYYTNVPATRRQGFEAGLQYVNGPWKLYANYAYIDATFQFSGTLASPNNPLATDGEIFVTPGDHIPAIPAQTLKFGLDYMVTDKWKVGGDVIAVSSQYYAGDESNINPMLPGYWVANVRTSYQITPNIQVFGLINNLFNQKYASYGTFFDTGYLGLSNAQMQTPGQPLSAYAGMKATF

SEQ ID NO: 15189 - protein, 832 aa, Myxococcus xanthus
MDLSHQYNIIHNIYEHTHNYLSLFPKKCKNYCIIILLCMCYILFNYEYSFSVKPTRQLSTNSDSSVEQQSEESSSSSEEEEGNPGSDSRNQFLLLWEQETSNVKEQVFPLQEESSSSKEFIDKAVQTGEDSSQSSSQSSESSTSSTSAALGTSEMFFLSESEEVQEVIITSSEEQMQQEVISNLKKKVKKLKEKLQQERKRHQQQMDKLKTCAVRQVQFLQSMVKMAQHQIQKVEIEKLEAQQVAALFQEALLGQEAQSQSSTSRSSVIISPPHGEENKSPCSPLSREDEGSDDSMPPLEGEEGDIWRDEYVSQEQRSQFFLQQQQQQSSSLSEVSQTGVVGSSRGLPTIQEEDEDGSSCSSIEGYLSSPTPSVLIAEEGSGSDLEESVKSPSEHPSGVDSDTLEEGEVIGEEVQGPLTTKRPAPSSSSDSSDDESLSPVVKRLKQSSSSPPKSPGSPSSRGDMSSMLIPGYNHESQYGSLKGLQCVLFGAVEQMSANLKTLVLKTSLYQAETKDKKTSSLIAKESKKACMSLCGKERSVKKVMSDSSNLLSFLNTCHFFGYTDSYLANQENKVSSGKVGLLMNPISNVSIGLTYNRHKNHGKEYHGAQLGTSFGSAKANMELDGFSAVVAWNSEEKGLTGYLSGCHNWGQMKNTRQVMQAGKEMRTKGSPDVQLSGVLGQLGYTFPLSKKVSCVPYIEATHIVVKWNQYREDSGSLPCVISGYTEKFQEKTIGLRTSMKITDKAILQTWVAGGTVQHTTSNITSMPLASPLLLYKTSVPGNKKKSFYSECGTLYEMNVTDFCKVDLHGSLRFKKDQKLDAGQMRLHFQYLF

SEQ ID NO: 15190 - protein, 273 aa, Myxococcus xanthus
MRTYLLSILTASTALTFASYAQAADVIYEEPMAPAPMEISPVASGWTGIYLGVQGGGAFNPQDPDNVDLRTNGFAFGGSAVQTAFGSNFDSNVDSSFLGGAHIGYDYQMDSVVFGVLADINAIDLTRSSNADSNAPAYYRTDRELNYLGTVRARVGYLVTPDALAYVTGGLAYGDVDYSFSTNSPAVTGATPAVVSEDEDSFGYTVGGGMEVKFTDNMSFGAEYLYTNLGGSGYTRLNGGPAFSGGVGGSTDFVVDDDFDFHTVTAKVSYKFN

SEQ ID NO: 15191 - protein, 902 aa, Silicibacter sp.
MNYYLYCLRRFARLILLLWIVFRIAPLAAQDRAARLDFQVRKATLDTFVRQLEDSTGFSFIYGEKVQLRQPVTLDVRQKTIEEILQYAFGQEAITFKISGTHILLGERPVSRKYTVSGYITDSISSETLIGANILESSCHTGTSTNPFGFYSLTLPEGETGLFFSYLGYETKHCRFLLSRDTVMNIRLQTNNQLSEIIVLSDKKETGIRATGMGTLDIPMTQIKNTPAILGEADILKTIQLMPGVQAGTEGFSGLYVRGGGPDQNLILLDGIPIYNADHMLGVFSIFTPEAMKKVTLFKGSFPARYGGRLSSIVDIRTNDGDMQNYHGTVSIGLLTSKLHFEGPILKDKTSFCLTGRRTYLDLVARPFLPEDKKYNYYFYDINTKVNHKFSDRSRLFLSFYKGKDHYDYKQDKEYDGYSNNYGASMYFYNSQIDFNWGNTIAAGRWNYVFNSKLFSNTTVAYNHYQMSMADAYRKDIIETDKNGNLITDKNESYVYNSDYRSGIHDWSFHTDFDYMPVPDHHVKFGVSYLYHTFRPEVTTSRVKEAADGQTAQDTVYNDSSNSYLHGHEFSFYTEDNADIGDRLSLNAGIHLSLFSTQGKGYLSAQPRLSARYRFHDGFAAKASFTQMEQYVHLLSSSPISLPIDLWVPVTKNIRPMRSYQYAVGGYYTGVEGWEFSLESYYKDMHNVLEYQDGATFFGSSGGWQEKVEMGRGRSFGLEILAQKTIGKTTGWLGYTIAKSDRQFKDGTVNNGERFPYKYDRRHNINLCVNHTFSKKTDIGITWIFNTGGTATVAEQRTGTASGNLIDYISHRNNYRLPVSHRLNLSINFHKKLRHGMQTWNISVYNAYNAMTPNLIYKEEEYIGVEHIKPDGSHETAWKRKTKLIKQTLLPCVPSITYTYRF

SEQ ID NO: 15192 - protein, 301 aa, Silicibacter sp.
MKHWMCAAGALALTGAAHAQSSVTLYGLIDTSVRYTTHENANGSGKLQMTEGLLTGSRWGLRADEDLGGGRKAFTQLESGFSPDTGSSLQGGRLFGRTALVGLKGDWGTVTLGRQYTVAHDVMSSYESMALANVSIVGYQGGNYTGLRQDNLLKYTYTLGPWQTELGYTFGEVPGSTRAGSTAAAALIYAQGPLMLAGVFQQSRDVTTSFFGLSIPASRQNVWSAGGTYQLGKSMLYFGFTSSALDVADYRNRAVYIGAKVPLTPALTFITTLTGDRVKHQGRRRQPLHRGRNARLQLRQT

SEQ ID NO: 15193 - protein, 184 aa, Silicibacter sp.
MKTLTIAAASLLAIFASSNVAAANDHSGFYVGGSLGQLKVKTEDSDNGLGFGAYGGYNFNDWFGLEANMYLSGDLGGNGYDLGAGTFAFTPKFTYQINDTFAVYGKVGIASMAVVYRPDRGIDEDFTGFGWVYGVGVNASITENLNIRLGYDIVKGDLDSEYSFSEQNVDTDISNFALGMHYQF

SEQ ID NO: 15194 - protein, 823 aa, Silicibacter sp.
MQIIPISYGTSMHLPTLTPARSILALAICLACNPVMAVEPTTATDNQATATYSFAIARQSLANALDQLSTQSGLQIAYSAALAQGIESAGVSGRMSAEQALGKLLAGTGLGFERNGANAVLLTRLPQSSQAVELEATQIVSNQLGTVTEGSGSYTPGTIATATRMVLTPRQTPQSITVVTRQHMEDFGLNNVDDVMRHTPGITVSAYDTDRTNYYARGFSINNFQYDGIPSTVRNVAYSAGNTLSDMAIYDRVEVLKGATGLLTGAGSLGATINLVRKKPTAQFQGHASLGMGSWDNYRSELDVSGPLTETGNVRGRAVAAYQDKQSFLDHYSRKTSTYYGILEFDLSPDTLLTVGGDYQDNIPKGSSWSGTFPLINATGGHNSMSRSYNNGATWSGWEQYTRTAFAMLEHDLGDGWVTKLQLDHKINSYHAELGSIQFDEPQTDGTAKVNAQKYTGDTTSDSADLYLSGPFNLFGREHELVLGGSIANSRWTGKGYWSPDFPGGKGNVVDFYNWHGKIERPIWGLPAQRTDDTVRQTGTYMTTRLNLMDDLNLFLGGRVVNYHLTGLTPSYKESGRFVPYVGAVYDLDDHFSVYASYTDIFMPQESWNKDKDSKLLNPDEGQNYELGLKGEFFEGRLNSSLAYFEVHETNRSVPDDAYNNQSPTPDNYAFKGAKAVTKGYELEISGELSPGWQVQAGYTHKIVRDDEGDKISTFEPQDQVNLYTSYKLKGDLDKLTVGGGLRWQSEGWYSVYNAPRKINEDISQEAYWLVDLMTRYQITQNLSATLNVNNIFDKSYYTNVGFYNSAAYGEPRNFMLSTRWDF

SEQ ID NO: 15195 - protein, 223 aa, Silicibacter sp.
  misc_feature (12)..(12): Xaa can be any naturally occurring amino acid
NEATRPGVRAQXDTVPSRHEINAGGSALWEETDTAYSMALTSISTNIYRTAYTAPLANTFNGGNVGNPQPINDTRLYSLFFSDTMSFFRDRVALTAGFRYQNMLIDGYDYVPSGRGPVNSRYDQDAITPVVGLVVHPTRRTALYFNRIEGLSPGQTASGNVVNVGQVFAPYKSTQYEVGAKYDTGRFSTSLAVYEISQPNAYTQAIGNTGTYRFTEDGLQRNR

SEQ ID NO: 15196 - protein, 313 aa, Silicibacter sp.
MKKILFASTALVATAGVAAADVSFGGYGRFGVGYVEDRTVGGTSDTVIVSRFRMNIDASAETDAGVKFSARVRMQADEDAASGEANAAGLNGARFSVEYGGLRVDVGNVAGAIDNLPNYYGNEPGLETFMGQYSGADYDFIGYSSGGAGVNGVYARYAVGDFAVAAAYDQAANGADGDRFDIHAAYTFGNITAALAYGETDNGAAADFDMTVLTLGGSWGAFSGTLIVGDESVAAVNESDTFYGISAAYDVSSATTLTFAYGDGSGDGDTRNIGLGVIHDLGGGVSLRGGIGESKTGNADGQMRADFGAQFSF

SEQ ID NO: 15197 - protein, 179 aa, Silicibacter sp.
MIEDTLSISARLKYYDKAASDLKWPTPVWNNNNQKPDNYQQRPDNYQIAIHSPGAFTSLGFGSRLNWTVDDKNNIYFDIERYINEISVNSISSRAIKSEKQLFKDNIVLNHDGNYDFGSTNSYLQYGSTKDKELHSQIWVGEGKVVLPWNLGQYGNLVNTFGARIDYEMLKNDQASAGS

SEQ ID NO: 15198 - protein, 1100 aa, Sphingopyxis alaskensis
MRNMNYTLKNNHASPRNVKTGGGGLWKKISFLMLCLLVTVQITAQHRPVSGAVIDGNGEPIIGANVIEVGTSNGVITDINGNYSLSVSSSNAKLQVSYIGYITQESTVKGSILNFTLKEDTQTLDEVVVVGFGTQKKVNLTGAVGIATAKEIESRPVTSATQALQGLVPGLKIATNSGQLEKDMSISVRGTGTIDDGSKGSPLILIDGMEGDINTINPQDIENISVLKDAAASSIYGSRAPFGVILVTTKKGSKGKMSVNYNNSFRISSPMNLPKGMDSYTFANMMNEAARNQGVNPDYTDEVMQKMLDYQSGKLQYGLDAVADGSKWEDRWTKGYANTDIWDAMYKDQVFSQEHNISLQGGTSKVTYYASFNILDQGGLLNFGKESMTRYNVNAKISTQITNWLKFNYSQRFTRRDEIRPTSFYGDDNDTNSFWGNLGRTNWPNMPIYDRNGHINHDQIRQLVEGGERTVQRDRNYYQGSFIIEPIKNWVTNIELNYSINEISTKASTTEYYNYNPEGEKIVTNNIHSRLKENDQKENYWGLNIYSTYNHTFAEKHNFKIMGGFQAEEWNYHYFDVTKYGLITEDLLEFDLTSGLDATGKEIATEVTGNSKDWATAGFFGRLNYDYQGRYLTEVNLRYDGSSRFRRGSRWQWSPSFSLGWNIAQEKFFEPLNSVVDQLKLRFSYGELGNQNTTNYYPTYRKMKLEAGKGDWIQGGVRPNTAEVEELISSTLTWESVRSYDIGLDFALFNNRLSGSFDYFKRYTKGMVGPAPQLPVTLGLNPPKTNNCDLQTRGWEVSLTWRDRLNNGLGYGITATLSDQTTYIDSYPGNKTGSIDQYMKGKKIGLIWGYETIGIAKSQEEMDTHLASLPKGGQNDLGTQWAAGDIMYKDRNGDGKISEGSRTWEDHGDLKILGDKNPHYFYGIDLTADWKGIDLRCFLQGVMQQDFWPGGSSYFWGVLGGKSKWHTIGLEEHNDYFRANPVGLVGYEIPANLDSYYPRPIFSSSSDGTSYGAKNQKTQSRYMQNAGYLRLKNLQIGYTLPSTWMQKVGMSKCRIYVSGENLLTFTSLSSIFDPETCTGGWYGNAYPLSRTWSFGLSITL

SEQ ID NO: 15199 - protein, 453 aa, Sphingopyxis alaskensis
MIRSVCYAGAACALLGAAGICHAAGFKVSEQGAKAMAMGNAFAAQADDPSALYFNPAGISFLRGAQANLGSLVILVPQTEFHGTTPLSGTPPLDTGTTHVTEKSRRDIVVAPTLYATYSMDRLPLSFGLGINAMYPLAKSWDDSSVFRNQVQTASIKPINFQPTVAYRFDDLKLAVAGALDVTYAVVSLQKMTYAPAIDPTAPAPPFGAYELGSLGLDGTATGVGYNFGILWKPRPQYSFGVAYRSRITLDVNGDANFLATTPTGLGAIGFTAAAPFPYTRARATSAASTRIVLPDTLDLGVAWHPTEKLTLEFDATRTGWSSFDQLLIEFDSPEFAAFNNRPDPRDWRDVWGYKFGGQYSLNDVLDLRAGYSFDNTPVPDATLDPLLPDADRHSFAVGAGIHHSMGTFDLTYMWVHFVDRTVNNQDMAALRGSNGTFKSDAYLLAANLNFKF

SEQ ID NO: 15200 - protein, 843 aa, Sphingopyxis alaskensis
MKKTHTFKAKDQWLKVALMMSASSAILSGANAYAQEQATEAADDLETISVIGSRRLGRTVEDSPVPIDIIGADSLSTTGQTETNMILGNLLPSFNFPQPSLTDGTDHVRPAQLRGLAPDHTLVLVNGKRRHSNALLNLNGSTGRGSSAVDLNAIPANAIERIEVLRDGAAAQYGSDAIAGVINIVLKSASSGGSASVTYGANVTTMDGVPDLKDVGIDDNGELAFTEGGDRELTDGQTATMRANMGFALGDDGFFNLSAEFRDRSASNRSDYDQRENYSRLEDGSLDPRELTWDRYNHNFGNGDVEDMAVFYNAGFELNENAEIYSFGSYSTREGEGGGFYRRAQDSRNIEAIYPDGFLPIITSDINDYSFATGVKGFMSDWNYDLSAVYGEDEFEFGVKNSLNTSLGPTSQTVFDAGTLIYDQLTINLDLSREIDVSGLASGVNVAVGAEYRREGYEIEAGEEASYVQGTFGGSAGSQVFPGFTPESAGDNSRHNVSLYVDLEAYITDNWNVTVAARYEDYSDFGSTVNGKFATRYTLTEEIALRASVSTGFRAPSLQQQYFTSIATVFVDGEPTETGTFAPNSDVAKALGSPGLDAEEAVNYGAGITWSPDSNFSVSVDYYNIKIDDRIVLSNNLSGEGIETLLAGTGANRARFFLNAIDSETSGVDVVASYNTDIQNWGDVAFNAGFNYNKNEVTDIIDPPAVLAGAGVDQGNLFSDVELRRFEVGSPKTKLNLSAVWTMDEWHATLRTTRYGETQEPSSDPATNEVLPEKWVTDLDVGYDVTDNLTLTLGANNLFDVYPDTTRELVEDVGTFSRLFPYSGFSPFGFSGRFVYGKVSVTF

SEQ ID NO: 15201 - protein, 748 aa, Sphingopyxis alaskensis
MSIPSSFRRTTLLFALSFPIAHLFAASPAPEAPPATTPASNTPISPTAAVPPVTLPEVIVTAARTGESLWDTPDTVTLLDQETILRHQAQTPADMLQEQPGVFAVSVAAQGSPIIRGQIGNRVLYLWDGVRINNGSLFAGPNGYFNQFPLGAVDRMEVIMGSGAVQYGSDAIGGVINILPKKATFTDKFTIGGDLDARYSSNTDEHYESFDLNISGQRLAFAGGLTWQDVGNYHGPEFGALSPTSYWGFGGYADLAWQPFDNQTFRLSWIGNEREDVSSYIQSKLNANGIPRVYNPLERREIVKLDYTATDLGALSSEFKIYGYYQYYNQLSQRRIENFPTFANTTTDATQSVLGVGIQNTTTWGQAHFTYGVDYRHEKLSSSLDQQLLNEATGESDDLMPSGKTPNGTYDVLGAFLSGEVRPVQPWLLTAGIRYENTHIDSHPLDTDVIPNAGYTIDSLSLNRSWNSVTWDAGTIVSVTRSWDLVANVSTAFRAPTYSDLFSSGTPVFSSKTASIPSPTVDPEKSITYEVGTRYHSDRVTASLTAYTEQLYDTVQTIDAGTVTIPGQGTFIASGRNNSGAGYVRGVEFSLAVHPAKGWTVFGNGTYTFGQDTSNDVPLRFIPPFYGTAGIRYESPSKRWWVEASEYMAATFHRPAPQDLLDAGFSKDPAFGSPNTTNNPPYRDDFSIPAFAITNLRAGARLWEHEGRALDVMLTLNNLFDHKYREVYAQQELVAPGLGVSVGARLTF

SEQ ID NO: 15202 - protein, 908 aa, Sphingopyxis alaskensis
MKSSRLIQKTPIPAKLALCIASALALSGLSGHVLAAGCSQSSSTQFFCDDTTIYYFGNPLNGGSRDYTTFDEVLINTSQNGITTPLQGWGVYLDSTGYKFKDLVINTTGSEADGIHSKNVGGRLEAENIKITTTGTSSDGINLGRELNSAYSVVEVSGNVSIDASDGMGLRANISRVNTSAKSSIIIHGNADVVTRGNGGANSGYGIYAGKDPGDLFGSAAGVADVTINGTAKITTSGSNAHGVYAGRKGEINLNNTDITTTGNGANGIYAYANSDFSRVNLGGNTTIKVTGNNAYAMYAYQSKGLIRSWDAATDTASSGIYDIEGNLYARSSGIIDLTMDDGSQFVGIANSSQLENTTSLRATINLNMNGANSEWTMTGNSVVSTLTLNQATLRYSADGVSRDDESTFKTLTVMGNYTGTDALLVLNTVLEGDDSFTDKLIVKGDTSGNTNVGINNIGGVGDLTLNGIEIVDVEGVSDGTFTKAGRIVAGGYDYDVVKNASNWYLTSQLSPVEPEPEPEPEPEPENPDPVDPPTPPGPVDPVDPPAPPGPVDPVEPPTPPGPVDPVDPPAPPEPPLPPAPEPGEHQYRPEFGSYLANNYAANTLFITRLHDRLGETQYTDILTGEQKVTSMWMRNVGGHMRFTDGSKQLKTQANRYVLQIGGDLAQWSSDGLDRWHLGVMAGYANQKSKTHNTHNGYASRGHVNGYSAGVYATWYANEADKTGTYLDSWVLYNWFDNTVQGDHLASEKYKSDGITASIEGGYTFLIGESERTSYWLQPKAQVTWMDVQADSHRESNGTQVKDKTDGNLMTRLGVRAYLKGHNAIDDGKDREFQPFVEANWLHNTHNQSVQMGAIRDEISGTKNIGELKVGMEGQINPRLQVWGNVAQQVGDNSYSDTAAMLGVKYSF

SEQ ID NO: 15203 - protein, 76 aa, Sphingopyxis alaskensis
MRPFAAVVYRGTWLSGWWCNEPITDVVRRLNLSADGEAGMNLLARSAVTQARQRVGAAPVEWLFRQTAQTGARNVT

SEQ ID NO: 15204 - protein, 376 aa, Sphingopyxis alaskensis
MKLRYFTSLVVTMVIIAISTAGAAEFYKENNNNTLRIYGNITEGQIFVENKTNSDNHMSMKYGLIGKTYITDKIVGFGVWEQEFNLKNTESGVNLKNIAYPILGYIGIKLGDFGSIDYGRNYGVLYDVDSWVDLMPEFGGDMSIPDNFLTNRASNVVTYRNINFFGLLDGFNFAVQYQGKNDGSSDTGRTVKTENGSGYGVSASYALGNSGLSASAAYINCVRTVDQKSLDGAYTSDLAEAYSMGVKYDAYGAYLAAVYGESYNLMPFGNFDDVLNSEIIFGFVNKARNVAIVAQYKFDCGFSSLVSYLHSKASDVENGYGNYLKKCVTISSSYLLSKQLSATVDYRINLLHKTDFTTVAQINTDNMIALGVSYLF

SEQ ID NO: 15205 - protein, 689 aa, Sphingopyxis alaskensis
MTLEELSVEHVGEGAGRTTASGRGTIGLIGPTPGYGAGAAVSATRTATPQIDVPVAVSVAPRETITDIAATRVDRVFDYLPGVARQNNFGGLSIFSYAIRGVTTSEIYKNGFPLNRGTPPPPDAQNIERIEVLKGPGAALFGRSDPGGLVNLITKQPTAERFVEFGNQVDSFGLTRGTIDAGGALSADGTVLYRFNLAAQGAGSFRDFVDSDRLLVAPVVSWQVTPDTRITVETEFVRNRIVFDRGVIALNRQLGFLPVSRFLGEPGQSTYQNNNSLQVRVDHRFDENWQLRLATYFNTGDLAGESAEIRAIAADNRTVSRDRNVRDYRWDVAVGQADLVGRFDTAGIGHTLLLGMDRESTDSRTQYLRSNFRTSPFALDIYAPVYGQALPPITVPRNNLERITNTGLYAQDEIVLSPEWRALVGVRLDIFEQSFRERAVRSQVDQSRVAASPRAGLVYRPIPELALYTNVGTSFRPNTGPDAAAVTRGTALPPETGLGYEVGAKSELFGGTLLLTAAAFRVERENVLTPDPANTGFSLAAGAVRSQGFELTAQGQITPELKLLAGYVYADARVTKDNVLPVGAPLINVPRHSGSLLAVYEPEGAWRGFGVGGGVRGVGARAGDAAGSGFTLPAYVAVDALAYYRFDNARIALNVENIFDTAYYESSLNVFRVYPGSPRRFTGSVTVRF

SEQ ID NO: 15206 - protein, 934 aa, Sphingopyxis alaskensis
MAEHPANTASTTSRNDAAGRGAPAADAPESGVKTLDAMQVTGVRRANAAAVESKRAATNITDVISATDVRALPDSTIVEALRRVPGLSVLPATDNEHPRDEAATPVLRGLGPSYNNVTIDGLTIASPGTPNGTLGSITRGVRLDLLPASMVSELQVVKTFTPDLDPNATGGAINLKTRSAFENGGKPFFSAEAALGHANDVGKPRDQDDPGYRLNATGSRTFGSEQQYGVTVSANYQTLSSYTETHMTTDTVHYGFYDNSGVLQTGDSLGNGWAVPQQDKYWYVQDQRDRYGLTGKFEMRPSAALEAYAMAGYYYFKDDMERNEVIIDPRNRGRVFNQTATSGSYPGGDIEVGYSNQVVTTRTKVAQLGTIWRPTDRQQFSARGAWSDATYDEPIRMIKYATGITRPAPVPVGQTGSGVTVNATPNYAFNYDTSGFDQRFGVSPQAYDNLDNYSLSYWRPDYQRTASDRILTGRLDYGSNQGESDQGIGLAAGVSYTTDKPSYEIYRVEYQPNTTAPAFGLADVVGTGRAPMRYAGLNLLSIDPNKANRVLAAAPLSAFNSTDQQAFSNQDNFTHTEKTFGSYGLISYRSDRLNVQAGVHFDSTKLDTVGRQRQLDAATSHYVYVDNPTSADYDYLLPSAVMTYHLTDALDLRAGASRTLGRPPYDAYAARTSIGFVNTTDAGNPNAQGVTVTIGNPDIKPRVSNNLDLSLEWRLPGDFDAFASAAVFDKHIQDEIFTLSRTDSFTFDGTTYANALISTPANAAKARIRGVEFNGIVNTLGPIAPWLSGVGFSANLALLDGSLDVPYSVGSGSSLTQRERKLDNLVGQPDYTANATLFYNAGGLELRAAYNRQGKALRSIVSNIDWQDLYWSPRSQLDFTATYAVSKQLSVIGQVSNITHSRITSVTGPVQNLLKDSYSVPTTYWVGLRFTPTL

SEQ ID NO: 15207 - protein, 934 aa, Sphingopyxis alaskensis
MSMKLDLGKVFFFILLLVLSTMTALAGNIKGTVLDKQTKEPLTGATIQITGTAQGAVADIDGNYTLNVKDGTYTIAVRYIGYKDILLNSVKVKAETVLNFEMESDAQTLGEVSVTAQAKRNNEVALIQEQRRSLVVQSGVSAQQIAKTQDSNASEVIRRVPGISIIDEKFVMVRGLSQRYNNVWMNGSAVPSSEADSRAFSFDIIPSSQLDNMVIVKSPAPEYPADFTGGFILINTKDMPGENSFNISVGGAVNDQTHFKDFRKAKGSGMDRLGFGNGFRSLDAGMKGTLNMYPGYETGNTARIDVLNNGFNNDWTLKTIKPVGDLKLNMAYNRKWETESGRTIGMLAAVNYSNSYKTYLDMENSLYGPYDTNNDKYVYLRKATDNQYSNDVRLGALLNLTFQPRNSNHRYEFKNIFNQISKDRYSERTGFNAQPDNINNMEYYYSSRTTYNTQFTGRHNFDDSRFDWSVGYAYANRNLPDRRLIERTDRTNETMGIYRISREFTKLDEHIGSANINYRQDFQFGDIAPTLKAGAYGEYRTRTYNTRQFQYGWQPNNSLPKGFQFDNDVANNILIDSNYGIDKLYMQEEVNYMNNYEGKNTQLSGYVGINVPIGSFNFYAGARYEYARQELIMNTRSYEESLQSTFYDYKDLFPSVNATYKLSEKHQFRLAYGKSVNRPEFRELSTSVYYDFDLGSSVMGNSSLQAAYIQNVDLRYEWYPSNGEQVSIALFYKHFKNPIEWTYTMSGGTDPVYSYVNAKGANNYGIEVDIRKNLDFIGMRNFSFSFNGAWIKSKVQFKEGGNNIDRPMQGQSPYLINTGLFYNNPDKGWNAAVLYNRIGKRIIGVGNRYGSSSEGDARNIPNSYEMPRNSIDLSASKKFGKLEIKATIRDLLAERYYFKQFEDVTVNGQARTIEEVTRSYKPGRSYNLAIAYSF

SEQ ID NO: 15208 - protein, 254 aa, Sphingopyxis alaskensis
MGRILMKKLTTALLPLALLVTSFGAQAATSDGNNFAVSAGWAHIMPQGTKQGVNSTSSIPYFNTFNSAAGFELDNADTAEFKLDYLVNDNVTVGLILGVPPKVDIQGKGQLLAGALNLDSFSKVGDVKVYSPVLTGKYTFGSVNNKFRPYVGAGFMYASFRDFKLNPEVNAKIAPLGGTISNVDIDDAVAPVAFIGADYNITPNWFATASVSYVHLSTHANLNVVNPANVTFVQGSSKIEINPIVTYLGVGYRF

SEQ ID NO: 15209 - protein, 158 aa, Sphingopyxis alaskensis
MNKLVLSSLLLAALPAVVFAGTPSLQGSILDANIHSERWQDGDYLFGDLGGLRSRLAGSGVTYDSYYVANPAGNVSGGKRRGFTYVDNFYFGITFDLEKLFAWRGAQLAASVINRSGGGSVTNAYVGSQYDVQQSTEARISSFTISPSNKSSGAINGS

SEQ ID NO: 15210 - protein, 1068 aa, Sphingopyxis alaskensis
MKKLLQSLFILVLFAGSAMAQERTITGTVTDKGDGQPLPGVTVRMKGVQGGTQTSSDGKFSLKANSSVTELEFSYLGYLTQTVSAASNVVNVALVADSKQLSEVVVTGMGVSREKKALGYNVQTLQADDLTKASNPSLAGALQGKLSGVEIKPSSGMPGASANITIRGARSFTGNNSPLYVIDGQPIASTSNFSTGNSVTGTDIANRAVDLNPNDIESMTVLKGQAASALYGIRASNGVIVITTKSGKGLAKGKPVISFSSNFALDKLSRKPELQTTWAQGTNGNFATPTSMSWGPRIDDLPNNPTVGGNVANALNGGTLRPGKYYVQQRADAGLDPWVTPQIYDNVGDFFELGTTFNNSLNVSQATDNGSFSIGLGNTNQKGIISSTGLERYNAKISAESNLSKSWKVGFSGNYVQSDIDKAPSANDGLLATVYGAPAHYDSKGIPFSTPSDPYTQINYRASNFNNPYWAMENNVFNERTNRFFGNGYVNFNPDVNWGRDSKFNVKYQLGVDSYSSNYRDIFEYGSGNTAGSINNYGNTSAVYNSLLTATYGVKLSDDFTLNALIGNEINHENNKTYDETGYDFNFGGWKHIDNATSRNATEARYQYRTVGLFTNIDLSFRNMLYLTLTGRNDVVSNMPRDNRSFFYPSASLGFVLTELGGLKESETVNFLKVRASYAEVGQAGNYLPNYYAEPVYGGGFFTNPGVVFPIDGDVAYTPYSTLYDPNLKPQNTISKEVGIEGRFFNNLIGIDYTFSRQDVKNQIFPVPLAGSTGADELIMNGGKIHTNAHEIALNVNPIQKKDMSLSVGFNFTRIRNVVDELAPGVESIFLGGFVTPQVRAGIGSTFPVIYGGTFLRHENGGILVDEDQFLSDGTTRNPYYGTPLTGGPDVIGSVAPDFLLGSNATFRYKRITLNTTFEWKSGGSIYSGSNGLINTYGVSKVTEDRSTPFVYPGVKADGSPNDIVRGGSSDPNAYYNLYSQVLGNIDEAFIYKSSFVKMRELSVSYKLPEFNKLSLNVSAFARNILIWSELPNFDPESSQGNTNMGGAFERFSVPQTSTFGLGLNLTF

SEQ ID NO: 15211 - protein, 2848 aa, Sphingopyxis alaskensis
MMTRSSSKRTILAGSSLLVMAIAAAQPALAQDTTISSSITTGSTWNGTTAPGSNFTVTSSGAINTADPAAITVAGTVGALLGTLLNSGQILDAAASGYGISIGSVSVGVVNNSGLISGASAIYNTGTLGAVSNTGTVSGTARGIYLSSTGSIGSLNNSGLIAAGTLGSMAAGGIANSGRIGTIVNNGTIISAHSSGIGNNQSTGSIGQLVNNGLISGVTGGIWNQGTFSQITNTGQIVGTQAGIFQVAGVLSALDNSGTISGGSYGVSIGGGNVGTLVNSGLLSGPIALTIASGATLGGVANSGVIAGNIVNRSVNVLTITGGTGTQIGTLTGSTLTNQGSIINTVSNLVFGSGNLLLNDNINVTGRTVSNVGAALSLNSIVNVAGAFSQTAGSLQIDPMTGGLIVSGGATFSGGTVKSTFQSTGNYLAGSYTLLNASSLNLTGATVSINSLTGLYKSTSTVGNKLLLSVNNDYIGGALASLTNAAALTSASTGLYVATTGSIGTLTNTGTLGGGQFGINNRGTIGTLLNAGRVTDNSFTALWNQGSIGQLINTGTIINSSWAILNTGNLATLTNSGLISGAGNAIQNSGVITLVNNSGTMSGGSNAIAGNFGTIVNSGVILGDINKYGGSIGAIIGGANGTIGTLTGFTVGTQGTIGASSNLTFASGALLLNDSITAVGIAASALTVSNTGADITLATIVNVNGNFRQTAGTLTLGGTGKLVVTQAASLTGGAITTSTGGLSSSSTYLKGAVGGTLVAGGAGSSYSGVNVSITSGFTGLTGASTTSGNNLLLAIANDYVGDTQVSISNSGSISGVSYALYVAGTGSIGTFTNSGVLTGLSTGATNNGSIGSLSNSGLISGAMKGLGNQATIANLTNTSTGTILGGTAAGLQNDTWLGTLTNAGYISSGSAGFANYGTLGLLTNSGSISGGPQALYLVGTVGTVSNSGTITSGQTGIYVGATMSALVNSGFIGNTSNALNLGGTLDTLINAAGGTISGGNALYMSGSLGGFANSGVVKGKIDNQSVNNLTITGGAGATVGTLTGLTGVGTINNTLSNLIFASGNLLLNDRIVATGHTVSNTGANLSLTSNISITGAYSQSAGTLNLIPGASSLIVIGAANITGGTVAASLSATGNYLAGVQTLVSASSLNLTGATVSINSLTGLYKSTSTVGNKLLLSVNNDYIGGALASLTNAASLTSASTGLYVATTGSIGTLTNTGTLGGGQFGINNRGTIGTLLNAGRVTDNSFTALWNQGSIGQLINTGTIINSSWAILNTGNLATLTNSGLISGAGNAIQNNGVITLVNNSGTMSGGSNAVAGNFGTIVNSGVILGDINKYGGSIGAIIGGANGTIGTLTGFTVGTQGTIGASSNLTFASGALLLNDSITAAGIAASALTVSNTGADITLATIVNVNGNFRQTAGMLNLGGTGKLVVTQAASLTGGTVSTSLSSTGNYLAGNTAGTLVQGGAGSSYAGVAVTGGTPGLALSAGASGNNLVVTADNNYVGASLASLSNTGSLTADYSVYVASTGSLGSLTNSGTLSGSIAALYNAGTLGAIANTGVIAGNIENVAAQDLIFTGGAGASVGTLTGLAGAPGTITNTAGDVVFASGNLVLNDQIVATGHTVSNTGANLSLVSNISITGDYSQSAGTLNLIPGASSLIVSGVASITGGTVATSLPLNANYLAGGGAGTLVQGGAGSSYAGVTLSIAATPGLALTASVSGNDLVMTVANNYVGSTLATLSNTGSLTADYPVYLAATSNLGSLSNSGTLSGAVAALYNAGTLGVISNTGVIAGNIVNVAAQGLTFTGAAASGVGTLTGFGGGRGTITNTGGDVVFAAGNLLLNDDIVVTGHGVSNTGAALTLANSANITGDYSQTAGSLNLASGQKLIVSGAASLTGGTVSTSLSSTGNYLAGSTAGTLVQGGAGSSYAGVAVTTGTTPGLALSAGTSGNNLVVTAGNNYVGASLASLSNTGSLTADYPVYVASTGSLASLTNSGTLSGSIAALYNAGTLGVIANTGVIAGNIENVAAQDLIFTGGAGPSIGAPTTFAGKSGSVAMTSMIAGDIETSPMRALAAPSAAASGVGTLTGFGGGRGTITNTGGDVVFAAGNLLLNDDIVVTGHGVSNTGAALTLANSANITGDYSQTAGSLNLASGQKLIVSGAASLTGGTVSTSLSATANYLAGSTAGTLVQGGVGSSYAGVVVTTGTTPGLALSGGTSGANLVVTAGNNYVGASLAGLSNTGSLTADYPVYVASTGSLASLNNSGTLSGAVAALYNAGTLGTIANTGVIAGNIENLSSTDLRIAGGSGASFGTLTGYAASSQGAINNLSSNVVLTGNILLNDTLNLGDHTLIANDATLQLNSITRVNGNYSQSGGMLLIGVTSTTAYGQLQVSGTASLTGATVKLVALGTGTISAGGAYTVVKATGGLTYSNLTSSVSGLEGAFSSVASEGATGLVLTIDRAVQPTRFAAAGAAAGGAGVGTGMALDAIADAGGALAAPVITDVLMPLAILSSADQQRGVIQLSPSQLAPQVVAVAMSPALNAITRHQDALMANAGGPASCALTSDVPSQNGVVWGQFLFNSSKRDVAAGATSYDATNYGVVVGADVVNTANLVVGGALNWTKTAADGRAELAGSTTRISSVQASGYFTWRPGDARSPGLSMSGQFGVGYNAYRQHRQIDFLGRTASASFDGRQYLGQLRAGYTIPLADAISVTPFASVRAVHLKNDGYTESGAGAANLQVGRLTVDSVSHEIGIQGGATLDTAAGRISPSLKIGWVHNYDNGPIPLNAALGGVAFSSSSARVARDGATVNAGVSFVQNERLRVGVQYDGELRRAFQSHSATVELRYRF

SEQ ID NO: 15212 - protein, 782 aa, Sphingopyxis alaskensis
MGARSLKSLLQIIDNSYQLHQYSCFIFDKDQIMQLKPLFTLLPVVLSSVVQAQENNEQAVDETVTVHGQSIPSDQRTRSDLDKVRGIANADIFSGITSVQSNNMHNEAGALDIGIRGVQGEGRVPIFIDGSLQSTHTSRGYQGVSDRTYIDTDLLSSLTVNKGATIESSPYASGAVGGVVNATTLGIKDIIKDDQAFGVVLKARANNHNRTPDVSGDYSEQGQYALDERGEHSAFKHGSLMLGLGYQAESFNTVLAYSKRSKGNHFAGKKGYEEYQEPVVGQGQEVVNTSFESDSWLFKLASDTGTAHNADFNYRHHAQKAGEVLMAYWYKSSEDWEGNPYPDGKDRMPQWGLGTAKVNTYSANYYYQPDHPWLNLNANFWYTEADLAQYNGLWALGTNAEQYFHAYHNDRSGLSLTNETLLTQWPVRLNYGLAQQNERLSPEEDGQTRFTKTVTSRHGKRTAQNLFANADIDYSPLRVQLGLNLHNAKSTDYQTKQQLDYKEKLDLLSEFTYALTPSTQLFLKSSRTYRMPSLYETTLSNEVFSYNPYNPIKPEQAWNNEVGVQFMASDSVLQDDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKQNLYLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 15213 - protein, 712 aa, Sphingopyxis alaskensis
MNARALPGAPWIIHGRRLAAEGRCISMKSLLLATTAALAFAPAALASTAFAADTTADATQVSSVIVTARPNPEDPPVVADARKRLSETPGAVSVISQESYINRQTLALDDMLRDAPGVYAQRKWGGDIRVSIRGSGIGNANHNRGLLIAQDGVPLNEADGFGDTQIADPLNTRYAEVYRGGNALRFGGALLGGAINMVTPTGKDAGFQNRIRLDGGSYGLARQHVALARQSGDWDVFVAATNQTSQGWRSQSQQNIQFGSLNIGRSFGEDREVRFIVNGSNINQEIPGSLTLAQFNANPRQSSAGNLANDNGRNQRGVRGSLRTTWRLDDSLVFEGAVYAVWKDLDHPIFQVIDQQSRNYGAFGRFDWDGEIGGKRADAFFGAWYRSGDLDSNFYVNNRGGRGAPTSRTLQNAEAIDVFGEGRVFVTDQVAIVAGATWGQAKRDYQSFAIPGVASTFNLKADKTYDWVSPRIGLLWQGEGGDQVFANLTRSVEPPNFGSMSPTNIGFAPVRSQKAWTGEVGARGHRGPFTYDVTLYRAELKGEMLQYTVNPSIPASTFNADKTLHQGIEAALDWAVAPQWRIRQTWTYSDFRFKDDVQYGDNRLPIVPKTFYRSEVRYDDPRGWFLAPSVEWSASDQWIDYRNTKKAPGYAILNLNAGWKVNDTVSLFLDARNLTDKAYVSNTGAATTWTAASAVLWPGDGRSVFGGVTVSF

SEQ ID NO: 15214 - protein, 456 aa, Sphingopyxis alaskensis
MHGRAFAADVKPVCRQDEPGFMFRAVSITALSRPLPKLCAIASRTSGHVARAGDASRPIHSNETIMKKYLAIPAAVACLLASAAHAQSSVTLYGTIDAGLDYISNQKSAAGAGPVYGVQSGNVSTSRWGLRGNEDLGGGLAAVFALENGFNVANGKLGNGGDEFGRQAWVGLASRQWGTVTLGRQYDFLVDFVAPLSATGSGFGGNLADHPYDNDNLANDTRMNDAVKFRSANYGGFTFGGAYGFSNQGGGFSNDNAYSVGAQYVNGPVDLAVAYLQSNQPGGVDAPQNTGGSLSSSDGDAMLSGGRWRTFGAGAHYAFDHAAIGFVYTRTILNDPRELSQGGAYGRVNGQLLTFSNYELNARYFLTPALSLGGAYTFTQGRFDDADRGIAPKWNQFMLQADYALSRRTDLYLEGVYQRVTGADGVAVLGHAGIFNLAASGNDRQAVVAAGIRHKF

SEQ ID NO: 15215 - protein, 207 aa, Sphingopyxis alaskensis
MRKLAMAAATVIAATGSTAQAADMGYYGSRTPYTVNQPLNAFSWAGPYLGGNLGYAFGNVTNNITKPSGFSGGVQGGYNWQSGNIVFGLEGDIQFSTANDTFASYKFSNPWFGTARGRVGYAMNDILLYATGGLAFGQLKGEYLLSSESHTSAGWTVGAGAEFAFAPKLSAKVEYLYGSLSTNNFFITGAPNGYNFGLIRAGINYHF

SEQ ID NO: 15216 - protein, 701 aa, Sphingopyxis alaskensis
MTLRMRPRRLGLACLFTTTAILAAGMASAQQTQLDSSTFLGRLIFGAGQQKVAIDTPQAVSVLDQDDIDREQAANVGQILRNVPGVQTAGSDRPFGFAFNIRGIGATEQSASEARIIVNVDGVPKFYEQYRMGSFFSDPELYRRVEVLRGPGSATLYGSGAIGGVVSFETKDAGDFIPDGGTGALRLKYGYESNGNGQLGSVIYAARPAEGAEFLAALGYRRSDDFETGAGAAVTGSGFEAPSALLKGTFQINDTQTLRLSAQRFSSDADNTTLAQTGGGDAIANAFGNVDRSVTDDTFNVTWDHAGGGWFNPRVQLSYSDTTVDQSNARSTSGAAQACLPTASNANVFCDVTYAYSTTMLKAENTADFSGAGWNHFLTFGAQTTYQDRVADSAGPLGFHPEGSDRKIGLYAQSEVVIGDRLTVIPGARIDFAEREPGSDVPNGATVTDEATALTLAALYDVTDDLSVFGSVARTERLPTLDELYSTSGTKAAALDLDKEEATNIELGLTYNRDGLFAAADNLQLKLTAFRNRIDGYVTVTPTTDTVFFRNLARADFEGAEIEGGYEAESWFARLALSRVRGTDGNFGYTLSTTPADQAALTLGARLPGRGLEFGWRGTFVDDITTSTRNVTSGVVTDTAFDGYTTQDVFVTWRPENGALDGFDVQLGVENLFDTDYRNNLSLDQGRGRSFKVSLARTLTW

SEQ ID NO: 15217 - protein, 743 aa, Sphingopyxis alaskensis
MKFIVFLGAFLWHLMPVSAQVKGMVKDNQGEPVVAANVFWINTTNGTVTDENGAFTIEQPVGAKKLVVSFIGYENDTIVVENDHKELAIILQGSVMMDEVQVVERKIGVVKSRSSVLNQDMISSAELARAACCNLGESFTTNPSVDVSYADAATGARQIKLLGLSGTYVQMLTENIPNYRGASAPFALGYIPGPWMQSIQVSKGSSSVKNGYEAITGQINVEFKKPQTTQSLNVNLFASSKEKYEANFDANVHLNSRLSTGVLAHYENSTRSHDDNGDGFLDMPKVEQYNLQNRWAWMGDQYVFQASVKAMKEDRTSGQATHLHVDNSVGGFVGRELYKIGIHTDRYEAFTKNAYIFDKEKGTNLALILSGSLHKQDAGYGYKLYNVDQKNLYTSLMFETNFDERNSISAGLSLNYDYFNQTYRLENDDTGLLYGKEKETVPGAYVQYTYNWKDKIILMGGIRADHSDIYGTFVTPRAHIKYAPDDWVNLRVSVGKGYRTNHVLAENNYLLASSRKVKIDNDLDQEEAWNYGFSSSFYIPVFGKTLNVNTEYYYTDFRRQMIIDLDTDPHIVHFANLEGKSYSHTFQAEATYPFFKGFTLTAAYRLTDVKTTYNKKLLERPLTGKYKGLLTASYQTPLGLWQFDVTLQMNGGGRMPSPYTLPDGAPSWNTRYQSYQLLSAQITRWFRHWSIYVGGENMTNFKQKNPIVGASNPWGTNFDSTMIWGPVHGAMYYVGFRFNWDRN

SEQ ID NO: 15218 - protein, 925 aa, Sphingopyxis alaskensis
MRLLSGAAFGAAALVAVSSAQAQTAAATTQADEQPAEVGEIVVTGIRRSIEASISAKANNTSIVEVISAEDIGKLPDVSIAESLARLPGVTMQRLDGRSQQISIRGLGPDFTTALLNGRELVTTGDNRGVEFDQFPSELLGSVVVYKTPDAALIGQGLAGTVDLRTVRPLAYGRQAIAVNYRHEWNDIGALNSGTTDSGDRYTLSYIDQFMDGTLGVALGYAHMSSPYQSERFNAWGYPTYSDGNLLTGGVKPYVMSSELERDGYMGVLEWRPNDRIHSTIDAFYSEFKNTQVLRGIEFPLAWGGSSGDCTVNVPSSFCRPAPSLRAGYTVEDGMIVAGTWDNIKGVVRNDLNKRDSNITALGWNTEFVANDDWTLALDVNYSKVERNDIILETNAGTGRNINGALDTLGFELTDDGVTRFTSQLDYADASLIRITSAQGWGSDVIAGGQVGYMNTPSIEDEIKAVRLTANRTLHQSPFKSIDFGFNYSERNKTFVNDQYYIGVPGGGDLFVPSEYLLAPTDLGYLGISQVLSYDALGVVNSGLLDLVRNPNADVAAGNWEVTEKVSTAYVRANIDHYLFGLPLTGNVGMQFVYTDQMSDGFSARQVSPGVSETLAVSGGVDYLEILPSSNFILEVGDDMFARFAASRTLARPRMDDMRASRNYSYNTSLAQSTDINRSPWGGGGGNPELRPYIADVADVSFEKYFANRKGYVSVAAFYKYLESYVYNHNQIFDFTGYPIGVISPTNPEPALRQGLVGAPDNGDGGWIKGLEFSVSAPFDIFHPMLEGFGGVFSASTTDSEVQPDPTQPPTALPGLSETVVNGTLYYERYGFQARVSGRYRSDFLGEVAGFGNGRTLRSVAAETVVDAQVGYEFQSGPLEGLSILAQVNNLTDEPFKTFENGDERRTIDYQSYGRTFAVGMNYRF

SEQ ID NO: 15219 - protein, 740 aa, Sphingopyxis alaskensis
MKCRVRGAHLRNLLASGVALAPLVTSGLAFAQDGDATQLERIIVEGGNTAGAGATGPVEGYVAKASATGSKTATQITEIPQSVSVVGREELDDRAVVNKVDEALRYTPGVLSAPFGTDPDTDWFFIRGFDAAQTGLFLDGLPLFSFGFGNFQIDPFMLERIEVLKGPASVLYGGSNPGGIINLISKRPLDEPLYYTEAGINSDGNAFTGFDVNDMLTDDGTVRYRLTGKIAGGDNYSDYSEDLRGFILPQVTYAPDDATSLTVFGLLQGLDQVHVGNGFLPYVGTVVDAPFGKIDRDAYFGEPDLDEGTYAQQMLGYEFKHDFDSGWTFTQNARYAHLHKHEKYPYPYGYVGPGFGNIEPIAPDYLLNRIGFEATSKVDSFSIDNRAETDFDLGTTNHTFVAGLDYKYYRLDHIGASGGATPISPTDPVYGVPQGPTAVYINQIFTQQQIGIYAQDQVRFGDGWLVTLNGRYDYVDTDLKNGATAWAGPSNFGYDDGALSGRAGLGYEFDNGLTPYVSVATFFNPLVGSRDSNPDPAITTLVPLRPEEGYQYEAGIKYEPTFIDGLITASLFQITKQNVQVTDTLGISTQLGEVRSRGFELEGKVNIDDNWKIISAFTYTDLEITEDTNPSLLGKSPYLIPETQAALWLDYTATSGAFEGMSLGAGVRRQGESWADAANTKKVPAATLVDAAIRYEKNDWTASLNVANLFDKEYVSGCQGLLTCGYGESRTFTLKLSKKW

SEQ ID NO: 15220 - protein, 683 aa, Sphingopyxis alaskensis
MPKMVPLLYSALLSTFICQVNALQLAELDSFDLDTLSPTDEIPVVLTAARLRQSQLDTPASVTVIESETIAALGFKDIEEIFRLVPGMLVGYHSGVGEKAPSVSYHGTLLPEHRRLQVLIDGRSVFKPGLARVEWLDIPLAIEDIDRIEVIRGPNSAAYGANSYLGVINILTKHPEVTGGNTAKVRLGGRNTQDSYFNFNNRVADTDIRFTLASKQESGFDYLNDGKEENPDDHTGWHFMLRTHTPISSQTKLETQLGYKDSVNGQREIYGDYVDYLEQVDIEAKDTFAWLKGVHEFSQNQISHLQVYWQDFDRVEEWAACLREDIFGLPMKCGELNKNMYETKSELEFQHTSVWNTDARSVAGFRYRLDELESDTVNDGYSSNENISAFLNVEYRLSENWITNLGAMYEEDELNGYDFSPRLALNYLIGTSQTLRFIYSEAIRSPDLYEKQGRLQFTLENGYTPGGEPLVPVVLPFGTATGEIDNETIYSHEISYFGLLPSIHAQLDIKLFYDRLNGLISESLDHSPSNPLSNGRKLQMSGIEGQFKWNPSTFNTLLVSFAYIDTEDDFPQNYDDGVFTRDSERETTLSADISGSLSWIHSFNTDASFAATYYHVDNWNPITYGFQFSRLDLAYTDQIRLMAEQGVELKLNMQYRLDDDPLNRPKNNYADDYLFYGSIAYRF

SEQ ID NO: 15221 - protein, 841 aa, Sphingopyxis alaskensis
MPLRRFSPGLKAQFAFGMVFLFVQPDASAADISAQQIGGVIIPQAFSQALQDGMSVPLYIHLAGSQGRQDDQRIGSAFIWLDDGQLRIRKIQLEESEDNASVSEQTRQQLMALANAPFNEALTIPLTDNAQLDLSLRQLLLQLVVKREALGTVLRSRSEDIGQSSVNTLSSNLSYNLGVYNNQLRNGGSNTSSYLSLNNVTALREHHVVLDGSLYGIGSGQQDSELYKAMYERDFAGHRFAGGMLDTWNLQSLGPMTAISAGKIYGLSWGNQASSTIFDSSQSATPVIAFLPAAGEVHLTRDGRLLSVQNFTMGNHEVDTRGLPYGIYDVEVEVIVNGRVISKRTQRVNKLFSRGRGVGAPLAWQVWGGSFHMDRWSENGKKTRPAKESWLAGASTSGSLSTLSWAATGYGYDNQAVGETRLTLPLGGAINVNLQNMLASDSSWSSIGSISATLPGGFSSLWVNQEKTRIGNQLRRSDADNRAIGGTLNLNSLWSKLGTFSISYNDDRRYNSHYYTADYYQNVYSGTFGSLGLRAGIQRYNNGDSNANTGKYIALDLSLPLGNWFSAGMTHQNGYTMANLSARKQFDEGTIRTVGANLSRAISGDTGDDKTLSGGAYAQFDARYASGTLNVNSAADGYVNTNLTANGSVGWQGKNIAASGRTDGNAGVIFNTGLEDDGQISAKINGRIFPLNGKRNYLPLSPYGRYEVELQNSKNSLDSYDIVSGRKSRLTLYPGNVAVIEPEVKQMVTVSGRIRAEDGTLLANARINNHIGRTRTDENGEFVMDVDKKYPTIDFRYSGNKTCEVALELNQARGAVWVGDVVCSGLSSWAAVTQTGEENES

SEQ ID NO: 15222 - protein, 836 aa, Sphingopyxis alaskensis
MIKTSRLAAAVKLSLIATVSTSGYFVANNAVAAEESASFERIAVTGSRIQRQDMETASPVTVIDASAIRAEGYNSVDEILQAQPAMAGMAVGSTTNNGADGVAQVDLRGMGASRTLVLLNGRRMVNSGSGADSAVDLNTIPVAMIARVEILKDGASAVYGSDAIAGVVNIITKKDFEGFQLDINGGATDKGDGENVEISALYGFNTDGGNYTFGVAYSDRGGVMQKDRDWVEKGASSFIPTGSLGGKVQDENGNWVDRTEGYDFTQDSWLQTPNERYSFFANATQEFANEIVFTGDLLYTKRQSEQMMAAQPASVMLDVCTPTSTGNCITLTDEMVAGGITPDDQGRVEYRRRTTDAGNRIYEQDTDTLRVSAGLAGEFDVHTGIAWDLSYTYGKNKAETWVHNSINAKNMAQSVYDNQDAWFSGDPLSQAIVDDISYLESTTGGNEQHIVSGVISGEAFDLEAGPVAYAIGAEYRHDSGYYNPDPVIVAGEGTAAQQDPTDGSYSVVSVYQEVSVPFTDKLTGEFALRFDDYSTFGNASTWKIGLTYEATDDLMLRAVAATGFRAPNVSELFGGNVGSYDYLDDPWGNEQDPQILVNYTSDPDLKAESSESYTAGLVYSPSYIDGMSLTLDYWRFKIKDAISRLDVQAGLNACHAGDTTACETFGITPDGNLENLTNPLTNVGYQDTSGIDFNLAYRFEGLGLDWSISNDLTYLLEFEQDGIDYTGTIGGMFGGYAKVKNNFSVKAGQGDWSLMYSNRFIGEMDDINYGDTVDSVLYHNISGMYHINDSITASLGVKNFTDEKPVMVASGNEAGTVPEVYDTIGRQIYGGVTVKF

SEQ ID NO: 15223 - protein, 860 aa, Sphingopyxis alaskensis
MIRLLTLAVALVAAAPPLARAGEGEGALTRAPELLQAVEPDYPEAARAAGVTGVVALELELSDAGEVVSAEVTESADHGLDEAALAAARRLRFTPAEIDGKPAAVRIAYRFEFRLAAPAEDAPAPPELRGRVLERGTRLPVAGALVRAEPAAGEGRSTYTDRDGRFALAGVPAGPVAVTVEDGAHRPLRSMEEVRAGEALEATYWVARAAGPGEYEAVVVGEREAREVSRVALSAGEVRRVPGASGDAVKVLQNLPGVARPPGPSGQLVVRGGNPRDTRVYVDGQRVPQVFHFGGLTSVYASDLLQDVEFEPGNFGVRTGRAIGGRVNLVTRDPGERSHALADVNLYHATALVEGTTAAGVGVALAARRSYADAILTRAAEQADDGPGMRVAPRYYDLQAKAAWRPGPDDTVRLDVFGSDDRMVLTGVAREELRDVALLEYGTRFSVATLRWAHRASEATRVEVSAGGDWQDATIRAGDAYQERSRVFTGSVRSEVRHAAAPWLDLAAGVDGGWAPSARVEVTAAPFPPPGQVPSPQEPPRRYRARIEGAEGGAFLEATWKPAAGVAIVPGIRADAERLLGTRTWVDPRVAARWQLRASTALTAAAGLYHQSPPLAYLTEEWGNPALRPEGAWQYSAGVEQRLLPRLTVGVQLFAKRLFDLALPSDATVVRDGVEVPERFSSRGTGRARGAELLLRWEPGGRFMGWLATSWSRTRRGQAVGGERLEDEGDAYDQPLNLVAVGSWELPELWDGLSAGFRLRAGSGNPYEPVRAAVYDADADAYRPLETGRRSARMPAFFQLDVRADKKWTYRTWTFAAYLEIQNATARENAEAVAWNHDYTRRGWVTGLPFFPAFGLRAEY

SEQ ID NO: 15224 - protein, 644 aa, Sphingopyxis alaskensis
MTKSDQSAADAAQSITVITRDLLDSQQAQNLSDALQNSAGVVTNVYGRRGWDDFIIRGQRASESIFADGLLVDSNNRVAQELFGVERVEVLKGPASILFGAVQPGGLVNMVSKRPRAELFGELGLTVGNYGFRQTTVDVGTPLAKDSKAAFRLNALMMNSDDPTDYVWYRNRWIAPSLTLDLGTRTDFTILASHSQRNYVRQQGLPVNGTLVPNRNGVVPSNRFIGEPNAPSYDGEQNRIGYALTHRFDSGWTLNQNLRYQTSSLTGTLVSAGTMAVNSQAMNRSGTQQSFSGDSFGVDTNVQRTFAFTGHAHSVTFGIDYRHTKEDRLQKTCRVAALNVYNPVYGASINCPSAYSLDATDTLNAVGLYLRDQIRIAERWTVTGGVRYESAQTSTTDRLARSRTGNDDNAVTGSAGVMYDLTHWARPYLSFATSFLPNAGTDVNGATFKPEKGRQYEVGIKFDMPDKTGLLTLAAFDLTRTNVLSTDPVNTGFSVAVGEQRSRGLEMELTQDLGNGLSVSGAYAYIASEVTEDTTAANVGKPLNSVPRHSFSVWSQYRFRGALAGWYVGAGVRGESAKRGYSFNYTVPGYTVADLAVGYVASHWRAAFNVKNVFDKMYYAGGLNNNVLPVGNPRVAMLNVTMNY

SEQ ID NO: 15225 - protein, 624 aa, Sphingopyxis alaskensis
MRKTLLAITCASLLSPTFYLQAQEASADETVVVTANRFQQIDGAVLAQTVTVTKEDIERLQANSLFDVFRTLPSVEVAQYGGRGQSASIYVRGGSSSQVLVLVDGVRMPRAIMGGVDFNQFPINSIERIDYIRGARASIYGSEAISGVINIITRADIDNDASRVSAGYGSDNHKKGTFVVSKPVGDGKHFKGVLGYEKTDGFNVKPLPGVNDGDEHGFETLNLKLGYQQNFSDNLSGYVGVSAYNNEYDYDNSNYGNPAWGTVDKHEKKTGEVEYVGADLSLEYNKDVYSSELKLAYGQQDNYDHKSGQSKSTGDHVAIEQFNAIWLNSYSINEELSVGGGLDYRTEKLAKGYIAPSDWGPAKDYDPEKNPRANFGVSAIAQYAYDVWTLEVSVRNDDNNQFGNNTTWQTAAGWSFYEGYELTLSHGTAFRAPSFVDLYYPGYEMPNLKPEESENTELSLSGAVSIVDWTVTGYYNQIENMLIWEGAGMQNVGEAEIKGVELEVKLDTDIVSHEFYLDYKDPVDKSGAEDTQLAYRSKRGAKWNAYATFDQWTLGSQYLYQGERFNGSTRLPSYSLWNFTASYAVNQNWDINAKLSNAFDKDYEMYVGYATPGRQYFVSADYRF

SEQ ID NO: 15226 - protein, 132 aa, Sphingopyxis alaskensis
METPMLAVMLALSLQAATPPGPLAAPLAGDWVVDLSATPSEPYYKGMSLTLEADGRVTGSFYDSEILAGRWKTAGGRTCASFRTTDGAGPYHTSVCQGASGLEGQTWAEHRNFVFLWRAKPATAEDRKAKWW

SEQ ID NO: 15227 - protein, 814 aa, Sphingopyxis alaskensis
MKFTYLFLMLAFFTIGQAQNAKITGRITSENNEAVSYASVSIKSPKKNTTSDDKGNFEISNLTPGNYTIYFSAMGFSVQEKTVELHENENLELSISLQENINTLQTVEITGRKEKSYKNTKSFIGAKTEIALKDLPQAVSYATKELIADQGSIRVGEVVKNFSGVSQFTFYDDISIRGFRINGGSNTQLLNGMRTSTGFWKQPLANYLERVEVLKGPSSALFGNASPGGVLNRVTKKPLDQAANSVSFSTGSFNTLRALADFTGPLTEDKSLLYRLNLGYENANSFRDLQFDKNIVIAPSLSFLPNDKTSVNFDLIYTGSKSNLDRGQSTYENNLYSTKISNSLNSTNDYLNEETYIVTTSLNHQFTDRLSFSASYIRTGYTEDLLEHRGANKYASAGDGSTIPTAIEMQVFQRKRKRYIDNLSAFFNYQAKTGALDHNLIAGYDYAQEQVPSGGSQLQATGYRNAANNGSIATYDPAKKNLYLLDSKGNPVPNVAHFDLTNPMASQQLKDMSKYFYVARPFDPTYYSLYGVYLQDHIKFGAFQALIGVRYDEYSDKENYKKATEKKVKQHSFLPRFGLTYTLNPNINLYGTYVKGYNPQTASSLSNPNAGGPFDPLESNMVEFGGKSSWFKEKLFVTVALFKIQQKNTLYPANDPTNPDLMRSIGQEESKGIEIDVNGSITRNWSISAAYSYNEAAITESPVDSEIGRQKPNTPKQQGNVWTRYNFTDGALKDFGVAFGSNFVTTRNLSQTVTQTIPGYTLFNAALYYNINKFKIQLNANNITNKTYWVGGYDYIRLFPGAPSNWLLTLGYSF

SEQ ID NO: 15228 - protein, 648 aa, Sphingopyxis alaskensis
MTFSGLCAGLFFSFVSPLSFAQHADISQLERYTVTATRPYYDESLSRIFPQYQFDKSHLVTPLHTNELLLQAPSVSLNGQGGQIQSISIRGYSRWRIQTLLDGVPIVSDRRAGSSIGFVPPEFITSVSVLPGAASTYLGSGALGGAVNLQLDATENPYLNVGYSSNQQMKTLSYKDSVGNTDWNIAYRNANKGEDANGALLFDQFEQAGLFLRHRPESGFIKEAWTLYSDNNNIGKSSSDYPLNRISTYPDNTHWLGKLTVGADNYTGSIWWHQSYLETSVLRPQSRINDSENKALDYGFDIKTKGNWQDWWFNWQLQVSGREGVEADEKEFSLTAIPVEQGHGPDSIALLEERAPALAYEVSTLNANEINAAGIVDASRQWNSTALALGARVDWQRQSDNTGTNENVTATNLSGYIGVNYQLAKRWATSLYVSSAFRNPSLTERFFAGETPRGTVIGSTKLQTESALNSQATFAYNSEQLQGAIDVFYQQIDNYIERQAIADDVLQYANLDSATIKGLSYQLSWQSKVNNIDATLSGAWVNGRDELGNAIADIPADNHRFNVGMTLGSARFFTTVVYRASKSDVAEGERPLDDVITLNVGGSWRMNERIVLQASWENLTDQLYYTSTDDKAPFAQGKSIQLALTYLL

SEQ ID NO: 15229 - protein, 987 aa, Sphingopyxis alaskensis
MVGGIVAASLSMLSAPVAMAQDATVTQADESASVEDIVVIGSRIRRDNYNAPSPTQVVTREEATLQGFASTTEALQSTAVTGGTSQINNSYGGYVTNGGPGANTIGLRGMSPSRTLVLLNGRRVSPAGSRGSVGAADLNVLPTAIIDRVEVLRDGASSVYGSDAVAGVVNIQTRNNFEGVTFEGQRNEPLEANGAGGSTRLSLTAGVRADRWRAAGSVERYERDELTLRDREFTRCQTDGFRNGQDYIDPLTGQSKCYPITTTGSNGVTINTVALGVEGPPSASGARTFIGTAGVGAPGSVGTVFNRWRPNAGVAGGVPGFEGVGGPGNDLNVRDTFEDRMLNESLISPVDITTLYGEVGYDLHALGNAEVYGEALFNQRKSSQTGYRQLSLDYAKGSPLIPDSLAFSTISGDQGLNKGQDVGARAFIGFGNDHSEQEVDFGRYVAGIKGDLFLPEWRYDAYVSYSRSKSTYTSEQFLTDRMIESLDVVETAPGQFQCAELASNPGCVAAPALNAQTIRGALPQDWVDYVFRPVTGTTEFTEKVVSIGIDGPLFSLPAGRVMGFFGAEWRESEIDDTPGLDSQLGNTYNFSTSAITRGSDSVKEVFGEIEAPILVDLPGVRELTLNGSFRYTDYDSYGDDTTYKVGLVYRPIDWVTVRGTYGTSYRAPALFEQFVGATTGFLSNTNDRCNNYGAPGVNPNRVANCTAEGLAGDFQSTNSVTVITAGGADAGLAAETSTNMTVGLVVQPPLPSGWGDLAFAVDYYEIEVENGVSRTGAAQILTRCYDSNPADFAADAGFCRLVTRDAVDNSLTVRDSYVNLATDNVKGLDYTVRYRKDVGPGTALFNLAITQYTEISNKLFAEDPLEDYTGMIDNPEFTGTADVSYAWDKWRVRYGVEWIQGTDSYAYYGEDPATSDYDLATDDYWLHNTSVQYASDGWTATLGVRNLFNDNPPTISSGVYNRVGNAPLYSGYDYLGRTAFVNLTKSF

SEQ ID NO: 15230 - protein, 282 aa, Sphingopyxis alaskensis
MFRVFGAPVSPNRAADRSKRAPGPAARFHPVASVGRRASGGEMMGTKLVLTAALLSLATPAFAADIIAPAPVKAPVPAAIFTWTGFYIGAHGGGAWSKWTGIDPTDPTAVWTSVTASGGIVGGQIGGNYQIGNVVVGLEGTGAWSSVTLNAGGPFGGGAGFTLSLKNDYIATVAGRFGVAFDRVLLYAKGGAAFTRDKYNANNGLAGALAGSASGSFNRTGWLAGGGVEWMFMPNWSVRAEYNYMGFAAITEQPVTSGNLAATPANVKLNIQTGTVGVNYHF

SEQ ID NO: 15231 - protein, 438 aa, Sphingopyxis alaskensis
MNTALGDSSSVTDLLRVSGSTSGNTGVQITNSGGLGAQTTGDGIKLIEVAGASNGQFTQAGKVEAGAYQYTLYKGGVGADAADGNWYLRSTLEMPVEEDRGASAGTGNMPPAEQPVAYRPATVGYVMLPQLAAQYGFQILGRLDQRVGDVPNVEHEAGVKDNGVWGRIYAWNAQTETSSRFSADTRNAFVQFGKDWTVSAPATGGTSHAGITATFGNGSARFDDLPRGDYGLTTATGSAEMQVQALGAYFTRYLSDGSYSDSVLQVSHYHNRYDDKQGNTPGQNGFSIAVSEEIGKPFQIGTLPLAFEPQAQIAYQYLHLNGFSDNVSAISSTTSNALRGRVGFRLFRPDMQNASGTSTATPYLSANVLHDFLAPGRTVVGGTPLSADFARTWVDAGIGITMTFGKRSEVHAAIDYAHNLGGQNSHSINANAGYRYSW

SEQ ID NO: 15232 - protein, 532 aa, Sphingopyxis alaskensis
MNDSLIVDRNFRTDGIQYIWKPFEYVSNTMNISRSYFQERIQNSTYFTDTSKGVLSAAFNGLQKANTLGNDFSEDLRYFEDVMEFNLFKKILKLKAGGQYRETVSSFKGKVIYINENPEMLKITQFILSDPNTNAVMEGDRMVRRQLGYFSEMKLDYKGNVLSFGARRDYYDLSREWKTSPRLMFAKEIDFTKTTFFGGTGKFFQAPPDVSYISKKIGNPNLKMEESQHSNIGIEQKFLSSYSIKLEGYKNTFDNLAVRDNLIYNSSAANINNMVSYMNNQNTELVLQRNVNYSNSMSGWSKGFELMIKKEIPEDSGFFGWISYTNSLTKRNRNQPSLKDSELQAHNELVANHRILYQDVSKDYYTNVYDNGSIEVLKKNSKEEYYDLDRTHMFSFVGGWKYKDQWQIGTRIIHLTNYAYTPIVGSELTPVNSLNIYTPTYSNDIRSARLPSYNQIDIRFDRFITTSWAKLDLYFEIINLTGNRIAVSKTLYSTLAPYIPDVNPSTSYINQNGLEVGKTKVPMFNFGIQMQF

SEQ ID NO: 15233 - protein, 678 aa, Sphingopyxis alaskensis
MNILRLPKLLYSCVAFCCCQALTVSLSAQQQKVDTARTYSIPEVTVAEAYHTREVRAMAPTQVFSKEELKSLNVLQVSDAVKHFAGVTVKDYGGIGGLKTVSLRSLGAEHTAVGYDGITISDCQTGQIDIGRFSLDNVDRLSLSNGQSDNIFQPARFFASAGILNIQTLTPQFKDNRRTNLSASFKTGSWGLVNPSLLLEQKLSRKWVLSANGEWMSADGHYPFTLHYGEDNDLTSREKRKNTEVKNLRAEAGLFGNFSDTEQWRLKAYYYQSSRGLPNATTYYYDYSSQHLWDKNVFVQSQYKKEFSRQWVFQTSAKWNWSYQRYLDPDYKGSEGKTENSYYQQEYYLSASALYRVLSNLSFSLSTDASINRLNANLKDFAYPTRYSWLTAFAGKYVNDWLTASASVLATVINEEVRQGSAAANRRKLSPYVSASFKPFASEEFRIRLFYKDIFRLPSFNDLYYGQVGNTNLKPESTTQYNLGLTYSRSINELIPYVSVTADAYYNKVKDKIIAIPTKNLFIWSMVNLGKVDIKGIDIAGNISLQPWEKLRVNLSGNYTYQRALDMTEPGGKTYKQQIAYTPRVSGSGQAGIETPWVNLSYSFLFSGKRYMLGQNLRENRLDSYSDHSVSVSRDLRIRNVNTSLTVEVLNLLDKNYEIVKNFPMPGRSVRVTMKVRY

SEQ ID NO: 15234 - protein, 372 aa, Sphingopyxis alaskensis
MRYRHAVTAALVMSATGTAFAQSSVTLYGVLDTGVEFFTHASPTGGTMARFPTISGGDLPSRWGLRGEEDLGGGLKSVFVLESGFAPASGTSLQNGRLFGRQAYVGLSGQWGQLSVGRQINMTIWGMANADVIGPAAFSIGSFDGYLSAARADNSIEYRGTFSNFTVGASYSLGRDVMPAGNCAGQVPGDLMSCRAITAMLKYDTARWGVGLIYDEQRGGAGATDINVVPGVTGIAFKTSSATDRRYQANGYFMVGAVKIAGGWIHRVIAGDVHKLHTDLAFLGASVPYGVWTFDAQISHIRNHDYDANGTLGVARANYNLSKTTALYGLVAYLKNSGNGAVYSVSSTSLVPAMPAPGVDQAGVMVGIRHTF

SEQ ID NO: 15235 - protein, 1661 aa, Sphingopyxis alaskensis
MNDNLAGATTVSGGDTVGVTGAWTSAAGAPGYTLTPIGNTSIVSGNPNQPLLSLGGKTRSVSTPDSITGTHTSIATYDSSAFAASTAGATNVPVYQDVNGNQYVNLRLGTIDNTGGTLNVSIGNPANAPDAAGNAISIAPKQTDLTFADGTGSATSVVNWNSRNQIWFGTGDYLASGGAVGQVQLDVPTYAGTFTAFDGSTWTVSDAASLAAYNDFLARAVRSGALGSQAAYDTAFGQAVTFTQETFQYANNVSAGDKNTLPIDHLAGMHGTGANATLQIGKDGQIDFRGTNTIESSSAVLAENGAHFVNDGRLSGDFTLVRLLSGASGVNNGVISSGYASGDNVDTSSSTPPDNFGFRAYTEGNGVYASGTGTTFANNGVMNVGAWTLDGNRPDLQNYAVAVTGGANASNAGTINVGVNATTLDSQVIGGFAAGGTFTNEAGGTIQLGRAAQYGPGAAANDVALSARAYGILLGASGTASNLGSIVIGSQTQNGAGMASLGSSSGTLRNLGSIVVNGAAPGTPLANVGMLAANTAAAVTNTGTITLNGVNGIGIMVVGTSTATAATSTGTINVAGGLDPASDTRNYGVWAEGSRAKATVDGSLNLTGTGAIGVHARSGATIDVGANAVPRFMSGTNQIGFYAYGAGSRINVAAQHLSVDTDDSTLFRIAGGAAYTGASAAGTLTTDVTGQGARGVLATGAGTTLSTGNATYNVNGANGIAVAVEGGAQGSIDAGATINLNAAGAIAGVVDGQAHDLAGANAGAPVATTLANAAAVTSSSAGVTGFVARNLGTLENRGSVLLTGAGSTGVVIGPLGTVNNASAIRVSNGTGALVQGASAMLANAGTIEADDGVAGVHLTGAGASVALSGAGTVVANGSADGVLIDSTVSNGGIVAGATSIAVGGAGKGIDNLGTNTTIVLSGTQIGTTGNGADGLSSTGAGAHIATDAATVVRTAGDNARGLVVAGTDSTLAANGTTIATTGAGAHAIVTGSGASAWLSGAKVSTAGAAADGLVARNGGRIGDTGSSIASAAGSGANVDGGGVLALTGTTLKGASAGVLSTDTLGTGATSAVLVDGGSVASVAGPGFAARGGTVNIAVRNGTVVTAGSGTLLDLANGSTATFNASAVNLSGDIISDASSTGNVLLANGTTLTGKIDPVALTVDGTSTWRVTGSSVLSSLNNAGLVAFAAPSGAPTAAGSYRALTTGSYVGYGGTIALNTYLGADTSPTDRLIVNGGTASGTTGLKIANTAGTGAQTTGDGIPVVVTANGGTTAASAFHLAEPVQAGAYEYRLYRGGQSDANGWYLRSQLDPTDPGDTVHPSGNGNGNANGNGNGNGGNLAYRPGVAGYAMTPLLNADYGFSTLGKLHERVGDIYNLEKQAPGNRDGVWGRIGGQSLDANAGRFAADERTFFAQFGKDWTLEQAAAGGSTHAGVTASIGVANASFDDIARADTPGLSTSTGSVEMHAQSVGGYWTRYLADGTYFDSVGQVTHYGNRYRDSYGNDASQNGFGIALSQEVGKPFGIGGMPIAVEPQAQLMYQYLKLNGFNDNVSAVSGTTTNALRGRVGVRIFRPNLDANAGGGAATPYFTADVLHDFLSPGRTVVGGTPFATHLGRTWYELGLGVTAGFGKSGELYANVKYARNLGGDYRRGVTGQVGYRYSW

SEQ ID NO: 15236 - protein, 188 aa, Sphingopyxis alaskensis
MRHSCAAVSQYPRNTYVMNKRPLLGALSAISLGLCSFTASADFYAGALVSYSNAEYHHSSTSSVTEGNPFLLQAQAGYFFNDYVALEARYGTSVQRESGLAIDSLASGFVKLNMPVSERFAFYGLAGYSSVQIDQQNVGSNKDQGFSFGLGMHYALDKHNAVVFEFVDNTSEDQVRLNALTLGFQHRF

SEQ ID NO: 15237 - protein, 678 aa, Sphingopyxis alaskensis
MTKRLLFAFCIPTILLSADTQTIEQDFLTTLNEASEIASATKLNIDKTPSTVTVLRKDFIRHTGAKTLFDLMCYIPGIEVSITSSGKKQIIVRGVKNSYRDKIKFLINGVEVTNNIYTNQFYYYNFPADLIKRIEFTKTPDSVRYGDNAFLGVVNVITLDESDEDMVSTYYSSENGYGISAFKSIITEQGTLLLDLHKLYSKPDLLSPTTLKIDTLNDTTTIFRQSTPAHALEKNDGVGITYKNENWTVQYRLQYYKKGNFFGISRVSPLKRDQFVHLQHQFVDVGYQQYLTKDWKIETNVGYKYYIWNGAFRVYPYDLNSTSGPDKDLIIGGNFAEKEMYAKADIKYLSQKHNLQFHIETSYAKPSRAYYLQYVPALGNYAHLPGPIKSDVHRSIFALGIEDLYFINDNFTLTGGLRFDHYNEFGWKFSAKAGLVYNFDPKNTMKCIYNAAFRAPSWVELYANTAAEFNGNESLQPEYINLLELQYIKKFTKTDVLKTNFYYGKTKDTIDRYLSDSGLRIYENLGDYLIRGIEVSYTKLFNHAKLILRYAHNFNKREYQRSPNDQTEYLGIRKNIFSTSFDYDWDHFHSHTMFKWTSKIDTPDIYRDVRPSLSLNQVFTYSLNDLDIQFGVKNITDHKNYAYVTPSELIQNRFQFVPQGWAVPQSGRELFFRIRKSF

SEQ ID NO: 15238 - protein, 711 aa, Sphingopyxis alaskensis
MLKTSLCLLSVAVSACAIADENSKNKYSVDQLEHVIVSGSRIFESIDEVPASITVINQQQIQQHLKVNPELSSLLAQMVPGLAPSTGSSSNSGQTLRGRAPLVMIDGVPQSTPLRNGSLGIKTLDASAIARIEVIKGATSIYGNGAAGGIINYITKQAKSDGQPEGEISISSRFSAVKLDESAGARISAAINGGLDKFSYLISASYEQNGVQRDSKGDILGLQYGLSDSETQNYFTKLSYDFDDDKQLEFSYNFYSSQQKTDLGDVTGDGNIGEKTYAIHVPKELQKPGKPQGPEGNVNITLKYLDYALFDNTQMTLDLYKQNIENVFFFSTNLANLDDGYSGGQSVIKSDKLGARATFNSQFDFDNLTTTLIYGIDALNDKTSQPLVDGRIWVPEMNMDSVAGFLQTKWVINDDIILKAGVRKESIDLTVADYQTLKLCRTATQCSVPLSVRGDTINYDATTYNAGIKYNLSPAFSPFFSYSQGSDISDIGILLRAATVNDIALIQTQASIIDNYEVGFTSQFDDLRFELAAYKSTSELGTSNKFNDVTGVYEPIRAPQKIWGFEGLVNYAITPQLKLVATYSYVEGKDTQADEYLGAKQISPPKATANLAWQASDDIALTFSYLYVGDRKRFDKNEQGQYVGDQGPVSSYDIVNLSGQYQITPQWSSYFGVENLFNSDYYPARAQSYTYGGYNIKGLGTTATLGAKYQF

SEQ ID NO: 15239 - protein, 1076 aa, Sphingopyxis alaskensis
MAQASARGMGLRITSLAAALLGVYGAAGAAENRLECIGACPPGQPVAGAHYSGTNLSANREWVVYGEGSNAVFTLQGGSVTASGGLMGAVNAADGARVYLNQVSVRTDAGNGWEAPGVRAEYGALVNVRGGSIATVGGGSYGVQSLDSGTMIELNGTDIRTTDAYSDGLRAEFGGSIRAVGLTINTTGEHAVGAMGADDGTIALRDSRITTSGVDAYGLGTESQVLSPGGVLQVSNTAIQTSGKNAHGVYLQGGSSLNMSGGSIRTTGSGAAGLRVSNGSSVALNGVEVVASGPSLLSTLSATRQQSIVVGAGSNLTRNDGRLLLVRRVAGGELGQVTLTLKSGSYAAGNIENLAADGSRESSALTIVDVQSGAQWAGLVIDDTTAIVNGSQSGQHSGFSTAGDMVLEGGSAPVTFTGVSNIGGSSSLGAGSQTTFGGATTIGQSLAVLPGGSVAFNGPLTIGESVTGGQGTALSFNAPAIIGANVQGAGGAAFTFSGPAQVGGSVQGLDGASFRFSTSAPTAIAGGLSLAGGSSLGGGSPTTPIVVTGGADAVSGAILGGNLDIGGALRMTGASLAPGNSIGTVTVGSVGALSGSTYLAEVNAKGQSDLLVVRSGNVDLAGVSLVVGQENGTGGYVLNHDYTIIKTEAGKIVGEFAAASLDESLASTLVKLDPVKYGAQATQVSLSPDADKLAAARAGLTRNQSAVLDGALSVAGRNASADAVMLMSDTGQRAGALDQLSGEVHGSAVSALYSNTQLLNRTVARRMSANLGAGLLAGAPTAQAAGPAAASAMPGTAAYPLWADVVGNWSSFDAKDNAAKAKSNTAGLFIGGDVAVGAGWRVGGALGFTDGRIKADAVDSRSDVTSYTAALYGGNSWAAGKGKLNFLAGVGYTHHDIDSRRSVDVGGAQTLKADYKANTTQLFAELGYQVPVGASSSVEPYAGLAWFNNHSDSFDEDGGPAALHGSGQTDQITTFTLGLRGNTALQLGATETRLSAGLGWRHANGDVDATRKLAFIQGGGTAFTVAGSPVARDAAVLDLAAEVDVGRNAALGLAYGGQFGNGNKENTGSLYLKVRF

SEQ ID NO: 15240 - protein, 366 aa, Sphingopyxis alaskensis
MNRKVLALVIPALLAAGAAHAAEVYNKDGNKLDLYGKVDGLHYFSDDANSDGDQTYMRMGFKGETQVNDMITGYGQWEYQVQANGTEGDKGDSWTRLAFAGIKVGDYGSFDYGRNYGVMYDVEGWTDMLPEFGGDSYTKADNFMTGRANGVATYRNTDFFGLVDGLNVALQYQGANENQSPEQEGTNNGGDDRNMKNSNGDGFGISSTYDLGMGVSFGAAYTSSDRTNEQVNDSTAGGDKADAWTVGLKYDANNIYLATMYSETRNMTPYGGSNGSDNTIANKTQNFEVTAQYQFDFGLRPEVSFLMSKGKDLGVNGSDGDQDLVKYASVGATYYFNKNFSTYVDYKINLLDEDKNFYSQKRHLYR

SEQ ID NO: 15241 - protein, 437 aa, Sphingopyxis alaskensis
MRHLPLFLLGIAIATPCLADETVENWQAKGQATYVSQKSKSFSAAYSGPNSLSTDGESSYTFTSTAYLGARLWQGSELYLNVEAGQGDPLSRLTGLGGFTNGEATRVSGTSIKAYRQRLFLRQTWALGDDTEFVESAFNQMAGHVAKDRFVLTMGNFSTLDIFDGNAYAKDPRTQFMNWSNMAHAAFDYAADARGFGWGFAGEWYQGDWVFRFGRMTGPREPNALPIDYQIKRHYGDQIELEHAHEIADQPGKIRLLAFRNRANLAAYRDGSTWLDNNPGPDQIAIQNVRNGEKIKYGFGLNIEQAITENIGAFLRAMRADGRTETYAFTEADASFATGLSLKGSLWGRSDDTVGVAWMRNALSHERRDYLAKGGISFFIGDGALNYRPENILETYYSLKALPGLWLTADYQRISNPAYNADRGPANILSLRAHAEF

SEQ ID NO: 15242 - protein, 677 aa, Methylobacillus flagellatus
MCKRISIFAIVLSLLCFTQVSYAQSELGRGDDSLMIYQMQPIEVEAEKTDVEINASVPIQELAGEQIKKLSVSNVAEAVKFLPGVTLKDYGGIGGLKTISVRSLGAEHTAVFIDGIKYSDSQTGQVDLGRFSTDKLARIELLSSGLSDETCLPAKAYLMTSSLNLQSKISTLSQLTQPVGFDADVSLGSFGYSAFGLASEMKLSSSLFASVSVEKIDATGEYDYTFQNGELTEHLHRQNTDVHSTRIEMDVVAKFAEASTLSVKGYAFFSERGLPGAVTVDYYDKSKERIYNDDSFLQGTYETKLFERISAKFRGKYGYHFLRYVDPDYYTSGGLDNRYTQHESYASASFAYSVASFLSAFASTDFSLNTIESGRFDDSPERFSWLFVFGLKASFYGVDVNTSLLSSLVEEKSYDDAVTPHRHNLLPAISMGYWITNILHLRASYKQSLRLPNFNEMYYPQYGNVDVRPEYTTQYNVGLGIDQPDVLMLERVSLRVDGFRIITTDKIMAVPRGSLFNWSVTNINRVETTGMELYGEVTTRKIGLAKVNLTASYVYQEALEKTPSTSPYWQEVTANKQIAYTPKQTASVTGGLLFEHYQLNWQMSYVGHRYTSGEQIIQNYLPGYTLHDVNAQVFFKIFEYDAKIKLAVTNIFNTEYVVVKSFPMPGRGVRCSFSIHI

SEQ ID NO: 15243 - protein, 199 aa, Methylobacillus flagellatus
MKSSMVALSLLSIFAMSSQAVASDKEASSKELGQFYVGADIGFYNETEFEFPNDAIEDSSDLSDLSYNLVGGYEFNTHDVVKLGLETEYRKIGKVSYSDSMDIEGQAFFVNVKPKFIVKGDALDLYVSLLAGVGSMDMDVKMSGTSESKSEAAYQVGAELGAIVSDNIDIHLGYRNARVEIYDVDVSSQTAYIGARYKF

SEQ ID NO: 15244 - protein, 733 aa, Methylobacillus flagellatus
MLRETVTTSHGHRHPLHLLAALSMVLAAARPARAEGDAPEAPAAPPEAGAAAPTGEGAPAGDAAIEVTIQAEKPGSEAASRVSVGHRELELRPRLRPGDILESVPGLFAVQHAGGGKANQYFLRGFDADHGTDVAFFVDGVPVNMVSHGHGHGFTDLYFMIPELVTGLDGYKGPYYASIGDFGTAGAVNLRFAEKLEESYAQVSLGQYGIQRGLVIASPDLGDTWRAVAAAEIYRNDGPFLSPERLERFNVYLRATHDLGNTGKVQMTWMSYGSTWHGSGQIPARAVCGEGEQGGLNPPPSAFGQPCIDHFGAVDPTEGGATERHMASVAYSTAWRDADLSALAYLVRYRFTLYSNFTFFSEDPVRGDQIEQNDDRAVGGADLRFRRQYEIGGARFTTSLGAQIRADAIDKSLHHDEARERIEEKSRTHVDESQIGVYVEQDARLRRWLRLVLGARAQWIDVNVDDPGEDLEAAGNRSSGARGQMQLLPKLTAIVSPAEGVDLFAHFGRGFHSNDAQGAVLGEGAATLITPATGYEVGVRVAPLRGLSLSGAAFLLDLDSELVWSGDAGATEASGQTRRYGIEIGGRYRLRSWLFADVDATFTRARFRENAGNASAVALAPTQTLTAGVGVRPTLGAFTPFAALRVKAIGARPATEDESLTAEGFTVVDANAGLRWKNVEVAVDIQNLFDTTWREVQFASESRLPYEPAPVTGIHYSPGWPFTAIGRATLYWE

SEQ ID NO: 15245 - protein, 1008 aa, Methylobacillus flagellatus
MKNNKPEKILFLGGNYLKLILMFFLCILASNVKAQESTVSGKVVDNAGLPLPGVNVHVKGSTKGTQTDFDGNFSISTAPKSTLVFSFIGMDEVTVDTENKKNLKVVLKPSSQALDEIIVVGYGTKKKSDVISSVASVKPGDMTKVATSDVGEMLRGKAAGVQVSLADGGPGSSSSIQIRGKKSINGSNEPIVIADGVVIGNINDVNANDIASLEILKDAAAQSIYGARASNGVILITTKRGKTGKAKIAYNGFSGVQTINRNFDIYSGEEFAQLKREAYRTSNGGVYRPDDQVFSPLELESVQSGKYIDWEKYALRTGTTNNHSLSISSGTDKTSIFSSINYINTTGVIPNSDFEKVAMRVNVDQRVADWLKIGMNVSLQFSETNRPNVGNVLNNAINTSPLGRIYNDDGSFRYLPGGIQETPNPLIDIYETTTNELNRNDIMNIFLDINLAKGFTYKLNASRRSWNYKAMAFNTSRSLSGIANSGQGSGSILYKDNVEYQLSNILNYNFKLAEKNHFNATGVYEITSSEYNEFKNSASRIPSDILGIYGLESAFLNTPEIGGNERSLISFAGKLEYDFDSKYYFTVSGRADGSSVFGANNKWGFFPAVNAAWNVSNENFMKEHVPVISNLKLRASYGKVGNQPKDPYQSMAVADQRDYIINGIKVSGYVPGTQLSNPDLRWETSTQLNLAADFGLFKNRLTGTVEVYNTDTSDLLIYETLNANTGYTKKLSNIGKVNNKGLEITLNGDLIKKKDFRLNVGATFTKNKNSIVSIYGKDANGDGKEDDDVGNLWFIGKPIDVYYRYKAVGIYQEGETIPIVTGTTLYPGDIKLYDANPANGANPNPNEDRVITSKLPDWFGTFSLALEYKQFDFSADIYTVQGVTRDNLFLYDYVKGGSLRGVKNGIKQDYWTPENPGGNWPRPRDGNDPPYINTLGLQDASYIRLQNVSVGFKFPESTLKPLGLSNMRLYVTGSNLVTLTDYQSYSPEKEINDYPEPVTCVIGLQVGF

SEQ ID NO: 15246 - protein, 559 aa, Methylobacillus flagellatus
MEIINDAELIRSMQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFILGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 15247 - protein, 623 aa, Methylobacillus flagellatus
MRKELLLVSGLLVSSMAFAIDPVEIDSLINLKGVVVSANKIHVNRNSVPLSISVIEREEIEASSESALLPVLSERVPGLFVTEKGITGFGVSEGAAGTVNIRGVGQGNKVLMLFDGQPQWAGLFGHSLPDTYVASDVEKVEVIRGPGSLLYGSNAMGGVVNIITRQHNQPGRRTQARIMYGSYNTQKYMINNGYNIGNFSSYISLNHDRTDGHRPDSKFHITNGFAKLGYKIDDHYKVTGDVSLAKFKNQNPGEITNPLIDNIMNILRGTTSFALENNYGKTSGALRAFYNWGHHKIDDGYNPGGTPNPYLFYSDDHNAGFLLYQSFRLVKGNSFTVGIDYKNWGGHAWQDSINGNQNELVNKTVNEVAGYVIMQQDLFDKVSLNAGVRYEHNSIFGGEWIPQAGFTVRPFEGNVIKASLSKGFRSPNIREMYMFPPQNPDLKPERMMNYEVSIGQTFLDGNLFTELTAFFIDGQDMIETTRIDGRPKNVNTGTFTNKGIEFDSRYQILKNLSLDMNYSYLHTSKALLAAPAHKFFAGVMYAPGRFTFNVNVQSIFDLYINTADKVKEDYTVLNAKAAYRFGTRDKGLNLFVKGENLTATRYSINEGFPMPKAIFMGGIDVTF

SEQ ID NO: 15248 - protein, 1050 aa, Methylobacillus flagellatus
MKHQNLEFKWMCLLFLALLLSPPLLWGQNHSIKGQIVDAKSNEPLIGVNITVEGTSNGTISDIDGRFTLSVAANAVLKISYIGYQEKKIKVDDLKKEPIISLEEDSKQLEEVVVVGYGIQKKVSSVGAITQTKGEELLKGGNITSVSEALQGKLNGLVAINTSGKPGASDTKMYIRGKASWQNSDPLVLVDGIERDMNDVDMNEIESISILKDASATAVYGVRGANGVILLTTKRGQDKKPNINFSTSFGIKQTTANMEWADYVTSMKMYNEAVANDNNWNQQIKQSVINAWSNAFDTGNYGPYNDVFPQVDWWDELVKPGFSQQYNVNISGGTNFMRYFASIGYQNDGDIYDLQKQENFDPRNYYRRYNWRSNLDFNLTKTTSLSVNIAGKMGYRNDNFADDVYTRIIAAPTNSFPIKYSDGYWGDGSTAGYNPVCNMNTNGSQLYKTFQGWYDVRLEQKLDFLTKGLKAAAKVSYTSASTTRSSIKTGEIWGNNDFESRNSIIKYHREYDYSNPIVNADGSLTYPMILEKRWPNDEDIELPPNVSYDNLDGYNRKLYYEFSVEYNRSFGSHNVTALALMNRQVSDSKDDKVIKFPSYREEWVGRVTYNWKERYLAEMNISYTGSEKFARGQRFGLFPSYSLGWRASEEPFIKKHVGDVLTNLKFRYSYGKVGSDAAAARWNYIQLFNSLGSIELGNTQGVTHSPLYTEGDIANLTSTWEKATKHNFGIEIGLWNKLDLTLDLFKENRKDILMTPQTTSSIVGATFNAINRGETKNHGLELELRWNDKIGRNFNYWGALTFAASENRIVYKDDPRNADEHLKAAGKPIDYQNRFIAIGNYGSIDDVFNYAQTAINGTTASQVIPGDLIYIDFNGDGIINSNDKVVVDELNYPLTTIGFSFGFNWKGLNFSAMLYSPRNIYKLQFDQYLWDFPASNIRVQPKSMERWTPETANSSGVMRPATHLNNTYNKVESTYRYSDYSYIRLKNMEIGYTFPKKWLSEAHISNLQVYMNGNNLLTFWKGDKRVDPETGGVGSYPIVRTYTLGLRVSF

SEQ ID NO: 15249 - protein, 1053 aa, Methylobacillus flagellatus
MNKKLFFTTLFLMLNVVLFAQVTTSKIKGTVTDETGEALFGATISVLHVPTGTLRGTTAQDNGRYTVLNLRVGGPYKITFSYLGFKEQVVNDVYLTLGKTTNIDAKLVEEGESLDEIVISSAKNKIFNNDRTGAQTSVTATQLKVLPTISRSASDFTRLEPTASNGSFGGRNDQFNNFSLDGSIFNNPFGLDAATPGGQTNAQPISLDAIEQISVSVAPYDVTQSGFTGASVDAVTKSGTNEFRGTVYGFYRNEDLTGGKINGQDVFKPSLTQNQYGVSIGGPIIKNKLFFFANFEKDEVTELGSSFVPNTGSGALNESRVLESDLQLVSSILSQVNIGNGQTYNPGAYEGFTYDANSTKGLFKLDWNINENHRLAFVYNFLIASKEKPAHPTALGFRGPNATTLQFENAGYQINNNINSFLVELNSTFNDETSNKLQVGYTHFDDFRTPLSTPAPSITLLNGGSNYIIAGHEPFSINNKLDQKVLQITNNMSFFKGDHTYTVGFSFEKFMFDNSFNLGAFGAQGVFFPSGDIADFRNTVGNPTAEAALVANYQAQFDAAIAANNSRLANGTGNPGGFALAETNVGQLAFYVQDEWNASDDLKITYGVRFDKPLFFDTTQKAQDVIDNACCFAPDIPYYNPNTQQEVTLDNRKMPTDKWLFSPRLGFNWDANGEGKLQLRGGTGIFTGRLPFVWIGNQIANPEAFFYQAVDPDFQFPQVWRTNIGVDYKLESNYVISTDLSYSKDINGAHVQNWGLRNPTGNLSGADNRAYYLDSDKGNNGYVFTNSNKGRTYNFTTKVEKTFDNGLYTNIAYSYLNSKDVNSIEAEITGDAFAFNPVVGNANNDVLAYSKYGDTHRIIGVASKKFNFFGEKAPTTFTTFFEYAKGGRFNYTYGGDINNDGSSVNDLLYVPTASELNSMQFTGAGQAAAFESYIQQDDYLSERRGQYVERYGALAPWRGRWDLKVLQDFNFNVADGKENTIQISLDILNLGNLINSDWGVVQQPRNVQPLGVSVDANTLQPTYTFDETLTDTFAFDSSLQSRWQAQIGLRYIF

SEQ ID NO: 15250 - protein, 730 aa, Methylobacillus flagellatus
MTHNYHQIAANSSTKELNGTLSPSRVALVIALQLGVSALPINLAHADEIESDESMTVFGEANKGYAAGKISTESSLGMLGDKDFLETPFNALGYTDKQIQDVQAQDISDVISATDPSVFTSGETGLNKESFKVRGFNLDVGDVMFNGLYGIAPYYRVSPEMFQRVDVLKGPSALLNGMAPNGSVGGSVNLVTKRAAETPTTAFTLNYLSDAQFGGHIDIGRRFGANDQFGVRFNGAFKDGDTAVNHQSSKTQLAALSLDWRNNIALVEADFYYSTERVDGANRGLSIAPGVKVPPPPSSDTLLAPDWAYNDSKDKGMMIRGELDVTDSVTLYTALGGSRTDFDSNVPQRIKIIDNSGTLEVSQGAVKLDSKRTSGDVGVRSEFYTGPVEHYLVLNGTYFREDKHDAPAGNKGPESWKTNIYDPVWGPAPSGYDNYYQLPADSTLVSYGIADTLSFADGTYQLTLGVRHQSIDFESGIVMNGMSLPTTKLKESAVTPAVALLYKVSSSASLYGNYIEGLTNGKTAPRGSANIGEAFAPQKTKQIEAGLKLDLDDFAHTFSLFEIKKPNGYQDPVTDIYSFGGEQRNRGAEWGFYGTVLEDYTLTGGVAYTDAEITKATDVTTEGKQATKQPKFQAKLALEWNLPAMRDLTLIGQANYMSEQYIDAQNTQSLSAQTIFDLGARYNSTIADTNVVLRLNVNNVTDEDYWTSTHYATLALGAPRTVMLSATADF

SEQ ID NO: 15251 - protein, 978 aa, Methylobacillus flagellatus
MKPHCLFVAGAFSAAMIVSATRAQTASPAPTERASEEEPVVLSPFKVDASRDKGYRATNSISGTRLNTAIKDLPMPIEVITEEFLRDTGARTLRDSLRYSSGILLQTQNDYSAPAGSFSTSPGKINNPEGMTASATQTNMKIRGFQTESVLRDGFRRQNATDSVNIDRVEIARGPASLLYGVGNFGGVVNYLVKQPLRERATELSATYGSDNFMRATLDTTGPITANGSVAYRLTGAWQDTGSYTDFNDENHYFISPVVSWRPFESTELVFDVEYGHQKNMGIGWQTLRAVASPYVNEASGYNGNFYQIPGRDVREFRWSGPDTYRDGESANFLVKLTQRITDNLHLLVGVNRSTFNYDQLDNLAHFRRIEGDPGDIAWAVAPVTYAGLSSTQSGIPVGPQPSAIGYQWELRQQEDVHDQVRAELNFAGELFRDSSKWLRMKHSLLGGFSYTRETSEYHTRQTPGDVVNYHSPADYSYFRFGQQGNGTPDHPLVEWDNQETTVSNPALYLVYQGRLLDDRLTLIGGTRRDRSWNSVWQYNPQYRSDGTKGGDAERTDLRSDTNKDTTYQWGASLAITPKKDLSIYWMRSEGVQPNYQGKLDLYGRPLQAAIATNKEIGLKFDLFGGRLSGTISKFKIVRERGQVGSSSLVWFAPVVSGNLKFDPAKDIVYRVDELNPVTNDWNGAAVASAAQWDAAVAAGSVYQATNSAGETHWYANASKPTGAALLDAVFANVHAQKQYGWWGWIYGGADPGSLPFDNLVNNATMDDNGAQRAVATGTDQSKGWDTQIIWSLTDNLQVVATWSHIEKRVLNAQAWAKYPYPQDRWAIWYAPISWAATAGRPLSEVYTDPTDTSTFIAFGKGLPMDDTPENQATLWVNYKFTEGTMKGWSFGAGGWWEDERSIYPAYGQNALDNQGNPIFLSTKARTSVNAMVRYEFLLRGRESSVQLNVDNVLNDRDLYGFIYAAPIRWQLSFNHRL

SEQ ID NO: 15252 - protein, 697 aa, Methylobacillus flagellatus
MQISRIALVAALAASHPAYAQEADTLDLGTLTLEAESDATLLQNGYVAESGRQATRVDTPIRDIPQAISTVGQDQIEDQEPRTLLDALGYTSGTNVTNFGFDSRYDAVYLRGFSAYYDGLFRDGLRQVNGPSAWFQNHPYTFEGVSVLKGPSSSMYGVSGAGGLVNIISKRPKDDAYNELKLTFGTDSRKELAFDFTGPVGTDGRLSYRLTGVARDADTPLPGYSDDLALLAPSFTYQLTDRTKITVLTEYSESTRGGTASYYNPSQGEASDIYVGDPDYNDFVNEQWRVGYELEHEMDNGVTLRQNLRYSEVDADLEFSGIYAAGTGFGRYWGHYLENSENFSVDTYAEGHFSTGAFDHTVVAGFDYTQSSYDAYYGGVGYVSAADTDAMDQPYSNGQEMYQYGVYVHDQLSSGPWTMFLSGRYDWVDMTTFDANQNGTDTSHNGFSGRVGLSYAFNTDLSVYANVSSSFVPTTGLVYDDSTDPNSGRSAEPTRGLQKEVGVKYQLPGTESLITASLFDIRQEDGVVFQTVDPATFNGLNQVQVPYDLRSRGLEIEGQFNFANGLRVTSAYTYLDMEIEAGSTGTVGNQLSATPHHTASIWGFYEPQSGAFKGFGFGAGLRYVGESYGDDANTYKNDAEVFADLSLSYDFGEVGYEGLSAQINVKNVFDNTDQTCSADYCYRYEGRTATASVSYRF

SEQ ID NO: 15253 - protein, 291 aa, Methylobacillus flagellatus
MHHSDFTARGHNMKTLRLTLALVLATLASIALPAHAQKKGDNVVSAGWFHIRTHGQSDPLTTTLLDVPINYPLGLPSTFTAPGSSISSSNANTLGLTFSHFVTDHIAITAVGGIPPEFKLYGHGELIPPGPAGALGRQSLGDPALNPIITKARQWSPAAMVQYHFLDPGTRFRPFLGLGVSYNFFTNIEVNPAFASSVNNNLGAILAAGAGIPGPTSVSADASSSWAPVFNIGGTYNFDEHWGLTAAVTYIPLKTTSTMTIKAANGTVLSTSKTKLEPNPLVFFVAASYKF

SEQ ID NO: 15254 - protein, 287 aa, Methylobacillus flagellatus
MAGAKEIRSKIASVQNTQKITKAMEMVAASKMRKSQDRMAASRPYAETMRKVIGHLAHGNLEYKHPYLEDRDVKRVGYLVVSTDRGLCGGLNINLFKKLLAEMKTWTDKGVQCDLAMIGSKGVSFFNSVGGNVVAQVTGMGDNPSLSELIGPVKVMLQAYDEGRLDKLYIVSNKFINTMSQVPTISQLLPLPASDDDDLKHKSWDYLYEPDPKALLDTLLRRYVESQVYQGVVENLASEQAARMVAMKAATDNGGSLIKELQLVYNKARQASITQELTEIVSGAAAV

SEQ ID NO: 15255 - protein, 667 aa, Methylobacillus flagellatus
MPASSRTRHATYFIALGAITGAGLLGTPPQTHAGGHGHLAPIVITAPVMTSPGELETDPRQARLPLPAQDGGSFLKSIPGFTTSRKGGTSGDPELRGQGGGRLNILMDGHPVLGGCGQRMDPPTAYIYPESYDRVRIFKGPQTVRYGAAPAGVVDFQRDPQRFDEPTVTGHASMTVGRFDRTDLMADVTAGSSEGYARIIGTISKQDDYRDGDGDKLHSQFERWSGTGILGWTPDEFTNLEFAYERSDAEAAYGDRMMDGTTFDRTGYSLTARREALTPWLDAVEFKAFYSYVDHVMDNFRMRSAPQQTVSFPDRRTTGAKVDAELVLAEQTWLTVGLDYTEDEHGRGRRTTMGGANTLQEVLSTDYSRNDTAEFRDYGMYAELEHGLTARDYVFFGARIDRNRAEAESMYGGATPGTTDRNTLWSGFARYERDLADLPLTLNIGVGAAERAPDFWERMKDFDLETERLTQLDAGVQWRGTRVNATLSAFYGEFSNYILVGAESGDPDARNISASHYGLEADLTYRFSPTLSSTTTLAWVRADNDSDNEPLAQTPPLEGTLSLDYDDGRWFAGGVVRAVERQDRIHEGFGTIYSVDTGETPGFATLGLYAGHRFTQQTHATIGVDNVFDRKYREHIQGGSPDLDPNGRFAPLNEPGRQYWMKVATRF

SEQ ID NO: 15256 - protein, 1002 aa, Methylobacillus flagellatus
MSNYKKQDYDKQQKTNKTQSAPLFKKSLLAMCIVALNAPVYAQNTEPPVEEVVVYGIKQSLESAQAIKRNSATVTDVITASDIGALPDKSVVEALQRVPGVAIERFEASDDPDHFSVEGGNVTIRGLNRVRAEFNGRDAFSAGADGGMSFSDIPPELVGSVEVAKNQTADLIEGGIAGTINLNTRKPFDKDGFTAGVTVKGSYGDLIEDVNPSISGIVSNVWDTDLGKVGALFSVSASNFTSRGDGIGIYNYYEKDAPDVGNGVTPIVPNAASARQQFNDRDRLGFAGSLQWANPSDTVLATLEFIRSDSTVAWNERFIESPAQPFTGDAGTDRITLGDDYTFACPASDATPCQFRSGTLLGGTYPWGNVPYVAGARAREDERVINDWSFNLKLSPSDNLTLWADVQYVKAENSIKDNTAHGKFFSDIYLDIRDEDNPKLEFLNDNVANPESYFMRSAMDHISENEGDELALQLDAEYTFDDQWITGVKTGLRFSNREVTVRETIWNWGGLTETWSSQGEGSEAFYDGLLDAGMVEQFTFDSHLSGNALKGNNTFWFPSESFLSSTENMYQKLVANDGRTVDGAWVPLHRRAGVIPGTSFLPSEIYVTEEDRYAAYVRVDFGSEDGALRYSGNVGLRYVTYELASTGASNFPNPVGAELQNPGLDPSLPQDVIDYQTGDGTLATTIRGKKFDKVLPSFNLKVELTDDLLARLAVSEAIYLPELNAVRNQRNISSVMTVLNDPDSNAVTGVIHEGFYANGAGNPYLQPEEAVNVDLALEWYFDDLGSLTLTLFNKDVDGYFRQATETELVTNPENGITQEVSSTRTINGGSAEIRGYELAGQTGLGFIHESLTDFGIQASYTYIDGDADDGSSEFDPTDSPEDTFRNFTGLPLEGLSQDNYNLVVFYDNGTFQTRFAYSWRSRYLLNSRDVIAFSPIYGEATGQLDWSASYSLNDTIKIGLEANNLLDEVTRTSIQYNQEGVRTPRSYFVNDRRVGLFIQATF

SEQ ID NO: 15257 - protein, 917 aa, Methylobacillus flagellatus
MMTNKFKLTAVAFSVLSTCVYAEEMLDQINVEYKLPPKQEVFKKAGATSVRENISTSTQSIDDIIRTVPGAFTNLDKSSGTVSVNVRGQTGFGRVNTMVDGISQTFFATSGDNSEKAGGTSQFGATIDPAFITSVDIQRGSFDGKAGANALVGSANFRTIGVDDVISEGRNVGALLNVGGGTNATGPNYMGAVAFRYPFSDTRTLGFMYAYSWRKSSQDFKVGGGRSIKDVDAEEVGRIVEEACKGEAFCDRNEKRKLYGLQPYDPSKLLHYPQSHLAKIEYNDKYNKAILSYRSLSTALSGRNLENKNYQLNYQLKPKENLQFELILADNTSTQTYHKGSVFNGKMLKDVLESKNSAKTTDINMHFSIPFTEKFSYEATLGANILKNKYSKNRHPRELGYYFDGGEPNSLDACDEVGKYKNACKYHGIRSNTFQPDGEQRFKTLYFDQTFKYDIYTLKVNANRQIYKYEGRIFPLDPKDRFSSRTWHDSHKKMKNGKPIWVNSNSSEIVAKYGVEEAEKLGCYTGPNDDDTTWDVYNCPSFYSVHKGDSRSHDNYSMSFSADFHPLFSPFVSYAKTHRVPNIKEMYFSEFGTLAIRPDLKSEKAKTIQFGINGYKNGIFSDFDALGFKILAYQTKIRDYIINIKQECSSNAWRGSNKAPTIYDCVEHLTHINYEGGKTILKTDLVDTGDGKTKVPSNQLIPADSSPIVKIQGLELELNYDIGWFYANLSYARQKTNQPSSFSDSSYNVSDDSETGQYLQGFGLSKISSLPKDYGSLDLGTRLFDGKLTLGGTAKYYGKSKRARLDKADGDVILPGTFTSRKTGETFLTYVRISGTEEIKAQPIIFDFYAIYQPTENLTIKGEIQNAFDKKYINPLDANNDSANQMTYAMGVGDGYQKALNNYSKGRTFVLNVNYKF

SEQ ID NO: 15258 - protein, 425 aa, Methylobacillus flagellatus
MTTAFFKKSLIAAAVTLASTQTFAAAFQLNEHSASGLGRTYAGEAAIADNASVLSRNPAAMTRFDKMALSVSGTYIKPDVDVSGELYTGPTKRPASESDIAPDAFVPASYFIQPLNDQWAWGIGMFSNYGLATEYSKNFAAGAGAGDTELLTFNINPNIAYRINSNFSVGAGINAVYAKAELNRYAGALAISPPLNSDTAIAHLKGDTWGFGWNVGTLYEVNEDHRFALTYRSQVDLSFDGDFKGSTSNFQTVDGNLKLDLPAQAEFAGYHRLNQQFAVHYSVNWTDWSAFQELKATSSGCNMPGQPGVCLNKPEKFKDSTRYALGGTWYISPSWEARIGFAYDNSPIEPEYRSLSIPDSDRVWYSAGATYNIDKDMSVDFGMAYLDGKEVDVNEGLRSHDDVLRWKGTSHGNAFLASAQFNMKF

SEQ ID NO: 15259 - protein, 597 aa, Methylobacillus flagellatus
MHLERSLSQQHKQGKGMIQNTKTSSLNTMAIRFKPYIRWCLLPLIAALLQQQSAYAQVAPPDQELLRQQERERALREQLERDTDARLQEVPGKTPSLLPRDETPCFPIQKIFLEGDKAARFQWALTAANPPHDPAIGRCLGTAGINIVISRVQNAIISRGYVTTRVLAAPQDLKSGELHLTLIPGRLAHIRFAPGTKPDATFWNAIPAHPGDLLNLRDIEQGLENFKRVPTVEADIQIVPTEGDNSQPGQSDLLISWTQGRPVRFNASFDDSGSKSTGKTQAGATLSLDHALTQNDLFYISLNRSAFNGSKRGTRGITLHYSMPLGNWLIAATHSGYNYHQSIAGSQQTYIYSGESHNSELKLSRRLIRTARSKSGIYLRGWTRDSKNFIDDTEVLVQRRRMAGWEMGLTYRRYISTATLDTTLGFRRGTGAFGALPAPEELFDEGTSRPKIYFADAQFNLPFQLGRQSLRYTGSWRAQWNRTPLITQDRFSIGGRYTVRGFDGETTLIGERGWLLRNDLGLSLGGDQEAYLALDYAHIGGASAYLQQGNHLAGTALGLRGGHRSLFWDVFVGAPINRPRTFSNAYTVTGFSLNWSF

SEQ ID NO: 15260 - protein, 341 aa, Methylobacillus flagellatus
MKKNLIALSAALLCAAGAHAQSSVQLTGLSDIYVGSMKMAGDADRRSVVNSGGLTTSWFGFKGTEDLGGGLKASFQLTSFLQVDTGTQGRFANDTFFSRDANVSLSGDFGSVLLGRWMAPNFLPSVVGNPLGDSFTFSPLILHMNVPLFNGTGWAATTPADTGWSNQIVYSTPKIGGFSANIQYQFGEQAGNNGRKNVGANFFYFGGPLTLTGFYERDQIANPGQGAYLGTTRKDWMLLGAYDFGMVKPFLSYGEAKADNTSNKARTMQIGASIPAGPSGKVLVDWVKTEMTQTDIDRKTFTVGYDYFLSKRTDVYAMLMNDRITAQAKGNSFGVGIRHRF

SEQ ID NO: 15261 - protein, 714 aa, Methylobacillus flagellatus
MSRKRYVIARCAGIGFAGLVAPPLQAEEVALEEISVTSDKPARRAGEGAAAGPNPPGSVGVLPVVSDRFSTVTVVSGAELARSQPTSLGEALFDKPGLSATTFAPGSASRPIIRGLDNHRVRILENGTGVQDMSDLGEDHAVPINPLINDRIEVIRGPAGLRYGSQAVGGVVSVENNRIPTSLPPGGVAGRVTTGYSAVDNGRNVAATVDAGSDNVAVHADAFRSAADDYNTPLGIQRNSFNESQGGAFGASYLFERGFVGLSFSHFDSVYGIPGLGSAAQRTRLDPVQDKLQARGEVRPLDGPFAAIRFWAGGSNYRHNEFGTDANGVEGIEAVFKNRAAEGRIEFDHVPVETAFGTLSGQLGFQADRRKLRISGAEGGLLRPTDTRVQAAYLFEELALGGGLRFQAAGRIEGNRVAGTQALFPADFLPDGPGDEPVESRRIRRFAPKSASFGALQDLPYGFVGSLTGSYVERAPTSPELFSRGPHEASATFEIGDPNLRPERARTVEVAIRRADGPFRLDATGYVTRYTGFVYKRLTGFTCGDTFDSCGIGGGDLRQVAYSQAGATFAGAEIASQIDLVPVGDGFAGLSAQYDFVRAQFDDGRFVPRIPPHRVGGGVFLRADGWFAQISLLHAFAQTQTGALETPTPGYNDLKAEIAYSRPLDPAVHGLSEVTLGLRGTNLLDDVIRNAASFRKDEVVLPGRNLRLFLTARF

SEQ ID NO: 15262 - protein, 1083 aa, Methylobacillus flagellatus
MSKRFLLLILVKCLTLDVLLANPAKVQDKRMDEVYMSMHFQNATIEEAFKQIEAASGFNFVYTNKEIKGVPKVALQVNTNVFDALVTLSRQTKLEFRQINENIVVRKKDVYVPETAVVIEEAAAISVSGVVVDESNMPLPGVTIIEKGTTNGTVTDIDGNFSLEVNSSESILTFSFIGMESIEMAVGERRTFNITMLDDIQSLNEVVVIGYGTQTKKEITSAVANVSSEDFVQTGVRSPMELIQGKVAGLNIIRTQGSNPNAGTDIQLRGLTSVEGTTQPLIVIDGIPGGNLDLLQQDDIATFDVLKDGSAAAIYGTRGNAGVILITTKKGKSGQARFDYSTYFQREFVDRRPDNLTADEYRDLIDQGLVDEQNDFGTSTDLYDELINKENLSQYHNFAASGGSENSNYRVSFFFNDAEGIAKENSRKQYGGRMSFSQTGLQDRLTLATNMAVNLFDANRLGGGGGDFEQAIQRNPTAPIYNEDGSFVETEAYNNYNPLSRFANRISERKQLNLSGDVRLTLEIMEGLTASVFGAHQRRTYNDRYYQSMNDFANRPASQYQGTGYASKYNYINWNNTLEATVNYKRIFNLDHSLDVIGGYSYQYFTTETFNVNNSGFTTDGFLDWNLSAGSAINNTLLPRPGMDSFKDDNTLIAFFGRASYSYKDKYFAQATLRREGSSKFGENHKWGNFPAVSVGWALSEESFLSSSSTVNNLKMRLGYGVTGNQGIGNYLSLVTLGTGGVYPQEGVYYQTYGAARNPNPDLRWEKKKEWNLGFDFLLFNRKLTGSLDFYTRNTEDLLYNYTAQQPAFVKGSLFTNVGTINNRGIELYLSSQIMERGDFTWQMDLTANTQINEITSLSNDVFTVSWIETGGLPSPGNLGNAIRVEEGGAVGNFYGKKFAGFNEDGKWLFYKADGSTGTAGEMSQEDLTIIGNGVPKYMASLNNVFRYKGFDFTVFFRGKFDFDILNTKEMYFGNKRWLPNNLLSSAVNKHVELDDDPQYSDYYLENGSFVKLDNITLGYTFKVDGKYVKNLRVYAAGRNIATFTGYSGLDPELQDAGFTTGIDGRGFYPRTKSFTVGLNIGF

SEQ ID NO: 15263 - protein, 232 aa, Methylobacillus flagellatus
MLKRALLGATALALLAGSASAADLATRYPVKAAPIPVQTFSWTGFYIGGNVGWGWADNTYDVTPFGSLIGYSYSPGTGNGFIGGLQTGYNYQFANNVVIGVEADFDWSDIGSSSLVVGGPFTGGAISQNIDYFGTIRARLGYGIDRFLPYITGGAAWAKQNFSDFYGNTYNDTKWGWTVGAGVEYAITNNWTVKAEYLYLGFNKNTTNDYFGDSYSVGSNISTAKLGVNYKF

SEQ ID NO: 15264 - protein, 860 aa, Methylobacillus flagellatus
MKYSRHDASNRCRFLIEAHASDMQERSKAIRVGFENPRIASATEDRAGGYGDFSWTSRAKRRAVRRCVENIGGWIVKRILFIGALLGGESYGALAMAQDSTNLPPVTVTSDGQPRNVRQNGVTNARGRTARRSRQASQRNQAPAPQQLQSAGVLAAQNQVLSTGPTLPGASSVSPQGIAILGGPAQTSFYQALTMVPSVTYGSPDPYGLSPTRNINIRGKGDFHLSRNIEGVPLMGIVGGTDLFDLENIRRIDIYRGAVPSDQGLGISNATGVINQLILGPQDKAGITGRQAFGSYDFYKTFVRIDTGLLNDAGTQAFISGSNIGADKWTGAGDQRRQNVTFGLNQNFGDRVTLNVNAVYNKYNGNNFRALTYAQASDLKNNYRFDYNTVLTGVSATDVNYYKFNQISSEVFATIAKLDYNFAEGQHLLFKPYYWNNNTTRSNAAGNNVQIWRQQNDNVGSVFEYTGQFPWGTDVVAGYWWQSMKPPPPPTDQRRFTVNADGGLDFSHWQSLAKIDNFSVNSPYFQISQKFGATFLTGGLRYMVLGAPQMSYYNTAGIPDGTYDQALALNPAVYPDAVLSARDYVAWLPNVAIRHDLNSALSVSFSYGRRFGRPDWGPQASNYINNRAAFLAKGFTLQTVVDKVRAELADHFDASLRFSQYGLTVIPTLFYAKHQNKQVKIIDPSIGPNVAYFQGTGSSTEYGFELVSSYSFDDRFTVFGSATLASETFDADTPTLGGGALLATKGKQIQNTPQVMLNSGITYQADGLAITPIVRYIGPRFGDAANLQCVPGYAVADVTVSYNLGSLINIESLTASLSIQNIFDRQYIAQISPSDIDLSSGGTYYPGAPRTVIGSLSAKF

SEQ ID NO: 15265 - protein, 758 aa, Methylobacillus flagellatus
MNIRCILPIISLLLGLAPALAQDRELRGMVTDSEGPVPLANVYLRNLETGTATDVDGQFRLEGLPDGTHTLVVSAVGYRTHRQSVRVGPAGSRLEIRLQPRAEQLNVTVVTGTLKAVRRFESPVPVEVYSPAFIRKNPTANVFEALQAVNGVRPQINCNVCNTGDIHINGLEGPYTLVLIDGMPIVSGLGTVYGLSGIPNALIEQIEIVKGPASSLYGSEAVGGLINIITKNALTAPEFFADGFATGWGEYNLDAGGSLRIGENTRVLTGINYFNYDVPTDNNGDNFTDVTLQDRISVFQKWNFTRDSSREFSLAGRFFYEDRWGGEMQWTPEFRGTDSIYGESIYTRRWELLGRYQLPLPEKLLLSVSYNDHRQDSWYGDLPYLADQRIGFGQLSWDKTAGNHDLLIGAALRYNYYDDNTPATDSPRGNDPDRVWIPSLFAQDEYRFSGKHTLLAGLRYDQDPRHGSIWTPRGAVKLQLGEHELLRLNFGTGFRVVNLFTEDHAALTGARDVVIAEDLLPEQSWNLNLNYLRKFYTPDGHFFSVDASAFYTDFSNQILPDYDSDPNRIFYRNLDGRSVSRGFSLNLDAAFANGLRVAAGTTLQDVRVDAEGTNSRPVLTERYSATWSVSFPIRPLQLTADYTGNLYGPMRLPLAGDLDPRPEYSPAWSIQNIQFTFKGLEHMEIYAGVKNLLNWTPNRGTPFLIARAGDPFDKQVQFDASGDPVPSEGNPYGLTFDPAYVYGPNQGIRGFAGLRYQL

SEQ ID NO: 15266 - protein, 400 aa, Methylobacillus flagellatus
HFHGYARSGIGWTGSGGEQQCFKTTGAQSKYRLGNECETYAELKLGQELWKEGDKSFYLDTNVAYSVSQRDDWESTDPAFREANVQGKNLIESFPGSTMWAGKRFYQRHDVHMIDFYYWDISGPGAGLEAIDLGFGKLSVAATRNSEAGGSSAWINNQRKDADKTINDVYDIRLAGLETNPGGSLEFGVDYGRANTQDDYSLAPNASKDGVLLTAEHTQSMMGGFNKFVVQYATDSMTSWNSGHSQGTSVNNNGHMLRVIDHGAINLAEKWDMMYVALYQDTDWDNNNGTTWYSVGVRPMLQMELPIMSTLLEIGYNNVKSQRTGKRNGQYKLTLAQQWQAGDSIWSRPATRVFATYANWDEKWGYNNVDKSPDNGLAQNGTIGTDSRGKSNECTFGAQF

SEQ ID NO: 15267 - protein, 731 aa, Methylobacillus flagellatus
MDQSQKDGLEIIKVQGEKRERSLSETTSSVAVTTAQKIDQENLLDLSDIITRTANVSETYGGSGFTIRGISDEGSSANPLATVYVDGVAIPSQVNDAGPTDLWDIAQVEILRGSQSTVQGENSLAGAIIISTQDPTMDWTWKTRAIWSDPNDRRLAFAGGGPIIDDELAFRVAVEKRDFDGYTKNITRNEMEDSVDSLVTRLKVLWNPAGLRDFTAKLNFMRDDREDPYRFSYTRYDVENYYDNRVATSDHENVTDITTDIVSLDLSYELSEHWSLASVTSQSDSDSLRLYDIDLTEKDERYGEMNHDYKNQSQEIRLSFDYPDFHGLFGGYWSNREKDAMDNQLAGVATPVTTIVDVLQNMGLDETTATQFANSYSQELPLIPVDYESDVYDRSTNRAIFADVEYALAENIALIAGFRYDTERYTYESLTETAFAGTLPDPTNYGEPGTAPHSIISGINQEVLNLVDRAGNSIPESTRDFNAFLPKLAVRWDYDNNDSLALTVQRAYRSGGSSYNIARAEVFAYDPEFTTNYELAWRSHLLDNSLFVSSNLYYIDWEDKQVSANFGLNSFDSHTVNAGKAHLYGMELEARQYVNSYMDWYGSYSYSRTQYDQFEAIAGAQVRNFSGTEFIYAPKHTAALGVNLYPARDWTVNVNANYRDSVLMSTRETDSRVSSRTLFNAKISYDKFDWSAYIFANNIFDKGYIEYARTDVPLAIFGAPRVIGVGFEAEF

SEQ ID NO: 15268 - protein, 267 aa, Methylobacillus flagellatus
MERAIPTFPCRDLDSASAFYQSLGFHLGARYPTYAILQRGALELHLSLFEALEPKTNCSAAYLRLEDAQALHRQAAALGLGSQGIPRITALEDQPWGMREFALVDPDGNLLRVGQELDATPEQHRVRLASADDVPAVAALWQANVREAGETLDAGDQQAIQALLLAASRNRLLWLAEAQQHPRGFVLAHLWQIEDGQARVGEIAELYVLPQARRQGLARELVGSAEEALRSRGAGLIRAQSALDAPLSNLFWQGLGWDADYLTFTRY

SEQ ID NO: 15269 - protein, 704 aa, Methylobacillus flagellatus
MTTFSSQSIFGMTCLWLSIQLVYAQDLQVLNAIQLTATAQKNSFLEEPESAATKFVLDPLKTPQNVQVVNQKMIEDINAQRISDVVGLVSGVSLLNPTGGIWDNYSFRGFNTDQTIGVASLRNGLTSYLGFNVAHDLVNVERIEFLKGPEAALYGAGEPGGVLNIVTKKPEFEPHHSIELRGGSYNQYRSAIDSTNAITETIAYRLGVAYENNKSFRDEVQNNKLFVAPQLTWKPSDTTQVDYDSEYTVLNTLFDRGVLAVNQQLGAIPNSRFLGEKDDGLMTVNDYLQQVRIQHQWNPMWSTQTILNYKDNTWRGFSSEAYQLLNAQGDLNRERRYRIYDTTSYLFSHDLTGQFNTGSLNHRLFIGMTYSDLKVQNHLLRYRKKGSTSSEINIYDPIYGVNLPAVTSVYNTLERQKNAALSLSDYIEINPKWAVLLGGRYDYYQQDYREFIAGIQGGQYFMHFSPKVAVNYLLDDHASLFASVGQSFHLNSGLDIQQQPFKPEKAWTYELGTKAKWLDDRIMASVSLFHVKKQNVLTTNPLNSAYMMPVGQETSRGIEFDLTAQPVDPLNLKFAYAYTDAIVSKSEESSGIAKGSALLNSPKHHLNLLVMYDVWQAGASKIGLGGNIQYVSARTGNVYDNGFNLPSYTLLNLNSYYQMNPKLKLQLNLNNLFNTIYYTASVKDEWVAPGHPREIFLSINYQFN

SEQ ID NO: 15270 - protein, 814 aa, Methylobacillus flagellatus
MLHRPGARARLILGASVLALLAGPEAYAQAAAQTAGQETALETLVVTAQRREESANSVGMAIQAVRGEVLEQLHVTDTRDLSAFAPSFTVSQSYQGVPTYTLRGIGFNTINLSATSTVGTYVDEVAYAYPFMMTGPVFDLERVEVLKGPQGTLYGRNTTAGLIDFVTRKPTEDVEGALTAEIGNYQTKNLEGYVSGPLAEGLAGRLAFRMENSDKGWQVSNTRGERLGEADRWGVRGSLAFNPNDRLSVDASVSYWKNQSDTVAAQGIGFTPATANSPFLAPGLADYIAANPPTKATQADWAPESVRGVDIGIGPGHAGPLREDNTFLGVKLKVAYDLSDSVRLVSLTGYNDLKRRALFDWSGAPYEILLQRAVGDIESFSEELHLEGSTDRANWLVGAYYAKDEILDSNRTLLGQNANVGLIRFAGAGLLATPFNTGGYTAEQMAQAFRTYVDRGDIETKTWSVFANGDYRITEALKLTLGVRYTEDKQDYAGCSRDFNGSMLPNVNVVNRALYFQTYGVIPDQIAANACNTFDPATGQFGLVTSTLDENNVAWRVALDWTPAENLLLFGSVSRGAKAGATPINAANISTQNAPANQELLTAYEVGFKAGLLDRRMQANVSAFYYDYEDKQLSVYFADPIYTALSRLQNVPKGEAYGIDGEVTWRIMPELTLIASGTLLHTEVKGYVGINAAGQPQDFDGAPFLYSPKRSFALTALYSRELTSELGLQAAVNARWQSDSHADLEGDPRFVIEDYGLVNASIGLHSLDERWRVQLWGRNLTDEYYWTAVSSNANVVVRFPGQPRTYGASLTLSF

SEQ ID NO: 15271 - protein, 225 aa, Methylobacillus flagellatus
MMKLKNIVIATSVLFGTATFSFAAGSDNMDMSADTNTPVTQSSSSNSFIAPFANTYSSLTNKNNTWGPQDRTGQWYFGVDANGLAGTPNSPSGAGANMTIGYNVNKYFAVQYNQLVGRVFAGLGEGVINFSNSTMITPYAAGGAGWANLAGQATGAWDVGGGLKFELSRDVQVSADYRYIQTMAPRGMSGAQGRAGTNMIGGGITWFFGGKDDTTNDTGNIQDNG

SEQ ID NO: 15272 - protein, 719 aa, Methylobacillus flagellatus
MPASTFRPHINMLAIACVFSPAAQAQDASKADHPSLPETVVTSAPAGSPARRASVGSFPEASLLDTPASINVITHEQMQDRSIRSATDAVKWDASVQNSYNAVGLADWFAIRGFVLNQGANYRKDGMVILAQAMVPMENKERIEILKGLAGMQAGIASSGGIINYVTKRPTDVPLRSATFEVRERGTVYGAVDLSGRSEDGIFGYRINAAAEDIKSYVDGSTGNRNFISGAFDFHLSPRALLQLDLDYQHKSQLTVPGFQLLGPEQRIPTGVSAKQMLNDQSWSRPVVDDSYNIGLKFNYELNDHWHTTLQANQSTLHRDDAVTLPSGCQTQGLIVGFCSDGSYSMYDLRRKNDKRSITATQALLQGNFTTASVHHELIAGLSTLNRRDHFADYVYNYVGESNIYAPVYYDNFPLADVNPVRLRRKDEERALFVQDVMSLTNQLKLHAGVRYVQFKRDQFNSSGVLTHRTDDDFVLPNLALVYKLQPELAVYGAYSQGLEPGGTAPTGTTNAEVIMDPNKSRQVEFGVKAEVTPSVSVSAAVFEIKRKNEYVDATPTYVVNGTQVNRGLEFAAQGRVTRNWALSASVTALQARAEGTGDDRIEDKQAGNVPRFRSALYSEYTWPGLPALKLNAAWIYSSSKAFAPSNEIAALNRKVEGYHVLNLGGAYTTKLGNTATTFRFGVDNVFNKFYWGDASSAFGGYLIPGAPRIFRLSAQIDF

SEQ ID NO: 15273 - protein, 258 aa, Methylobacillus flagellatus
MNRRWNLVLATVALALSVASCDVRSKDKDKDQGSLVEYKDNKDTNDIELSDNQKLSRTFGHLLARQLRKSEDMFFDIAEVAKGLQAELVCKSAPLTETEYEEKMAEVQKLVFEKKSKENLSLAEKFLKENSKNAGVVEVQPSKLQYKIIKEGAGKAISGKPSALLHYKGSFINGQVFSSSEGNNEPILLPLGQTIPGFALGMQGMKEGETRVLYIHPDLAYGTAGQLPPNSLLIFEINLIQASADEVAAVPQEGNQGE

SEQ ID NO: 15274 - protein, 743 aa, Methylobacillus flagellatus
MHISVAIGETIFSKPAIRQPALWNDCVRAAVIMPYASHRALVALGVVLATLPGARAEEAGQAALPEPAIGLDTLSVTATKTAIPAVDALAGTSVVPRAALDRLQPGRLSEVLRDVPGVITQENRNDPAQAINIRGLQDFGRVNVLVDGARQDFQVSGHGANGVFYLDPELVGGVDVTRGPTATVYGSGAIGGVAAFRTRSIDDILAPDESAGFVQKQGFGTNGQRFVNSSALGARIGTAADVFGQFVFRDTAPYRDGAGLPVPDTGSELNAGLAKLTLRPAEGHALHATALLQRFAFVNGGDTGAGARFANAVQADTVTFGYRFARPDVPLVDLSLDGYATTTRDALTFLQDSPRGLYGRLGTRAGDRLTYDLATAGFDAHNTARFETGPVAHALTLGGDGVANRVRTTDQAGGFGAAFTPSGRRELAGAFLQDEIRAAPWLRIVGALRHDGYRLDGGAYRARGARVSPKITVGVAPVGGLELYGTYAEGYRAPTITETLMEGIHPFPAFAILPNPALRPEVARTVEGGANLRADGVVGPEDALRAKLALFDTAVDGFIDMQAVGPAYYVPAIPGVPASICAARPGRFPCVIPARSYQYRNVARADLSGAELEGTYDWGRGFVSLAATHVDGRDRATRESLLTVPPDRIGTTLGLRFLADRLVVGTRLTLVEARTDLPAAARSRATKAYGLVDLFATCAVTDRITADVAVQNVLDRRYRAYNDALASPGLVAKASLSIAFATR

SEQ ID NO: 15275 - protein, 147 aa, Wolbachia endosymbiont
GPISDEETSYYVRLQYNGEVLPFKTRIDGIEYKKGTEVHDPLKASFMAGGAAFGYKMDDIRVGVEGLYSQLNKNDVSGATFTPTTVANSVAAFSGLVNVYYDIAIEDMPITPYVGVGVGAAYISNPSEASAVKDQKGFGFAYQAKAG

SEQ ID NO: 15276 - protein, 179 aa, Wolbachia endosymbiont
SYYVRLQYNGEILPLFTKIDGIKNTAGKEKDSPLKASFIAGGGAFGYKMDDIRVDVEGLYSWLNKDEDVVGDTVADNLTAISGLVNVYCDVVIEDMPITPYIGVGVGAAYISTPLATAVSSQNGKFAFAGQARAGVSYDVTPEIKLYAGARYFGSYGANFDKTDKDGKGELKVLYSTVG

SEQ ID NO: 15277 - protein, 293 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGESKFVSTAGG

SEQ ID NO: 15278 - protein, 736 aa, Helicobacter pylori
MKKHILSLALGSLLVSTLSAEDDGFYTSVGYQIGEAAQMVTNTKGIQQLSDNYENLSKLLTRYSTLTNLIKLSSDPSAINAARENLGASAKNLIGDTKNSPAYQAVLLAINAAVGFWNVVGYVTQCGGNANGQKSTSSTTIFNNEPGYRSTSITCSLNGYTPGYYAPMSIENFKKLNQAYQILQTALKKGLPALKENNGTVSVNYTYTCSGEGNNNCSLKVTGVNQQNGGSKTETQTIDGKTVNTTISSKVVNGGTTTNRGPSYTEITNALSDVPNSAQFLLAQASTLINTINTACPYFHANNSSEANAPKFTTTAGKICGAFSEEISAIQKMITDAQELVNQTSAINTDEQTTPVGGSGGKPFNPFTDASFAQGMLANASAQAKMLDLAHQVGQTLNPERLTGSFQNFVKNFLATCHNPSTAGTGGTQGSDPGTVTTQTFASGCAYVEQTITNLNNSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVGSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEYVNLATVNNVYNAKINTANFQFLFNLGLRMNLARAKKKGSDHAAQHGIELGVKIPTINTNYYSFMGAALRYRRLYSVY

SEQ ID NO: 15279 - protein, 735 aa, Helicobacter pylori
MKKHILSLALGSLLVSTLSAEDDGFYTSVGYQIGEAAQMVKNTKGIQQLSDNYENLSNLLTRYSTLNTLIQLSADPSAINLARENLGASAKNLIGDTKTSPAYQAVLLAINAAVGFWNVLGYATQCGGNGDQKSTSSTTIFNNEPGYRSTSITCSLNGHTPGFYGPLGIDNMKKLNEAYQILQTALKQGLPALKENSGKVDVTYSYTCSGKGNNNCDPLLLGIAGDKRNGGSITKNQTIDGKTVSTTISSKVVQPTNGAAYTKITNALNGVPDSAQALLAQASTLINTINTACPYYYVTNGSGPQMEPARGKLCGFTQEISAIQKMITDAQELVNQTSAINANSQSTPVGESGKPFNPFTDASFAQGMLANASAQAKMLDLAHQVGQTINPENLSGTFQNFVKNFLATCNNPSTAGTGGTQGSAPGTVTTQTFASGCAYVQETLTNLNNSIAHFGTQEQQIQQAENIADTLVNFKSRYSELGNTYNSITTALSSIPNAQSLQNAVSKKNNPYSPQGIETNYYLNQNAYNQVQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKLNVANFQFLFNMGVRMNLARPKKQGSDHAAQHGIELGLKIPTINTNYYSFMGAELKYRRLYSVYLNYVFAY

SEQ ID NO: 15280 - protein, 744 aa, Helicobacter pylori
MKKHILSLTLGSLLVSTLSAEDDGFYTSVGYQIGEAAQMVTNTKGIQDLSDRYESLNNLLNRYSTLNTLIKLSADPSAINAVRENLGASAKNLIGDKANSPAYQAVLLAINAAVGFWNVVGYVTQCGGNANGQKSISSKTIFNNEPGYRSTSITCSLNGHSPGYYGPMSIENFKKLNEAYQILQTALKRGLPALKENNGKVNVTYTYTCSGDGNNNCSSQVTGVNNQKDGTKTKIQTIDGKSVTTTISSKVVDSRADGNTTGVSYTEITNKLEGVPDSAQALLAQASTLINTINNACPYFHASNSSEANAPKFSTTTGKICGAFSEEISAIQKMITDAQELVNQTSVINEHEQTTPVGNNNGKPFNPFTDASFAQGMLANASAQAKMLNLAEQVGQAINPERLSGTFQNFVKGFLATCNNPSTAGTGGTQGSAPGTVTTQTFASGCAYVGQTITNLKNSIAHFGTQEQQIQQAENIADTLVNFKSRYSELGNTYNSITTALSNIPNAQSLQNAVSKKNNPYSPQGIDTNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKDSDHAAQHGIELGLKIPTINTNYYSFMGAELKYRRLYSVYLNYVFAY

SEQ ID NO: 15281 - protein, 736 aa, Helicobacter pylori
MKKHILSLALGSLLVSTLSAEDDGFYTSVGYQIGEAAQMVKNTKGIQQLSDNYENLSKLLTRYSTLTNLIKLSSDPSAINAARENLGASAKNLIGDKANSPAYQAVLLAINAAVGFWNVLGYATQCGGNANGTRSTSSTTIFNNEPGYRSTSITCSFNNLSIGYFAVMSIENMKKLNQAYQILQTALKKGLPALKENNGTINVNYTYTCSGAGNDNCSPKVTGVQEQNGGRKTGNQTIDGKTVNTTISSKVVDSNASGNTRHVSYTEITNALSNVPDSAQFLLAQASTLINTINTACPYFSVTNSNSPNAPKMKPTTGKLCGFTDEISAIQKMITDAQELVNQTSVINSNEQTAQVGSSNGKPFNPFTDASFAQGMLANASAQAKMLDLAHQVGQTLNPERLTGNFKNFVKDFLATCNNPSTAGTGRTQGSDPGTVTTQTFASGCAYVEQTITNLSNSIAHFGTQEQQIQQAENIADTLVNFKSRYSELGNTYNSITTALSKVPNAQSLQNVVSKKNNPYSPQGIETNYYLNQNSYNQVQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARAKKKGSDHAAQHGIELGVKIPTINTNYYSFMGAELKYRRLYSVY

SEQ ID NO: 15282 - protein, 703 aa, Helicobacter pylori
MKKTLLLSLSLSFGLHAEDDGFYASAGIRIGEAAQMVKNTKGIQQLSENYEKLNNLLNNYNTLNTLVKLSSDPSAVNDARDNLGSSTRNLLDVKANSPAYQAVLLALNAAVGLWQVTSYAFTACGPGSNENANGGIQTFNNVPGQNTTTITCNSYYEPGHGGPISTKNYAIINKAYQIIQKALTANGEGIPVLSNTTTKLDFTINGDKRTGGEPNKKLVYPWSHGKAISTSWNATITAPTTENINTTNSAQELLKQASIIITTLNSACPNFQNGGSGYWAGISGNGTMCGMFKNEISAIQGMIANAQEAVAQAKIVSENTQNQNSLDAGKPFNPYTDASFAESMLKNAQAQAEILNQAEQVVKNFEKIPTAFVNDSLGVCYEVQGGERRGTNPGQTTSNTWGAGCAYVGQTITNLKNSIAHFGTQEQQIQQAENIADTLVNFKSRYSELGNTYNSITTALSNIPNAQSLQNAVSKKNNPYSPQGIDTNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKDSDHAAQHGIELGLKIPTINTNYYSFMGAELKYRRLYSVYLNYVFAY

SEQ ID NO: 15283 - protein, 732 aa, Helicobacter pylori
MKKHILSLTLGSLLVSTLSAEDDGFYMSAGYQIGEAAQMVKNTKGIQDLSDRYESLNNLLTRYSTLNTLIKLSADPSTINAVRENLGASTKNLIGDEANSPAYQAVLLAINAAVGFWNVVGYVTQCGGNANGKESISSTTIFNNEPGYRSTSIECSVNRYTPGYYGPMSIKNFKKLNEAYQILQTALKTGLPALNQNNKTVNVTYTYTCSGSGNNNCNVLKDNGNSGTKTETQIIDGKSVTTTISSKMVNSTASGNNLHVPYIEITNKLNDVPNSAQALLAQASTLINTINEACPFFRAPNSQTDGPKWEWPSNKLCGAFSQEISTIQKMITDAQDLVNQTSVITNNEQSAQVGGGNKPFNPFTDASFAQGMLKNAQAQAKMLNLAEQVGQAINPDNLSGNFKNFVTNFLATCNNKSTAGTGGTQGSAPGTVTTQTFASGCAYVEQTITNLKNSIAHFGTQAEQIEQAENIADTLVNFKSRYSELGNTYNSITTALSNISNAQSLQNVVSKKNNLYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKGSDHAAQHGIELGLKIPTINTNYYSFMGAELKYRRLYSVY

SEQ ID NO: 15284 - protein, 739 aa, Helicobacter pylori
MKKHILSLALGSLLVSTLSAEDDGFYMSAGYQIGEAAQMVTNTKGIQQLSDNYENLSNLLTRYSTLNTLIKLSADPSAINAARENLGASAKNLIGDKANSPAYQAVLLAINAAVGFWNVLGYVSQCGGNGNEKSTSSTTIFNNEPGYRSTSITCSLNGYSPGSQGPISIENMKKINEAYQILQTALKKGLPALKENNGTVTVNYTYTCSGEGNTNCDPSVVGLGSGGNRNGGSKTITQTIDGKTVNTTISSKVVEAEGNTSGVSYTEITNKLDGVPDSAQALLVQASTLINTINEACPWFNATSSNSPNAPQWRWNPSGGLCGAFKDEISAIQKMITDAQELVNQTSAINNNEQSTQQVGGSGGKPFNPFTDAKFAEGMLANASAQAKMLNLAHQVGQAINPENLTGNFQYFVKEYLATCNNPSTAGNGGTQGSPPGTVTTQTFASGCAYVQETLTNLSNSIAHFGTQAEQIQQAENIADTLVNFKSRYSELGSTYNSITTALSKVPNGSSLQNAVSKKNNPYSPQGIEANYYLNQNAYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGLKIPTINTNYYSFMGAELKYRRLYSVY

SEQ ID NO: 15285 - protein, 737 aa, Helicobacter pylori
MKKHILSLTLGSLLVSTLSAEDDGFYMSAGYQIGEAAQMVKNTKGIQDLSDRYESLNNLLTRYSNLNTLIKLSADPSAINGVRNDLGASAKNLIGDKANSPAYQAVLLAINAAVGFWNIVGYVTQCGGNMNGQKSTSSTTIFNNEPGYRSTSITCSLNGYTPGYGSPMSIENFKKLNEAYQILQTALKQGLPALKESNGTVNVSYTYTCSGEGNNNCSKEATGVDNQNSGNKTTTQTIDGKSVTTTISSKVVDSTASGNTLHVSYTEITNQLNGVPDSAQALLAQASTLINTINEACPFFHAPNNQPNGPKWEWHSNNLCGAFSQEISAIQKMITDAQELVNQTSVINSNEQSAQVGANNNGRPFNPFTDASFAQGMLANAQAQAKMLNLAEQVGQAINPERLSGTFKNFVTDFLATCNNPSTAGTRGTQGSPSGTVTTQTFASGCAYVEQTLTNLNNDIAHFGTRAQQIQQAADIADTLVNFKSRYNELGNTYNSITTALSKVPNAQSLQNAVSKKNNPYSPQGIETNYYLNQNTYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKLNVANFQFLFNMGVRMNLARSKKKGSDHVAQHGIELGLKIPTINTNYYSFMGAELKYRRLYSVY

SEQ ID NO: 15286 - protein, 734 aa, Helicobacter pylori
MKKHILSLTLGSLLVSTLSAEDDGFYMSAGYQIGEAAQVVKNTKGVQQLSDNYENLSKLLTRYSTLNNLIKLSTDPSAINAARENLGASAKNLIGDKANSPAYQAVLLAINAAVGFWNVLGYATQCGGNANGQESTYSTTIFNNEPGYRSTSITCSLNRHSPGYYGPMSIENFKKLNQAYQILQTALKKGLPALKENNETVNVTYTYTCSGNGNDNCSPNTTGVNNQNGGSKTETQTIDGKEVNTTISSKVVDSKASGNTSGVSYTEITNQLSKVPDSAQFLLAQASTLINTINTACPYFSLTNQHGGPQMEPTRGKLCGFTDEISAIQKMITDAQELVNQTSAININEQTTQVGGSNGKPFNPFTDASFAQGMLANASAQAKMLDLTHQVGQTLNPDRLTGSFQNFVKNFLATCNNPSTAGTGGTQGSVPGTVTTQTFASGCAYVEETITNLSNSIAHFGTQEQQIQQAENIADTLVHFKSRYSELGNTYNSITTALSSIPNAQSLQNVVSKKNNPYSPQGIETNYYLNQNSYNQVQTINQELGRNPFRKMGIVSSQTNNGAMNGIGIQVGYKQFFGQKRRWGARYYGFFDYNHAFIKSNFFNSASDVWTYGFGADALYNFINDKATNFLGKNNKLSVGLFGGIALAGTSWLNSEYVNLATVNNVYNAKINTANFQFLFNLGLRMNLARAKKKGSDHAAQHGIELGVKIPTINTNYYSFMGAELKYRRLYSVY

SEQ ID NO: 15287 - protein, 773 aa, Helicobacter pylori
MKKHILALVLTMVCISLYAVNPIKEGNMISGHVIVKGTEENIPYATILIKESGQGTVSNEEGQFEFRKLPVGKYTLRVSAVGYKTQEKEVTVSKDFTAVIHFQMQEESFMTDEVVVSANRNEVSRKDAPVVVNVMSAKLFEMVNSTDLAKTLNYQSGLRVENNCQNCGFPQVRINGLEGPYSQILINSRPIISALSGVYGLEQIPVNMIERVEVVRGGGSALFGANAVGGTINIITKDPISNSFQVSSMFSCMDGKSWEQYMGGNVSLVAKDNSYGIALYESYRNRNPYDRDDDGFSELGKLNMNTFGFRAYYRPTHFSRINLEYHTTNEFRRGGNKFDLQPHESDITEQTKHIINSGGVSYDLFWREYKHKISLYGSIQHTDRNSYYGAQQDMNAYGKTDDLTWVAGGMYVGNMNNCFFAPATFTGGLEYQNNSLHDVMTGYHRDMKQDVRIASAFVQNEWKMRQLTMLVGARLDKHNLIDKLIFSPRINFLYKPTEDFQARLTYSTGFRAPQAYDEDLHVTAVGGEGVQIKLADNLREERSNSYSGSVDWSTHLGHWQANILLEGFYTDLRHVFVLEDIGKDDNGDKIKERRNGSGARVYGVNLDAKLAHGKEAQLQLGFTAQRSRYMDAEVWTKVDGEELTTKRMMRTPDYYGYFTFSSAPLKNFDFSLSGIYTGKMIVPHYAPVDAPEGAFCNIEKDRMENTPDFFDLNLKLNYTFVLRDHIKLQLNAGVQNIFNSFQKDLDKGEFRDSGYFYGPTQPRTFFIGFKFMN

SEQ ID NO: 15288 - protein, 741 aa, Helicobacter pylori
MKKHILSLTLGSLLVSTLSAEDDGFYTSVGYQIGEAAQMVTNTKGIQDLSDNYENLSKLLTRYSTLNTLIKLSADPSAINAARENLGASAKNLIGDTKNSPAYQAVLLAINAAVGFWNVLGYATQCGGNANGQESTSSTTIFNNEPGYRSTSITCSLNRYKPGYYGPMSIENFKKLNEAYQILQTALNKGLPALKENNGTVSVTYTYTCSGEGNDNCSKKATGVSDQNGGTKTKTQTIDGKTVTTTISSKVVDSQAKGNTTRVSYTEITNKLDGVPDSAQALLAQASTLINTINTACPYFSVTNKSGGPQMEPTRGKLCGFTEEISAIQKMITDAQELVNQTSVINEHEQSTPVGGNNGKPFNPFTDASFAQGMLANASAQAKMLNLAHQVGQTINPDNLTGTFKNFVTGFLATCNNKSTAGTSGTQGSPPGTVTTQTFASGCAYVEQTITNLNNSIAHFGTQEQQIQQAENIADTLVNFKSRYSELGNTYNSITTALSKVPNAQSLQNVVGKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARSKKKGSDHAAQHGIELGLKIPTINTNYYSFMGAELKYRRLYSVYLNYVFAY

SEQ ID NO: 15289 - protein, 859 aa, Pseudomonas entomophila
MSRASGMPRERRDAGASRVHRGVRSVRRLTMPHDAIGATDRRLHRPPVRRCTRSPILRVRDRIGTGAIASTIAASMRAVRTHRFDAASRGDSMRIRSINRQDRASQFRNEFRSRRAARFPSRTMTVNRTTASRASRRRAKVGRGVGVGLALFAAQAAAAQGDARASDADASNATLPAITVSGERGGGFRAREASVAGLDDTPLRDTPASVSVVTRAQIDDQQAKRLSDVLRNDASIVNAYAPVGYFEGFAIRGFPIDLASAIRIDGLTVSGEQNVPLENKERVEILKGLAGIDSGVVAPGGVINFVTKRSTNVASATVGTDSRGSASAAVDVGRRFGPDNRFGFRINAAKENMHSYIDGTNGRRTFGSIAADWDISARASLQFNAEFQQWIQRSAPGYQLLGGTVVPSVHTTSKALGAQPWAKPVTTDALNLNARFDYQFDDDWKAYVAVGRSRTMIDDNSAFAYGCAYAPSCAAGTTSPFFFGANGDYDVYDFRSPGEYRRNDDVRAVTTGKFATGPLRHELTLGVGVQRRVVHMADAVYDYVGSENIYGPDQTFAPSPNEPGPSYPRLDAWQYGVFGLDRVRIGERWQVLAGGKQLLLRQRSWDSIDGAAAHTDRTVFLPQVALVYQPVNALSLYASYSKALSLGDQAPVRATNAYAFLPPVESHQIEVGAKYDWLDRLSLTAAVFSISKPFQFAEPDASGTRYTFVQRGTQRHQGIELGAAGQLTRRLSLTASVAAIRARAYDSGSPAYEGHQIINVPALRASLYADYAVPGIAGLDVLGGVEYSASRNANEKGTARVPSWVRVQSGRALYHEVLRVNSADTVLCQWPSFSLQVQRGRTAGPARSSDGYVITLARR

SEQ ID NO: 15290 - protein, 688 aa, Pseudomonas entomophila
MSGCTPVFALSLRGTIAALCGSLLAPMALAAGPGHEDHVHDAPELSPTVITAVAPSSPLTVVTNPKDPRQPVPASDGADYLKTIPGFSAIRAGGTNGDPVLRGMFGSRLNILTNGGLMLGACPNRMDAPTSYISPETYDRLTVIKGPQSVIWGPGGSAGTILFEREPEKFGTLGSRVNASLLAGSNGRFDKVLDAAAGNSQGYARFVGNQSRSDDYHDGNKDTVPSRWEKWNGDVALGWTPDQDTLLELTAGKGDGEARYAGRGMDGSQFKRESLGLRFEKSNLGEVLDKVEAQVYYNYADHVMDNYSLRTPSGSGMMGMPMVSNVDRRTMGARIKATWRWADVQLISGIDAQTNEHRQRGGMGVDAHKGKAWTKDADFHNYGAFSELTWYVSGEDRLITGARLDRASARDFRTTSATEGDTRADTLPSGFIRYEHDLAAIPATTYIGLGHAQRFPDYWELFSPKLAPPGAANAFDGIKPEKTTQLDFGIQYRTERLEAWASGYVGQIRDYILFDYRTGMMGMSTSQAQNIDARIMGGELGAAYQLTDNWKADATLAYAWGKNSSDGKALPQMPPLESRLGLTYSRDVWSVGALWRLVAAQNRIAENQGNVVGKDYDKSAGFGVFSLNGAYKVNNNLKLSAGVDNLFDKTYAEHLNLAGNAGFGYPATDPQPVNEPGRTFWTKVDFSF

SEQ ID NO: 15291 - protein, 737 aa, Pseudomonas entomophila
MSTPRFALHYASASVLLAASGLAMAQTATQIHDPSQVQQMATVQVLGTAEEEIKESLGVSVITAEEIARRPPTNDLSDLIRREPGVNLTGNSASGARGNSRQVDIRGMGPENTLILIDGKPVTSRNAVRYGWNGDRDTRGDTNWVPAEEVERIEVIRGPAAARYGSGAMGGVVNIITKRPADRATGSITYYTNQPEDSREGNTNRVNARISAPISDTLSMRLYGNYNKTNPDARDINAGHANTSDNGNPSTAGREGVINQDLSALFSWKADSRNTVDLDMGFSRQGNLFAGDTMNNANSDFSDSLYGKETNAMYRENYALTHRGVYDWGTSRASVGYDYTRNARQREGLAGGPEGAPTAGGYDTARLKNWRAAAEASVPFHLGFEQVATVGVEWLRESLEDPAGTRQTYTGGAIGGTAPADRDPKSRQTSSALFAEDNIEIDERTMLTPGVRLDHNSEFGSNWSPSLNASYAVTDALKLKGGIARAYKAPNLYQSNPNYLLYSRGNGCLASQANTNGCYLVGNEDLSPETSVNKEIGFEYDPGTWRTSMAYFRNDYRNKIVAGTDVQYRLANGARVLQWTNSGKAVVEGLEGNLFIPLASNLDWNTNFTYMIQSKEKATGEPLSVIPEYTINSTLDWFYTPQLSFQANLTYYGKQEGPSTNVRTGVELNGDGRQTISPYALAGLSMGYEVNRNLKFRVGVSNLFDKQLYREGNASSAGAATYNEPGRAYYATATVSF

SEQ ID NO: 15292 - protein, 774 aa, Pseudomonas entomophila
MPLRPNPFVHALLLTTTLGLAMPAAQAETRSYHIAAGSLEDALNQFGRESGALISFGSQLTQGMSTQGLDGQYDTRQGLDALLRGSGLQARQETDNAFSLQPITAPAAGAAVELGASTVVGDWLAEAQQDNVFEHPGARDVVRREEFERNGATTAREVLNRIPGVNAPDNNGTGSHDLALNFGIRGLNPRLASRSTVLMDGIPVPFAPYGQPQLSLAPLSMGNMDAVDVVRGGGAVRYGPQNVGGIVNFVTRAIPEQATFKAAMQNQISPSSSHEGFKNSANLLVGGTNDNGLGGALLYSGTRGGDWREHSDTQIDDLILKGKLQLDEANSLHAMAQYYEGEADMPGGLSTADFDADPYQSTRLKDKFWGRRTLFNFGYDYKQDDRQFSVNSFFTKTLRSGYLDQGSFVSLSPREYWVRGIETRFSQGVALGDSWHELGIGYRYVNEAGHELRFREPVNGSLPTTASRNDRDTRGSTEAHAIYLDDRIDIGRWTITPGVRYEMIDSEQSNKLNGQRYQGSYNTALPALNVMYHLTDSWNLYANTEGSFGSVQYSQMPNRVSSGEVKPEKARTWEVGTRYDNGDLQAEIGAFLINFDNQYESNQTNDSVIARGETRHQGIETSVRYALDGLSPALAGFDVHASYAFVDATIREDGPNKGNQVPFSSRHKGNLGVGYTEGPWQLNLDGSFQSSQYADNANTSTESADGSTGRIPGYMLVSTRAGYDFGPQLSNLKVAVGVKNLFNREYYTRSYDDNNKGKYVGEPRTLYLQTSVEF

SEQ ID NO: 15293 - protein, 796 aa, Pseudomonas entomophila
MKFTPRCVPLWFGLAALPAFAVAPLATAAEQLQAYAFAQPAQPLAQALNAFSRTTGQSVVYTLELPGVQAPALNGRFSAEQALQQLLGNAGLAWRRVDARTLTLEPADTSGALSLQATTVTSQLDDYSYQPPASASIMRGQGPNQDIPQAINVVPAQVIRDQAPRNLDDALANVSGITQGNNFGGTSDTVMKRGFGDNRDGSIMRDGMPVVQGRNLNASTERVEVLKGPASLLYGIQDPGGVINVVSKRPQLQQYNALTVRGSTYGSGKNGSGGGLDSTGALGDSNFAYRLVVDHEDEDYWRNYGVHRESLVAPSLAWLGEDTQVVLAYEHREFLYPFDRGTAFGNNGHPLNIPATRRLDEPFNDMEGRSDLYRLEVDHQLADDWKLHFGYSFNRETYDASQVRVTGVNETQGTLTRSIDGTHNAMSRDQFVTLSLNGNVELAGMQHDLLFGIDHEDRKIFRGDLIRQTPQSTFSYLDPVYGQEVEGTNVRASDSDQTDKLRTDALFVQDALHLDEHWILVAGARFQQYDQYAGRGRPFKANTDISGQAWVPHAGIVYKVDDQLSFYGSYSESFKPNSTIAPLTGNVVLDSSVAPEEGKAWELGAKLDMPGRITGTLALFDITKRNVLVSNFDAVTSETVYSNAGEVSSRGVELDVTGQLSERWSLIGSYALTDAKVTKDPDLEGNRLQNVARHSGSLSAVYDFGSLFGSDRLRFGAGARYVGERSGNATNTFDLPSYTVADAFATYETKLDEHNVRLQLNVKNLFDKVYYSSAVNQYFVAIGDARQVSLSSTFEF

SEQ ID NO: 15294 - protein, 862 aa, Pseudomonas entomophila
MSTGPTSPSPLPRRTGQLSLLTLALLASGACGLPALAAEPAQATSPRMGDYRFSITQQPLVEAINAFSQVTGWQVGFSAELADGVASPGVHGSLPPEAALKQLLQGTGLGYRKISNGNVVLERQTAGNAIALQQLTVSATRSAQDVSQVPSTVSVQTREQLDRQNVNSIKELVRYEPGVSVGGVGQRSGLNGYNIRGIDGERILTQIDGVSIPDSFFYGPYAQTQRNYVDPEIVKRVEILRGPASVLYGSNAIGGAVSYFTLDPDDIIKPGKDVGARLKTGYSSADDSWLTSATVAGRQGDFDGLLHVSQRNGHETESYGEDGGTGLSRTEANPEDVRTTNVLAKLGWNYADDARLGFTYERYKDDRDQNILSAVGGPFIPGFGAMNSYRMRQGNDTVTRERFGINHEFGLDSLVADHVKWSLNYQIAKTDQRTDELYVASGRQVLRDRQTTYKDRQWVFDAQLDKAFSIGQTDHLLTYGTTIKHEEVTGSRSGSGTCVAIGGSCTAIGQDSSRDGQALVSDFPDPTINTYSLFVQDEIRWNNWTFLPGARYDYTRMEPKFTDAFLRGIQGSGAAPGALDDSDKKWHRVSPKFGLTYAFNDNYTWYGQYAEGFRTPTAKSMYGRFENPTLGYSVQGNPGLEPEKSKSYETGLRGNFDAGNFSAAVFYNKYRDFIDEDAVQSANLETTFQAHNIKHATIKGAEVKGRLNLDHFGAPEGLYTQGSIAYANGRNDDNGQPLNSVNPLTGVFGLGYEQPNYGGLLSWTLVKRKTRVDDTTFFAPDGASSQFRTPGYGVLDLSGFYKVTDDVTVNAGLYNLTDKKYWQWDDVRGYDGQGEAGVTQPANLDRLTMPGRNFAINVVWDI

SEQ ID NO: 15295 - protein, 685 aa, Pseudomonas entomophila
MEHRAFKKNIIAAIISSLGVSSTYAAVEAESTEPIEKITVYGEKIERSLKDTTSSVSVIDKDSLDSGQYQSVSDALSEIPNVVVLTGSVPDIRGVSGNGSASGFNSFTGGARARVSTLVDGVAEPFVADLTGDTGLWDIQQVEVFRGPQSTINGRNSIGGTVFIKTEDPTFDWRGAARLGYRDQNNYVDSAVMVSGPILDDELAFRLSGQNVTGETYNKGLVYETNPAPFDLNELITNRWRGKFLWQPSAIEELKVLYSFSYNDEKGDSGRNYFSGDDPWAYRPILQRYIETESTTHSVKVDYDLGSGRALDLVVAYMDYDWGSKSYEALVTAQQYVDMKDKSYTVDGKYSFGLNDRDFNGFIGLAYYERSQDFGSTGSSVYTGDDSSSSVSIYGELTYGLAESLWLTVGGRVMRDEQKRNFSMLYRGTQLEEKLDNDSTITLPKLVLQYAITDNTTLAASARRGYNSGGGALSLAESEYYYYDEEFVDTYELSARSMFLGGNVNLSANLFYNDFDGYQASNQARKITNVDKAVTYGIETELSAMLTANWQVITGVGLLDSEIKKVDSSYGDIVGNQLNSAPHVTANLGVKYWLNDAFSVGVSGNYVGEYFADIDNTESRIAGDYVVARLSVDYQKDNWRISGFINNMFDEQAMTVNEPPSANYVNGYAAIIDPRNLGVSVMYSF

SEQ ID NO: 15296 - protein, 1101 aa, Pseudomonas entomophila
MSTKYKEIKNLFITLNKLSMKNKVLLVLLLSFAVSLAASAQKITMNLQQVKLEKVFSLITKQTGLTVAYSRTIVNPERIVSVQAKDKDLSKVLDDLFAGTNVAYEIGEKKIYLKAKEAPVTSQGSQKTKKITGTVTDTKGEPVIGASVLVKGAGTGTVTDVDGNFTLDAPTDALLAVSYIGYKTQEVKVGNKNSYSIQLQDDTEVLDEVVVVGYGVQKKSSLTGAVASISSQEISKQVSSNVASSLQGRTPGVDIVQQAGVAGADVNIVIRGAASFGATEPLYVIDGAFSNAGLSSLNPNDIESIEVLKDGAAAAIYGSRAANGVVLITTKKGKSGKPVIQIDGSFAFQKTTNIPEFLNASEWREFANMVADNSGLPHAPENDNPTNPNLNTDWSKEWIQFAPVWNLNASIAGGGDNSTFSTSLGYLDQTGMTIYSDYKRYNFRLNTSYKKGRFSFSETLGLTHKDKTPTTAFNIALPTLPIYDEQGRFTSGGPDYYINPEDGKAQNKIAPLHYTDQFNKVTDLIGSLNAQLDIWGGLKYKLSLSGNYSNKHNYTHTPEYYTKWNSDGTPDKDYGNTRNSVSETRGEEFTYTIDNLLTYNKTFNRHSIDALLGTSWMREYYRYMTNSTINDLGGTDITGFQNEDGKISAGDSNAALLSFFARVNYDYDNKYLLSLSIRRDESSKFHKDNRVGYFPSVSAGWNVHQEKWFQNPVMSKLKIRASYGELGANFLNPYNFDAIAYGPIPYTVGGERYVTGRAAYLKSKDLKWETAKTTDIGIELGFFNNDLTLSLDYFVKKNVDLLAQIDLNLSSGQIFEINSSREKPYVNTASVKNTGWEFMMNYRKQLTKDFHIDATFNIATLKNKVLSLGENVQPITSGAMSSYFNDAASITMPGEAIGSFYGYKIDGFDAEGNFIFADTDKNGVVNANDKVILGSPIPDFTYGLNINMEYKDFDLTVFFQGVQGNDIFNQKKYTYYFDYSNNVVKEAMNGWTKTNRNTGIPIMKTQNTSGGNSLPSEFYIEDGSYLRLKNLQLGYSLPKKWLEAIRFNKLRVYAGVQNLFTLTQYSGYDPEVSSNVLFSRGIDISSYPNARTFTFGFNASF

SEQ ID NO: 15297 - protein, 794 aa, Pseudomonas entomophila
MLSALAIAVSCASAAQAQLEEVVVTAQARAESLQDVSISMVAMTGETINELGITKMEEFTMNMPAVTVAQNPIGNFLFIRGVGTSGTNQGIEQSVATFNDGVFMGRHQLSRAPFMDLDRIEVLRGPQSILFGKNTIGGALSVHTARPTDELEGSIQALYGSYGETEVNGVISGPITDTLRGRIAYRKYDYDGYLENVITGEDAMGRDDETIRASLQWDATDSVTVDFKWERSDFTQNESITQIGRVSEVPYNPTAAGITFLNQLSVGAVTGTDGTERIDDERAVVNDGGAILKSLGVVPANTPGFPDQKEGSENTVDAGRLGIEWALGEHALTFISGYASYDYTDICDCDFSALPFIEIDAVEDYEQFSQEIRLTSPTGGTFDYIAGLYYQSSDLFYRSQEAFGVAALAPLANVTRDYDFDQTQETFAVFGSLTWNLSDTTRVTGGLRYTDETKEVDRTLEKSFTGGWDFSSVIGAPEGTLVYGDTAAEYDRFEAELAPVAAAYDAGLWNDSGLLGTYEHQFDGRKRTESFVDYYANIEHDLSIDTLIYATVSTGVKGGGFDARFLKESVGPRADGFEYEEETSLAYEIGFKTTLLDGAMRLNGALFRNEVSDAQVSIFDGATGFVVVNAAEIISQGIELDLQWAATDDLIITAATSYLDSTFDEWDTAPCWARQQIDPGHPEFEPGCNNGFRDAAGDNTQFAPELAYNLNFDWRIPLMDSLETRAVLNINYSDEFATVGDLDPFIGSQDEFTMVDFRLSVGSPDGTWEVAALGKNLTDGVCRLQQQRPAPGIG

SEQ ID NO: 15298 - protein, 681 aa, Pseudomonas entomophila
MSLSSHLRSARLSRTRLATALSAACLLALPGLAAAEASADASTKDLDTVVVTASGNQQWIKDAPASISVISREDIARQPVHDLATLLSRVPGVTGGLSAVGEQSKIKLRGMPSNYTLVLVDGKRMGSSASTNYRPDLGRQDLNWISPDQIERIEVVRGPMSSLYGSDAMGGVINIITRRIGDEWNGSATHSYTRPGDGKRGDTQQIGATFSGPLGERFGLRIGANSMRRDSDQSNGGVYGNAYAGEKDRNVDALLQWKLSDAQELSLEAGHGVQQSFIDASLEKQDEGAWGASELKRSSLALNHDGKWNFGNSKISAYWTEYKNDIGATGRSEATDTIIEGSLTTPFTLGVEHQFAVGGQWKRQELTNTDTIGRAPIDYAGNAVNGSDLQVDTWALFVEDELKLHRTLALTLGARLDHHEKFGGHVSPRAYLVWHPAEQWTIRGGVSKGFRAPSLTENSPSAATQSGGRGCTSLIPLGYTRGGCYMAGNPDLDPETSTNREIGISFDNDLVDAGLTYFHTDFRNKIEYAPLGKFNGIWWTRMSNVQRARTSGMEGNLNFRFGEHWRWRTSATWMKEAKNLTTGRNLIDTPEFSGYSSLDWTPNTTFSSSLSAQYTGKQTGTATTFLKAYTLYDLTAAWNVNEVLTLRGGVSNLADKKLYAEGSTDYFVAGRSYFLSMTARF

SEQ ID NO: 15299 - protein, 504 aa, Pseudomonas entomophila
MVEFRFRLTYRESYLMPSAANLSGSSKQLVFFRSYSMENMFKRSVLSAVVVGIMAGSALTVATPVQASGFFEDSTINGAVNIFMRDRTRASFNAETGKEGPKTANLDHGSIFTNLGFNSGYAGDVVGLDLNVYATFDMWQNSSPDHEFNFWNVESPYGDATPSKGDCLNNKNEDDSESKWSASCNDNGISYQTVAAKFKLGEDGTAKLGYFQPSVPSAMGVNWSYAAGTYLGGEAGYKFGNLDLGAVYATRYKAPWFKDTYEFQTTNGEDAGDAYSFGGRYTLASGLLFDAAYAGMTDGDRKNAHFKVNNTLESGLYLSGQVYMVDDDEQYDSTAYQFAFMSAKSFGAYSVRAEATYTVADAEGEGSMGNFAYRLTSQYGGSNGTYDVWWNNRSDFNHDGELALFGSLSRDFADLGATGLSAGLSAAMGVASSDVAGLDDLSEYAGSVFVNYVIQNGALEGANVGFHYTEFVNDTKTDNWTGWTNLFQDESDIKVSLTIPYSIK

SEQ ID NO: 15300 - protein, 701 aa, Pseudomonas entomophila
MLSLSILMGLCGNASAQDIQLPTIDVQGHPDSDANADVTRDYKVNRVELGPLGKRPLIDTPFSVNTVSEGFAENRQIQSVREAFRFIPSVQGENIRPQTRGLQASVVQNTRIDGLNIAATTDYPIEQFQRIDVLNGLAGALFGPAQPGGTFNYIMKRPTAEPLQRFTGGYLSQTQWLAHMDLGGYADPEHRLGYRLNLLDQDGTSYVDNGRLRRQLASFGGDIRLGPDTVLETNASIYHYLTKGLPGTFAVANNVVFPAAVDPTRVGYGQPWGGDDNVTTFLSGRIKHDINENWSFTVGVSRNTSDRASTVPTNTIRSNAGNYITTAATTTFSLDTVDSNQAALNGRFETGSIKHDLFLATNGFLWNRYTPFNRGAITVGSASLGNPVVFSEPNFPDFKDRYRSVYTFQQSVTVGDTVALNEQWSVLGAVSNSWIDTSNYNSVGNFTGGYNASGWSPLGSIMFKPRENVTTYVTYANSLQQGDSAPAGTVNQGEALAPFRSNQYELGAKFDFGRISLNAALYRIERPYAYTGPDNVFSVKGTQINRGVELMASGAINDEWTVFGGMTFIDPRLYNTGSSQTEGRRILGLSQFVMNCLVEYHVPAVQGLTFTANLNYGTNRPTDYANTSFVPDYTVLNLGMRYAQLIAGKPVTFRFDVLNVTDLHYWANITPAAQNGYNATGSATGMLGAPRTVRASVQVKL

SEQ ID NO: 15301 - protein, 427 aa, Pseudomonas entomophila
MRVMKWSMIALAVAAGTSQLAMASAQDESKGFIEDSKLNVKTRMLYFSRDFRNVPSGSQSRVEETGLGFLGTFESGFTQGTVGFGVDAIGMLGIKLDSGKGRAGTGLFPEGSDGRSQDDYSEGGGAVKMRISNTVLKFGDQFTALPVLATDDSRLLPEVAEGGLITSNEIDGLTLHAGHFTALNAQAQTYHDSLNLTEANVFGGTYAITENLSTSVYYSRVEDHFRKWYGNINWALPISDKQGLVFDFNIYDTKSIGDNLTGAFVSKSDGSNELDNIAASLSAAYNIGAHTFTLAYQKVSGDGDYAYGVDGGGTIFLANSVARSDFNAEDEKSWQARYDLNFAEFGVPGLTFMTRYVRGTGASTRTTDDGKEWERDIDVKYVMQSGPAKDLSFRVRQATYRSGDGVYYGSPSIDELRLIVEYPLSIL

SEQ ID NO: 15302 - protein, 194 aa, Pseudomonas entomophila
MDAQGNPINTETSLCQSADTKMGGGNRIIFNNQLQNIGAEITSGIDINLAYTFDAVGLGWKMGLDSTILLENESIILGESIDYAGVITSGSGGFAKYKTNFDLGVEGDSWGAHYQARYISGMDSYVCQSEPSTCYAPSTDSIVYHDISASYFLSNTWAISAGVNNLLDEDAPYYTGNNDDRGYNRGACTGKKLG

SEQ ID NO: 15303 - protein, 634 aa, Pseudomonas entomophila
MFPCLPRSLLAGVLLASALPAHAELPHAPAYIDDSAYPAAARQRILPPMFEQRLGSLRYLAKPGDPLITQAESSDFQRTSDYRETRAYLEKLVAASSGRIALRELPERSAEGHPMLLVTASTEADKSAAGLKRSAKPTLLVEAEIHPGEANGKDAMFMLLRDMSAADRPLAGLLEKINLLFIPVVNVDGDLRRSAYGRINQNGPQETGWRVNGRNLNLNRDFTKLDSAEIRNVAWVFNHYELSFFADTHSTDGAMYPYDSSYCHNGNGWSPASSAWMDQVMRKPVYQALESLGHMVHECISLNDNQDPTQGYYPYRTDLARFSNQYGDIRNVPSILIEQHALHPYKTQVLGNYVMLKAMFEVIGEQAASLRQAIASDRERLLRQKEVILTWKPGEVAETPFVVGDYRYEQSPVTGARTIVWSNRPKTLKLPVTDNGVPDLVVPRPQRFIVPAQWHEVIARIKAHGIRYSTLERPTEIAVTLYRMDDIKLADGFEPDRVQGNRIPGYEGRLLVSGTPKPFQRLLTFPAGSLSIDTAQPLGVLAIDLLQPQSPDSFWSWGFFNSTLVAAEEPEEYVMEPMARKMLAEDPALKAAFDKRLREDKAFAADPQARLQWFYQRTPFYDVNAFVYPVGVVF

SEQ ID NO: 15304 - protein, 851 aa, Pseudomonas entomophila
MASRARRFSQGRMAGIALAGVSVAVMAQAAAQAGEAKRPRGPTILAEAPVGGAPVRLSIPKGSLEAGLVAFTEQAGVKLVYPTELTARLETPGLAGEFAPLDALTKLLDGTGLTYRPAGASTITLVNPRYVQLGAAPAGAVTLDELHVEGQAQARGRATAAGLPPPTGTVGQPPVPYAGGQVGSGARVGLLGNRSVLKTPFSITGYTEKLIADQQAVSLADVVLNNSSVRNDAPPYSERDSYFIRGFSVTNLDTAFDGLFYLANPRRTFTEGLERVEVLLGPTALLSGGTGRVGGTINLIPKRAYDEPFARLTTTYISDAQIWTHADLGRRFGEFKEWGVRFNGAYRTGATPLDNNAIEAGVAALGLDYRGDRFRASLDMTHSTQNVTAPTSLFNAVAPGIQIPRAPNNRTNTANPFEYNDSRYGMITGRAEYDVLPDTTVYIAGGASRYNEDFLTSNYRVTSVTGQATNLLAIQPQEIQGLTGEVGLRTRFSTGFLNHQVNIAAVEANNKNFRSGFVPPVFTPYTINIYNPVYLPTGSIPTIGLPRSAAQPLFAQLSARSVAVADTLSFFGDDRFLLTLGGRYQEIDQQGFATRPGPTQGQVTSNYQEGRFSPAITFVLSPFENLSFYGNYIESLDPVAAAPLAAINANVLFPPAVGRQKEIGVKYDFGTIAATAALFEIELPNAFTDPGTRIYSVSGRQRNRGVELNVFGEVVPGLRLLGGVTFIDAELVNTPGGQFNGRAAPGVPDTAFNLYAEYDLPPWLAPGLTLTGRAIYTSSMFYDQANTQSVPDWTRFDAGLRYTTEGVNGKPVVFRALVQNLLDDSYWASAARGFLAVGAPRTFIVSASVDF

SEQ ID NO: 15305 - protein, 713 aa, Pseudomonas entomophila
MRPTLLVTALAVALALPAPYAFAQQTSTSPAVTELDGVNVVGRAQTLYKSEDAAVATRTDTPLALVPQSVQVLPRELIDDQAARQITDLYRSISGISFFSYAGVTLRGFRQENVLYDGLRGDPYAGFSVPQLFNIERVEVLKGPAGALYGGGEPGGVINYVTRKPSHQALRRVELQLGNQSFGAASFEATGPAREDGRIRYRIGAYADGEDGFRWNTDSESQIGDASVAFDIGETGELTLQYTDITQNLGGNRLRGVPVDDDGNFLTNRRWNHNESTDFLDMRAKVAFAQYKFAPSSAWDVDMALRWFKNDEHQIYHEPMGLIDRDGNGIAEWMTRQLRNQYRDNDALSSNVNAVFRTSTGAIGHKLLMGADHYRLDADFRAQTANTADTGRTRGPVPGIDLFNPVYGRSGFYDYGLDTLPWRATSTRSQRYGAYLQDELTLTERWFAMAGLRWDGFNDDNRLDGSRITGNDLSWRVGSTVVLREGINAYASYASGFLPQDAANQDSSVGGPFDPERSTQWEVGLKTALNDGGLTLNTALYRIERSNIVQANGSIVDGVNQLSALGLVRSEGLEVDLLADLTERWVLNLTYAYNDARVLDAGTNGITNASGDRFANAPRNTFGLWTRYELPAWNSAVAFGADYVGERLSLEGQRVKPYAIFDISWQTQWDAWKLQVNVKNLFDKVYAASGFTERTGHFPGEPRRIYAQLAYSF

SEQ ID NO: 15306 - protein, 535 aa, Pseudomonas entomophila
MFQRLLVAPAALGLLAPMAVNATELNIDGVSDYAASGEQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFSTTTKLKGQTTFVTGASTAGSSVSSAADDYNQSFGAVTFNYDLRLALDTSFTGKDLLRTRLRTGNFGNSVFGNGLTAMEVAFEEPSGANSVGIDRVFYQFPIGSSFTATVGARVRQDDMLAVWPSAYPADTILDIFTYAGAPGTYNLSLGAGAGLSWSNDGFSISANYVSINGQNSASGTGDPFNPCDDTTGGIGTDCSGSNGTVQVAYTADNWGIAAAYNYASGDNGVGLYSGNGTPTANILQTGGANNSVGISAYWSPEESSWIPSISTGWGLNDNAGVDGLTKSSTSQSWYVGLQWSDVFLKGNSAGMAVGQATFVTAADFTSAGKDALGTDWVGDGNYAWEWWYKFQVTDNISVTPALFYLSAPQGYIFRIVNEKDDTFNNFGGLIKTTFTF

SEQ ID NO: 15307 - protein, 660 aa, Pseudomonas entomophila
MPHLQSASLRPSLLALAIVSTLPGVTFAAADEITVTATGNARSAFEAPMMVSVIDATAPENQTASSAADLLRKVPGLTLDGTGRTNGQDVNLRGYDRRGVLILVDGVRQGTDTGHLNSTFLDPALIKRIEVVRGPSALLYGSGALGGVISYDTVDASDLLDAGKNSGYRVFATGATGDHSIGMGASAYGRTDTLDGLVSWSSRDRGDIRQSDGARAPNDESINNMLAKGSWKIDPAQTLSGSLRYYNNDAQEPKNPQTTDASSSNPMTDRSTIQRDAQLGYRIAPAGNDWLNADAKIYWSEARINAQNIDASGEFRKQTTKGGKVENRTRLFSDSFASHLLTYGGEYYRQEQHPGGATTGFPDAKIDFSSGWLQDEITLRDLPVTFLGGTRYDNYRGSSDGYDDVDADKWSSRAGLTVSPADWLMLFGSYAQAFRAPTMGEMYNDWKHFSIGSFYTNYWVPNPNLRPETNETQEFGFGLRFDDLLLANDALEFKASYFDTKAKDYISTTVDFAAATTMSYNVPNAKIWGWDMMATYATSLFNLDVAYNRTRGKDTDTGEYISSINPDTVTSKLDIPVAQSGFSVGWIGTFVERSTHISSSYSEQPGYAVNDFYVSYKGQQQFKGITTTLVLGNAFDKAYWSPQGIPQDGRNGKIFVSYQW

SEQ ID NO: 15308 - protein, 747 aa, Pseudomonas entomophila
MHQRHPLARQISLALLLAGTGSQAIAADENNKNEPALETVTVTAQHREQTLQEVPVAVSAIKGTSITADGVRSMGDITTFVPNASAKNPDGDGRPRWYIRGLGTGDTGAATVYPVGIYADDVYLNAPIAGGGPLFDLERIEILRGPQGTLYGKNTTAGAVNVISKKPTFDTDGYGTVGFGSKNERIVTGAIGGALVDEKLAGRVALYSEERDGFQNNDFDGNTYGDVNKKAIRLQFLAQLNPDLDALLKLHSRQFKGDGSNGSLPVGRYYNVGYERPQGRDISLNVNEDYRLDHDGASLTFNWYLGDYTLTSISAYDYIRNRSTSDADYTPYEVNGAAITDNSYRQWSQELRLASPEDRPLHWLVGAHYFHEDLDSSAQRIVTPGPTPNGTGSNQVGTTAFRDLGYDHRTDSYALFGNLTYDFTDDFSVTGGLRWTQEKKDIDLDLVQLTRATANGPLIPLGGVGTNGNRQEDKTWEAWTYDLTPEYRINDNLRVFFRYAHGFRSGGFNTGLSTSLAQLTTVDPEELDAYELGLKSEWFDRRLTVNANLFYYDYSDIQVNLLTVNSGVLTTALTNGAKGKVKGAELEVEGQPTERLHLRAAVSFLDTEYTDFKNTNPTTGAVTGDYSGNSFVRSPRNVVSLGADYTIPLEVGGKLVAGGDVSFRDKEYFLADRQSSADETLSQPHYTLANARLSWFSHDDKLSVTGFVNNLTDRRYQVHGRPNGTAGQYVITYGDPRTVGLSVTSRF

SEQ ID NO: 15309 - protein, 1105 aa, Pseudomonas entomophila
MSTLRSVGIAVFLFFLSTFAMGQSYRGSIRGVVTDASGAVIPSASVTVKSSATGLERSAVTDGEGLYVIAELPAGEYRLSVPVTGFRTFARNVLVDVGHDSTVDITMMVAGGDTVEVNESTAPLVEDTRDVLGQIVDNKLVVELPLNGRDFGKLVALTPGVTVEGSGVAGTEKGFGQFNINGNRDRSNNYMLDGTDNNDPFFNNSALNQVGITGAPASLLPIDAIQEFNLQTQYGAEYGRNSGGAVNVLTKSGTNAFHGSVFYFLRNSALDARNYFDPTTNPDGSPNPKGGFKNNQYGASIGGPIVKDKTFFFAAYEGQRERVTSSYTLFVPTEMQKANARAAALAATTSDGESEVPVINAINPGIDALLGYFPAATGCSNGGTPAATGCIGGAGTVAGAVEDRNDLDNGIIKVDHYFTQTEQFSARYAISNSDQVFPLGGLGTYGNGSRLAGFAQTSPTRVNVVSASLLSTFSPTFLNELRFGYSRYNTSFNTLDGTVDPNSAFGLNMGTGKTGVPEIDFFALYDNLGASAYSIPRGRTSQTYQVLDNLTKIHGAHTFKFGGEFRRATIENFNDNLERGLLALDPYQLTNGPWPGDDQTAMLTNFYLGIFDWGTAANTGNTQRNTFNNGFSFFAQDDWRATKKLTLNLGVRWEYFGPLGESNGLISNLGTDGLLHMTDQPYNKDWNNVAPRVGLAWNVFSGTVVRMGYGVYFDYVPQNNMIANYTNTAGLVTNPIGPKAVTSMDYNQSAFNGSDAGAAVFTPSTGAQSIFAVPQNFATPYTQSWNVNVEQELGKAASMQIGYVGSKGTRLTRLYDANQDYTNSNYNAIDVLATISDSTYNALQATLTARSWKGISGFANYTWAKSLDDASDGIDFNFASAAFPQNSDCPVACEHGPSTFDTRHRFTGSMNYAVPQWKALPPVLGKGWELNTIATFQSGRPIPILTSNDTSGTYNYHQRPDRVPGVNPVLDHWNPVTGYLNPLAFQQPADGTFGNLQRNSIYGPHYTNVDFSITKNMPITEKVNVQFRAEFFNIFNHPNFALPGGTLNPAYLADGTLDPSVVDPASHAILTPAGQVTQTPDVAQGNPGLGGGGPRVIQFGLRFSF

SEQ ID NO: 15310 - protein, 248 aa, Pseudomonas entomophila
MFANNIVYVSYNHGYRAPEYDKAYGFVNHDFVPLTPFVIAPNLDLEAETSDSFEIGNKFDNGRAYVYASVFYNKFENFIDVVTTGFDSSTGNYIKQYQNLDGVELAAGYGLTKQWDISTKFGYVDGKDTKGEYVRSITPFEGNVQLKYAHQDFNAYVAWNWAAAMDRVPKCQTMLGLATECAQTSAWNTFDLGATYYVSKDLRVSANIVNLFDKEYIRYQDVAGIAEESKRYSTEPGRYFTLNAKYEF

SEQ ID NO: 15311 - protein, 686 aa, Pseudomonas entomophila
MRYLLPAILLLGTQIASAQSILKDKDDKELSVLLNEVVITGTGTEHYLKDAPVQTEVITSKALEQYQARSIDDLLSGLSPSLTFHDGDMGSHIQLNGLNNDYILIMINGKRMNGDVGGQNDLNQLNPANIERIEIVKGAASSLYGSDAIAGVINIITKRNREKMELTNTSRIGEYGDIRQSTSFGFNYRKIKSVTGINFRHTDGWRNTDLQWDQNQLKSGSTMLTVNRSSNYTLSENIEWQVNRKLDLTAEGTYYERWVMRTHGPWKYQANDFYYRNYTFAVGSKYKLGKRNYLTADLSYGRYGYFYDYKLNEHTDYFLDNDRHERITYFAGQRIKQSIQKQILGQVKSVFYLGEDHILNAGIEYQYNHLESPHHIDGDRASVYTLAAYIQEEWTARENLVLTAGVRGTQHKETGLNFSPKISGLYKPGEHINLRASYALGYKAPTIKELYYNYTGVIGGGALTAYHGNTDLKAQTSQYASIGIEYVGQKFQASLTGYMNYLHNMIELVEISVTPDEKFLEVEKSKQYKNLTKARIYGMDFTFNYRPAKSLSLAGGYSYADPKAQYPNKGIDYMKYLPIDATSSHNANLNILWQHSWKLYRLGIGIYGRYQSTRRYINDNNADGFQTWRINTAHSLLKMKRWSLTMNAGVDNVFDYVDRTPFGRNRATSTPGRTFYVSALIKFKNN

SEQ ID NO: 15312 - protein, 709 aa, Pseudomonas entomophila
MNHTFSVISLAVVGSLLSLPLVAFADDGIERIAIHAERMPSELNAIARSVSVIDENMLRQQFATANNLAEVLAKVVPGMAPPSPALSNFGTTIRGRNALVLIDGVPMNTNRNISRDLHNLHPSQVARVEIFRGGNALFGSGATGGVIYIHTKTGQAESQQHSRIGLKSSLNELSGDALSYLVSHASSGEAQGWLYRVAGSTEKTNGYYDADGDRLAPEPSQGDSYDSPIYSLDTKVSKEWDNQKLTLSALWYSLEQDSDYASDPSAATEPYITKARAIKGLQLDKQNEIKNLVLNAQYQRLLTEDATLHTQAYYRDYAARFAPFDGRPFATWDHLAQTYLESSNIGLRITINTQLSDSIELDWGLDTNDERSEMPVTTYDGQVYDDSNGLVFQPLGDKDFVPEISHKSLAGFTQIRAKISNQFSVEGGLRYERIDASFKPFVTLGSQTAVPGSSYDYSSFVYNLGGTYNINDDHTLYFATNEGYDLPDIGLQIRYASSQFDLSQSNLEPVETTDYELGWRGVVGPIAANFAYFTSSSDLGNVKSENMGLALSRNKVRIDGFEASANYQINTAWSVDINYSYINGEEKPDGKIDYTTMNGFSIPPNKLAAVLGYESDSGWNSQLTWLNVAGKDYRLDGKNAFGRRDTESYNVLDWQNSFELGAGMLTIGIENLLNEQYFSLYSQLQRNSNNTSSIPGRGRTLSLQYQFNW

SEQ ID NO: 15313 - protein, 1130 aa, Pseudomonas entomophila
MDVPTVMSGGIAKGRVRIASVAAARIKHLLLSTALAGIVVYPQALLAQSWNGAVDADFSNGANWSTGVAPTSTDVSTIASTPTTPVVAATTANSGQITMSGATLGINAGATLVLNTLTLTGASSVTGAGAIATNLLHLDSGSVGTDVTLATLATMGGGTFGGAISGAGQLLVSSGFNFLTGANTYSGGTDINTNAFLTVGDSATSGSITGDVLNNGNLTFTRSDTTSYGGVISGIGVVNKNGAGTLMLSGANTYSGATRILNGTLQTSANNVLSSASALTISAGATLELGNTQQTVASLAGAGTINVGASSNGFTFGADNSSTSFSGTVTGGFMRFYKEGTGTFSFSGTGPTSGAMQVDGGTLALAGAADFSGASVNLQANTTLDISGANAGISIKGLQGGLSSTAVHLGSRTLTVQRTDFAFGNNFSGVIDGSGGLTVGQNSTLNLFGVNTYTGPTTLSSASATLDLRHVSAIAASSEVDLAASGATLGISNAGGDATIQSLRGVAGSILTLRNNNLVITNAASDFAGIIKPVFGAPTGGVILNGGHQTLSGINTYLGATTVNAGTLSVNGSIATSALTTVNAGGTLGGAGTVGNTTINGGALAPGNSIGTLNVNGNLSFTAASSYMVEFSPTTADRTNVTGTATLGGATVNAIFASGSYVERQYTILNATGGIVGTFGPVVNSNLPSGFKSSLGYDANNAYLKLALDFTPTPTPTPTPTPTPAPEPSPLPINSGLNGNQTQVANALSNYFARAGSIPIVFGALTPAGLSLAAGETPTGAQQTTFDAMNMFMGVLTDPFANGRGLPNAASGASSFADGNASLGNRNGAARDAHAMITKAVVKPPVEARWNVWAAGFGGAQTTDGNATLGSTTATSRLYGIAAGADYWLSPQTVAGFAMAGGATSFGLANGLGSGRSDLIQAGGFVRHSVGAAYLTAAAAYGWQDITTERSVAVGGINQLQGRFNAHAFSGRLEAGHRTVASAFGGIGLTPYAATQVTAFELPAYAEQMLSGANAFALSYASKTVTATRSEFGLRSDKSYALSNALLTLRGRAAWAHDFNVDRSIAATFQALPGASFVVDGARPARDAALTTVSAEIAWLNGLSLAAAFEGEFSDVTRSYAGKGTLRYIW

SEQ ID NO: 15314 - protein, 358 aa, Pseudomonas entomophila
MAFLDDNEAQKMKKTAIAIAVALAGFATVAQAAPKDNTWYAGGKLGWSQFHDTGFIPNDGPTHESQLGAGAFGGYQVNPYVGFEMGYDWLGRMPYKGDTVNGAFKAQGVQLTAKLGYPVTDDLDVYTRLGGMVWRADSSSNIGGDDHDTGVSPVFAGGVEWAMTRDIATRLEYQWVNNIGDAQTVGARPDNGMLSVGVSYRFGQQEDAAPVVAPAPAPAPEVQTKHFTLKSDVLFNFNKATLKPEGQQALDQLYSQLSNLDPKDGSVVVLGFTDRIGSDAYNQGLSEKRAQSVVDYLISKGIPSNKISARGMGESNPVTGNTCDNVKPRAALIECLGPDRRVEIEVKGVKDVVTQPQA

SEQ ID NO: 15315 - protein, 147 aa, Pseudomonas entomophila
TGNKSQLARVAAQWNWNTALWQGSSTQLGGYWDLSLAEFRQNQYQNIPGQKKNLTDIGFTPVFRFQANDKKGLYGEAGIGVHLMSHLYDNNSRRFSTAFEFGDHIGTGYVFSNGLDIGLKLQHFSNGGIKKPNSGANFAVLRVAYPF

SEQ ID NO: 15316 - protein, 1040 aa, Pseudomonas entomophila
MTLSGIGTETLTGANTYTGATTINSGTLAIGAGGSLSSSSPLNLTGAGATFDVSGATTPQATSSLSGVAGSTVNLGGNNLTLGGTGSGTYGGTIAGTGGSLTLSGTGTETLTGANTYTGGTNLTGGGTLIAGSNTALGTGTLNTSSAGGTLAAGTPGTTLTNAVNLGTGSTLTVSGANNLGLSGAISGSGTLAISGPATTTLSGANTYTGGTSVTGGGTLVAGTPTALGSGTLSVGGNGGTLGTSVAGTTLGNAVNLGTGSTLTVGGANNLGLSGAISGGGNLAVSGPSTTTLTGASSYTGGTTIGSGSTLAVGGNGSLSSGSAVTLAGSGATLDVGGASSPQTTSALSGAAGSTVNLGGNTLTVAGPAGGAFGGTIAGTGGFAVQGGGTQTLTGANTYTGGTTIGSGSTLALSGAGSLAPTSPMILAGSGATLNLTGSAGPQAIGTLSGTTGSNVNLGSTPLTVNSAGTGTFAGTLSGTGPLTLSGTGVQLLSGTNTLSGPTTVAGGTLAVTGSLAGSPVTVGNGATVTGTGTIGGLVVSGGGTASVTQLGQPLKVAGNATFQPGSTLQVGATPQQSGSLDVTGSATLNGGSVQVVAASGQYQPNKTYTIVNAGAGVQGQFSTVNSTYAFLTPTLKYDPSQVLLSLAPNGTPFASVATTPNGQSVAGAIGTLGAGNPLFDTVLTSDAPTANRAFAQLAGDLYPSTRSVLLSDSRYVRDAVLDRARLGSQPGGALCGCEAPVSADDHAASLDRRLASENGCTPAKSYKPAVWGRVYGSHSRFDGDGVASVDRNLYGFVVGTDAEVSSHWRVGIAGGASRSLLNADQNQSAKVNGETIALYASGRYDAWNVRGGVAQSWYRVHSERNPSFGGFSDHDTASYDANATQVFTEIGYSTAIRNIALEPFVGLAYASVHTGGFKENGGAAALEGDSSTTGLGFSTLGVRASTDIAVTTKGKVTAFGTVGWRHAFGNTQPGSTLSFASGGSPFSAVGVPVARDAAVLEVGVDAAVTKNLSLGLSYSGQIGGSFSDHALYGNLLWKF

SEQ ID NO: 15317 - protein, 717 aa, Pseudomonas entomophila
MFRMTTLALLIGSATCAWAQDQTLTLPASNVTASADQPKPATALNLDTPSESGSRLNLSARENPASVSVADRQTMERIGARNFQDAANALPGVNASAPPGWGGYVAYRGFNGAQVSQLFNGINLQYGAAARPVGAWIYDRVELLGGPSSFLNGSGAVGGSLNVITKLANRDEDTFEGRVSYGRYDTWETAVGFNKELNSGDGPRHYARLDYSRTHTNGYIDRQENGAGNLAFSLLSDINDQLSHTLALEYLEEKEDSPYWGTPVLQPLTGTLHIDKSNRFNNYNVEDGRYEQRTRWLRSITDYRFDDTTQLRNTFYHYDGQRDYRNLEVYRYNADNSAIARSGGYRQRHDQEVNGNRLELTHQGQLFGLASDWAFGIDYNRNQQTNYPLSKGAFDIVNPNGFEPDHFLDIPGMDAPRSKGRSTTTDTSSGFVENRTRLTDQLSLITALRYDHIDFDVVDHVARSKLDRRWDAVTGRLGLVYDLTPNVSLYTQYSTSAEPPGGTLTSASISQVGDFDLSTGRQVEVGSKFDFLDGRGSATAAAYRIVRKNISVPSSTVPNTTEQAGQQTSTGIELAASFKVTPKLLAAGNFSWVNAEYDEFNETIGGVVYSRKGKNPVNIPDRVANLWLTYDLAPGWQVGADARYVAAVYANTANTAWVPSYTLYGLSMTHDLDKHVQLSARLRNLTDEVYARFIHQSNTQYYLGEPRSLEVAVQWRY

SEQ ID NO: 15318 - protein, 782 aa, Pseudomonas entomophila
MSARPTQLSPLVRTLRHVIFGASLSVGSLSMVQAAEVAPKAYHIAPSELEAALNQFGRESGVLISYGSQITSGLKSRGLEGQYTPEQGLNALLEGTGLQAMADGNNGFTLQPANTAGAPIELGVSTVVGDWLGAAQQTNVFEHPGARDVIRREEFERVGATSAREVLNRIPGVNAPDNNGTGSHDMALNFGIRGLNPRLASRSTVLMDGIPVPFAPYGQPQLSFAPISMGNMDAVDVVRGGGAVRYGPQNVGGIVNFVTRAIPDTPTLKGGIQTETSPSSSHDGFKTTGNLLAGGTADNGLGGAILYSGVRGGDWREHSDTEIDDLILKGKYQIDDANSLNAMAQYYDGEAQMPGGLSVADYDADPYQSTRLKDKFWGRRTLFNFGYRYEQDARVFTANTFFTKTLRSGYLDQGSFVSLSPREYWVRGLETRFSQGFALGETWHEVGVGYRYVNEAGHELRYREPVTGELPTTASRNDRDTRGATEAHAFYIDDRIDIGKWTITPGIRYEMIDTAQNNNLTNARYQGDYSTALPALNVLYHLTDTWNLYANTEGSFGSVQYSQMPNRVTGDEVKPEKARTWELGTRYDNGNLRAEIGAFLINFDNQYDSNQTNDTVIARGETRHQGIETSVNYALEGLSPVLAGYDVYATYAFVDATIREDGPNKGNRVPFSSKHKGTMGVSYTEGPWKLNFDSAFQSDQFADNANTSTESADGSTGKIPGYMLFSTRANYDFGPQLSDLNVAVGMKNIFNRQYYTRSFDDNNRGKYVGEPRTVYVQTSVAF

SEQ ID NO: 15319 - protein, 195 aa, Pseudomonas entomophila
MSEQRVVVMGLGNLLWADEGFGVRVAERLYAHYHWPEYVEIVDGGTQGLNLLGYVESASHLLILDAIDYGLEPGTLRTYAGERIPAYLSAKKMSLHQNSFSEVLALADIRGHLPAHIALVGLQPAMLDDYGGSLSELAREQLPAAEQAALAQLAAWGIVPQPANESRCLNYDCLSMENYEGVRLRQYRMTQEEQG

SEQ ID NO: 15320 - protein, 429 aa, Pseudomonas entomophila
MFAPFPLAPGRRVAGLFFLFAGVNAQAAGFIEDSSAKVEARNVYFNRDFRDGHSSSSQGASKREEWAQGFILNVQSGYTQGPVGFGVDALGMLGYKLDSSPADSNSGLLPSSGHNPRHSVDQYAKMGIAGKVKYSQTVFKYGSMMPDVPLLKYNDGRLLPTMFHGAWLTSEEVRDLKFTLARLNQYTARDSTDRQDIRVHCKNKRYACDIEADHFDLAGVDYRFNDRVSAQYQVSKLENIYRQHFLGLVASQPLDVGTLSADLRVIKSDDIGNARAGHIDHRAFSGMLGYSLGGHKISAGWQRMFGDSAMPYLDGTNPYLVNYAQVNDFAAAQERSWQLRYDYDFKALGVPGLSFFTRYINGDHIKVPGSLAEGKEWERDSELKYQVQSGTFKDVSVRLRNSTYRSNYEKWARDMDETRVIVSYNFSIF

SEQ ID NO: 15321 - protein, 769 aa, Pseudomonas entomophila
MPLRPSPLAFALILAAPFALAGEPRAYHIAPGTLEQALNQFGRESGALISFSPAITQGLNSPGLEGQYEVGQGLDALLRGSGLQARRETDNAYSLQPQPTSSSGAAVELGASTVVGDWLAEARQDNVFEHPGARDVVRREDFERSGASSAREVLNRIPGVNAPENNGTGSHDLALNFGIRGLNPRLASRSTVLMDGIPVPFAPYGQPQLSLAPISLGNMDAVDVVRGGGAVRYGPQNVGGIVNFVTRAIPEEATFKAAVQNQISPSSSQDGLKNSANLLVGGTNANGLGGALLYSGTRGSDWREHSDTQIDDLMLKGKLQLDDANSLHAMAQYYEGEAEMPGGLSTADFDADPYQSTRLKDKFWGRRTLFNFGYDYKQDDRQFSVNSFFTKTLRSGYLDQGSFVSLSPREYWVRGIETRFSQGLALGDSWHELGIGYRYVNEAGHELRFREPVNGALPTTASRNDRDTRGSTEAHAIYLDDRIDIGRWTITPGVRYEMIDSEQSNKLNGQRYQGSYNTALPALNVMYHLTDSWNLYANTEGSFGSVQYSQMPNRVSSGEVKPEKARTWEVGTRYDNGDLQAEIGAFLINFDNQYESNQTNDSVIARGETRHQGIETSVRYALDGLSPALAGFDVHAGYAFVDATIREDGPNKGNQVPFSSRHKGTLGVGYTEGPWQLNLDSSFQSSQYADNANTGAESADGSTGRIPGYMLVSTRAGYDFGPQLSNLKVAVGVKNLFNREYYTRSFDDNNKGKYVGEPRTLYVQTSVEF

SEQ ID NO: 15322 - protein, 299 aa, Pseudomonas entomophila
MIRNTRRFAAAFACAASCALAAPLAHAQATTETAANTGGSSGGLSSFMDDYVWGRNIMAVGWFHIHPLDSATPLTTSTSSLGLGTWQSPGTDVRVSNADTLSLTFTHLFDDNWAGTFVGGVPPKFNLYGSGNVIAPIPVIGPLTLINLGLPQNNPVATVREWSPAIQVEYHFGTAQSKVRPFVGVGVSYNFFTNLRLNSNFVNALQNLGQTLQLGMGQIPTGPGKVSAETSNSWTPTATVGVSYEFAKNWIATGSVSYLPLKTTSTITIRSQQGQVLATNKTDIKIDPIVFGLNLGYRF

SEQ ID NO: 15323 - protein, 793 aa, Pseudomonas entomophila
MPPRQTRRFRIPLTLAVPFVLSGVPALLYGAAASAAELRYYEIPAGPLAERLNRFAAQAGIHVAGDAALTAGKRSQPLDGTYEIEQALNILLEGSGLQAVPTRTGGYEVRVLADGGAGMALDAISVNEVAEERTYRASTSAIGDKFETPFLEQSQTAYSVTRQVLDDFAVSDLEETVKFVPGITVGNSFGGTQDSLVKRGFGNGVDGGVLRDGIRTARGRNFNSITTERVEVLKGPASLLYGMQEPGGVINVISKKPTYQWRGTLGGQLSSEGGGSGYFDVSGPLGGSGFAFRLIGQHKDEDYWRNFGVNRDKVVAPSLAFESEAFSATLSYEYSDYSSVLDRGAFLYDGHAVGDRDHRLDEHWTRIEGHRQYASLALEYRFSPTSRLRFNYGWNQDDSSDFQADPNAYNPETGELRRRFRSNPDIERSRNYAALDWLNELELGGMRHELTLGADHERHDESNGFFHQGPNTWGFDPESPHYGDLERTEIVNLGNSQQRSRVRMLSVYAKDNIHIGEHWILSLGLRHQRFRQRDGQGIPYQIGTNVNKIKNLPFAGLVYKVNDEFSLYANYSESYKPNIVEAGTGVDGGSDPEEGRQYEIGFRYDNGWLSGLVALFDIRKENIQTTETVGGERFTRAVGEARSRGLEASLNGQLGERWNVIANYAYTDTKVLKDTEATEDNELVNVAHNVAGLFLSYDLPQSVLPGSLRIGGGARYVGSREGDLANSFELSGYTTYDAFATWSLPDVIGKKAQVQLNVDNLTNKRYFISSGETSNRVSWGAVRTATLSASVDF

SEQ ID NO: 15324 - protein, 763 aa, Pseudomonas entomophila
MKSKYSIILNQLFLSSSLMFPALSLADSNQEKTKPNKAEELGEISVVANVEPIFSSTQSSEQLRKNMVSNERDLFRHEVGIGVPEGGRSGSNGFAIRGVDKDRVAVIVDGIPQAESTMSTSARYSTERHNGNINNTEYENISSVKVQKGANSVMNGSGALGGAVSFTTKEIEDFVEPDRTFGFLSKTGYTSKNREWRQVIGGGFKTDRFFGFAQLTKRWGHETINNGKGADITGPGRGKPNPLSYHTTSWLTKIGYDINNTHRFTLFLEDRAEKKFTEEKTLGLSDENRFATDRTPYRRYGLEYRYNGLSWLETAKLFVAKQKIEQLSALRGISSYNNNLFQLASYQYIQDQTITRGELSTYPLALWRTTHRLSSKVEFRDQFLENSNSQRYFVSYLMKKNRPNYTEVVPVKSRIFSLSLLDEVALTDTLKATIGGRYDRYNYAPQNVTKTLNGAKINFPSRKLSHLSWQLGLEYQVHPSHQIGYRLSTGFRVPRAEDLYFVSRSESTDIEYIPNPFLQPETALNHELTYRFQNQYAHFSVGLFRTRYHNFIQERERCKPNRFWDPDPKKSYGAKCTHISLAQFVNEPKAVIKGIEVSGAVNGSAFGLSDGLTFRLKGSYSKGQNHDGDPLKSIQPWTVVGGIDYETEKWSISLTGRYSAAKKAKDAIETEYTHDKKVVKQWPFLSPSYFVVDLTGQVNLSKNVTLNMGIFNLFNRNYTTWDSAYNLFTRGFTSRSVLKNQPSGINRFTAPKRNFAASVEVRF

SEQ ID NO: 15325 - protein, 416 aa, Pseudomonas entomophila
MTNSPFRLLPVAVALAASFAAHASDEQKLAELEKKVAILEAKEQNSIADKFSFNGFASLNMQLGNQNHGFMKSENKVRFDEGSLFGLQGEFEVNESTSAVVQMVARGNKKENWSPDIEWAFLSHKVTPNLTVRGGKLRLPLFMYSDYLEVGYAQVGVRVPNEVYGSVVLTSLTGGDFIYDVELDDSTLSFQGFAGSQKLSASKHSYNADTQFDDIAGGVVNWTDDTWTLRAVYAQSVISSSTNWNVNSKPVLNSTFDDEKAKFYGVGGRYENGNLMLVSEVTRTTVEGFYYDVDAAYLTAAYRLDEVTPYITVSHMETQDDDERNAEANRQLANVLQNPTSASAKYAYGSAKALADKLNTQRTTYSIGARWDFLPNIALKGDISYLTGFGSTNGGVASEYKNDDNILYTVKVDAVF

SEQ ID NO: 15326 - protein, 358 aa, Pseudomonas entomophila
MKSTSNPMRFDRIFYAVSTSMLLATPVETFAFPLLDDPSSPLFLQQPAMAQLSLDPVSASGLSLGTLTAFSNKMAERHGPLAPDLIASQWAQFFPGTPRPGAQAPEQLEAPSQQLTIGPDLFVRETSGGNVHRAGIFVGHNNLQSSLKGSRVMLGDKQRNAVNLSGESLGVYWSMTHEQGWHVDAVAMGTRIDVLGRGETGQRVNDSGHAMTFSVEGGYPIRLGGSWVIEPQAQLINQQFFPGNQVQEETLQAFDSQPTWSGRVGAKLSGRYEVRGMPIEPYVRTNVWYDFSDADEVKLDQVDKISGSRYSTTVELGLGLVARVTPSMALFVSADYSSDVDDNDLNGLIGSLGVRMRW

SEQ ID NO: 15327 - protein, 1042 aa, Pseudomonas entomophila
MSRFLILLIASVAMCVNAYGQDTGRVQGRVQDAVEGRYVENVTVTVTDTGESVRTTSDGTFRIGGLDAGTYSLSVEHYGYFSRNVMVEVTAGQLSTVDVVKLKSRSSFDEEGDEDVYDLDAFHVRGEVDAYSRAINQQRVSDYNVNVVDSGTFGDVTEGNVGEFVKFLPGVNINYVAADARTITVRGMADNFTPVTVDGNRMASAASGNKARDFELEQLSINNIERVEVAKVPTPDIAADSLGGAVNLVSKSAFERDGRQIKYRVYFSANSEDFDLGSTAGHGDFNSHKIKPGFDLTYADVFKEGTLGVIFNYTNSNQFNEQHRVRTRWVTDNDYDDEGVGTPLLRRYYIQDGPKYTHRESFHVKTDYKWGENTVVSGSLQFNDYSSEFRNRNITWDSNITQVDDSDGNESDSVISPTYMYGDPDRGDIDLGGSYRNKYGDTWHGNVSIKHYGEVWTYEAGAFASSATNFYDDFSQGMIMQVVGDDDYRGRFEFSNIGDPYAGILAYTPTLTLYDSDGNVDPTYGVGSLSTFDLDEVQTREQNAQDDFAGFNFDMKRNVRVGESSGYFKMGVRMQEQKRHAKRNRIRLRHVDSTYDDTGLPAEEIYSGESAIHIGEGVIQWPDYEDIYDYYADNPDNFEWGSRTAGNVVEIANQKFHAEEKISAAYVMSQLKFMDSRLKVTGGVRYEKTEMTGVGGYFDESLGEGILDEAGRLLAQWSQRKSSSVSYDDFYPSIHFVYDVSENFLIRFAYANTIGRQNFSSIIPQLELDIPSEDEVESDGVVEFNNTSLVPQNADNYDLTFEYYPSAGGSISAALFKKEISNYIVDEFGTLDQLSQADFDGFDLPSFLLDTPLYAYQTEVNGGDASVDGIELSYFRSLSGAGMPDWLSSFSFLANATYLDVELDTFEYIRNVKTAVSYNELQDMVEESYNLGLTYDRDPWKVQLKFNSKGEQLVGDYTDLRTYPVFDDSYYVPFQLYRDKLEQFDINIDYDMNEKTRIFVSGRNIFNKEQKQFVANADRSIIVPERIEEFGVQWAFGVKGEF

SEQ ID NO: 15328 - protein, 346 aa, Pseudomonas entomophila
MKLKNTLGLAIGTIVAATSFGVLAQGQGAVETEGFAKKQYFDSSRDFKNDGNLFGGSIGYFLTDDVELRLGYDEVHNARGDDGKNIKGSNTALDALYHFNNPGDMLRPYVSAGFSDQSIGQTNRGGRNGSTFANVGGGAKLYFTDNFYARAGVEAQYNIDQGETEWAPSVGIGVNFGGGSKKTEAAPVAAPVAEVCSDSDNDGVCDNVDKCPNTPANVTVDADGCPAVAEVVRVELDVKFDFDKAVVKPNSYGDIKNLADFMQQYPQTTTTVEGHTDSVGPDAYNQKLSERRASAVKQVLVNQYGVGANRVNSVGYGETRPVADNATEAGRAVNRRVEAEVEAQAK

SEQ ID NO: 15329 - protein, 261 aa, Pseudomonas entomophila
MKRITTSLLLGSSLLATLPSHAGEWLQWHGESLTYLYGKDFKVNPDIQQTITFEHANKWKYGDTFMFVDKIFYNGKADPGKGVTTYYGEFSPRLSLGKIFDRKLAFGPIKDVLLAMTYERGEGDNEAYLIGPGFDLNIPGFNYFTLNFYVRNTEGSRPGDNVWQITPGWSYTLPVGRSDILIDGYMDWVTDNDQTRRGTYHANLHFNPQVKYDLGKALNLGAKQLYVGFEYSYWKDKYGIDSRGNLDSNQSVASALIKVHF

SEQ ID NO: 15330 - protein, 445 aa, Pseudomonas entomophila
MRTILFIAAFGGLSTVAQAADVSSAASTPGPTWRHITLYGTLDAGLTHQSHGTPLDGDYPQGLEHLISKNSDRPVTTLSPNGLSQSRLGLKGTAPIGHGLSLLFQIETGFSPLSGRLADGPKALVKNNGVPLDRQTSNGDSSRAGQVLQGVAVVGVTSRRGASLTFGRQNALMLDNIIAYDPQGASYAFSPIGYSGLAGGMGATEDARVDRALKVRYAPGPYRLTVLYKLAGSEGGARRVHAVDLGGDYRGVSVDAIYNQVRGAISASPLSAAHLAAGAPAASLAATISDNVSYGVQTRYTTGPLKLYGGWERIAFSNPRTPLLAGRETIGGYRISVVNNTAYPHRKVVDIVWTGARRAINPRLDAAAAVYLYTQNSYRGDGCDDARSATCGGRLLATSLSLTYKATPRFNLYGGAMYSRVEGGMAAGFLHAASINPTVGARFNF

SEQ ID NO: 15331 - protein, 825 aa, Pseudomonas entomophila
MTPLRLSLLALACQSVLFPVYAHAQTPVAQSEVAAQSSNDTANESPSASYERITVYGRQNQVVMNSGLATKSDMSLMETPAAVVIVDEALIDAQGITNMQDLVRNISGVTQAGNNYGIGDNLVVRGLGANYTYDGMYGGAGLGNTFNPTRSLTNVSSVEVLKGPATGLYGMGSAGGVINLIEKKPQFDSKQLFEAEVGQWDSYSLMADSTGGITDDLAYRLVAKTARSTGYRDLGTDRDEIYGSLKYVLNENQNIMLSTAYISDAIPVDSIGHPIRIYNAASVDGKTAGEVSWQDLVNDPTSKGLQLTDDQRQQLTDSLSANDGLTPYEFGHNGLISPMAKDNEGEELRFKLSHNVYLTDDLFLNQQLQYRNYETSFARQTGAYNYVYWQRSGVINADPRAPLVEDGTLYPYAARRQEYRKVSAEEKSWQYFADLRYDFDIGNISNELLVNANFEDRDIRFKQYSIYDADYTLKDSDGNLSYQGSLPYIYDIRNPNWGEGEFEDYDPLLTSNYNKSVTAWGLGLQHVGYLGGGFTSRIGVAFNEIKQSYEHLGVDARYSSSLADPQPEADTTDNGVTYNLGLTYMPTDDISIFVNHSKGRTAYSVLGDVTGNEADREDSQSISNDLGIRAKAFDDQLLASLVFFKTSRTNVAYTNPEYESSEATPDIFPYFYDGSEDTKGVELDLNAYLSDQWKVNVNAVYQDARDNQNPNSSDYGQRQKGVPYVTAGAWVTYAAEFGLPAPVSISLGAKYVDERSTHSSSFGIPDGYVPSYTVIDSAISYDVESYKIQLNINNLFNETYYDKAMFLGGLPGEERNAKLTLTYRI

SEQ ID NO: 15332 - protein, 380 aa, Pseudomonas entomophila
MKKAMLALGVASAMSSAAHAQASVTLYGLIDTGIDYVNNSGGGKLFQMQDGGYTGLAGSRWGLLGTEDLGGGYKAIFRLENGFNEINGKLGAGGGEFGRQAYVGFASDRFGTLTMGRQYDAVVDDFGPLTFTHYYGGIFYHAGDIDNGGNSFRVNNSVKYTSPNLHGFSFTGLYAFTNSNEPSVGTTGMWSVGANYTNSTLYLGAAYFFAKNPAVLLPGGDFLPNTTESAIGATGSFSYVGNPSNAQVFGFGVNYLISSTTIGLNFSQAKFDNANGTTSSVIFNNYEAWVSVAITPAFSAGARYTFSDGKVNYSGQSPRYHQVGVGAKYSLSKTTTIYAAADFEKAAGDAKVADIAEGIVGTASTTDKQLVTRIGIMHRF

SEQ ID NO: 15333 - protein, 1006 aa, Pseudomonas entomophila
MLCRNIKRSALSLALGMCVVGGVQAQSAVGSIFGSGQPGSTIAIQSPQTGVSRSITAGADGRFTFSQLPPGKYVITADGVTREVDVKVGSGSQVLLGSDAKTLDRVEVVGVQAFNPIDVSSVESTTVFTAEQMVSLPVASDVSSVALLAPGAVRGDSGLGAGNLASFGGSSVAENGYYINGFDVTNMRTFLSFANIPFQGIGQLQIKTGGYGAEYGRSLGGIVSIVTKSGSNDWHYGASVEWAPDWGAAAAKNVRERDPDASDPLYQYRSDDQFDSTIYSAYASGPIIKDRLFFFAMVEGRQETEDNFYALTSRRVSDTTPQGLVKLDWYINDSNLVEFTGIYNQAKTKYRTYEYDTDANGDNRYNVGRHEVPIEQYEMENGGKVGILKYTGYFTDNFTVSAQYGYLSNLIDSRLPANPAGGECPWAYSFGLTTSVIDRYIGCNPGTITTIADLDAEPDEDVRKAFRVDGEWVLGEHRLRFGVDQEKYESSHRGQTYAGGINWAYYTVPGNAVATGAFAGQPGRTVNGQLVPRGALYARSRVYQTSSSSYENTNSAFYLEDNWQVTENFLAVLGLRGEKFENKNGDGIAWIESDYKMAPRLGFSWDVLGDASLKLFGTAGRYYIPVATNSSIRATGAESTVSNWYFVNGWSEADGTPVGQGAQIGQTQANGSLTAPNPASVASTNLSPMYQDEVILGGQLQLTENWMAGVRMIRREVKSGMDDTCTTNPWIDWAADNGYPDFDPGSVPSCYFLNPGSDVTLNVDLNGDGEVELATLPASYLGLPEYRRLHTALEFFWERTGEKFNFQGSYTFARTRGNVEGYVNSTLEQEDAGLTQDFDHRLFTDGTYGPTPNDRQHTLKLFGAYNLTPEWQFGGNLVLQSGRPINCQGYIPLDDIPQPDQGNLSGYSGSSFYCLNAEGTRELRQRGDEGRTPWTWTFDLAAAYIPNWADNKLRIKLDVFNLFNNDRVTEYNEFSEASRDVISPNYLNDGNYQTPRSFRLTARYDF

SEQ ID NO: 15334 - protein, 444 aa, Pseudomonas entomophila
MFQLPKTCYIGLALSALATPASASEMFASDSPWMLGDWGGTRSELLEKGYDFTLGYTGEMGSNLHGGYDHDRTARYSDQFTFGSHLDLDKILGWHDTELQLTVTERHGDNISNDRINDPRVGGFTSAQEVWGRGETWRLTQMWIKQKYFDGALDVKFGRFGEGEDFNSFPCDFQNLAFCGSQVGNWVGGIWYNWPVSQWALRVRYNLTPELYAQVGVFEQNPSNLESGNGFKLSGSGTQGAVMPFELVWTPRIQGLKGEYRAGYYYSNAKAQDVLKDSNGQPAAISGAAYRSSSSKHGLWIGAQQQVTSLASDQSRGLSVFTNATVHDKKTNAIDNYVQAGLVFKGPFDARAKDDIGFALARVHVNPAYRKNARLANQAAGLYDYDNPGFLPVQDTEYSAELYYGIHLADWLTVRPNLQYIRHPGGVSQVDGALIGGLKIQSSF

SEQ ID NO: 15335 - protein, 974 aa, Pseudomonas entomophila
MRRFSWLLFISSLTLAAEGTKFDVTFAAQPLKDALTQFSRTTDQTILFDPALVTNEHTEALKGSFTAQELLDELLKNSNLCASNVASGWLVETCQDNIIKSPQPAAESKPVNQVIEEITVTGFRDSLFKAREYKRLAMVSQDSILAEDIADFPDLNLADSLQRVPGISITREAGEGRQISLRGLGPDFTRVHINGMEALGITSSPMDARGSVSRSRAFDFNIFASELFNRIDVKKSYSARMEEGGIGGTVELFTPKPADYKDFTSAFSYRQAYNSNSQHYDPRVAGMIANTWGSFGALVSMAYSERHTTEYGTNTTRWRKENKTYVGPDNPALSEKLANGEFWFPRGHRYSLWNNNQTRLGITASLQYQPSENFISTVDILLNRLTNDLDEHHIAVKNNRQVKALEWVNNDSEKEVVYAEYKDATWRAETRLDYNESEFKQITFKSFWQTSPDASFNFLLGVNSSDYRQPKLNKVNIITDGVDIITDFRKDRFYGLSRSPEFDTTNPTAFRVKDLYFQENEISSDMLTFKADFDYRLTPQNSLKLGVSHKKLSNDGHERVQGDFPTNGLTPKNEGNLFLPPEYTDVYTQHPDFNWLQGDLAQLQQHYGLAGYRLGEESIIDTSNYSVEEETDAAYFLFDFDTQMFGKTLLLSTGARFFETTLSSAGISKGIYTEIERDYSDWLPSLNMVLDITDNVLWRFGASKNITRPSIDKLSFSANVSQASRDDGDIGSIGLGNPFLQPFESINIDTAIEWYFNKQGFISLALFHKNIDNFIVEKTELLRYGSLGLPEALLQEGESVDDLFIVTTPENSDSFVIQGAEFAFSRDFDFLPEPFNRLGMIANYTWADGDTLYRDVQGTGENQVKTFAGLSNQSYNLTFYYEAEDWSARISSAYRSDYILSVQAGNTDQDESGYHDTTYVDAAAHYQLSDNFKLTLEALNLTNVREELYSDSSDRAYNTTSNGRTFLLGVSGQF

SEQ ID NO: 15336 - protein, 809 aa, Pseudomonas entomophila
MNNNKPFPRLRALALALVVSAVAVNSQAAEAGNTIQIQAQPLGSALTQLGQQTSLQLFFSPELVAGKQAPAVSGNLAPVQALQQLLQGSGLTFEMSQDTVVIKPLPTTLELGSGSLELAPTDIKVVGDWLGDAQQSVVQNHPGARTVVRREAMVEKGAMNVRDVLRGIPGVQVQDSNGTGGSDLSLNVGVRGLTSRLSPRSTVLIDGIPAAFAPYGQPQLSMAPISSGNLDSIDVVRGAGSVRYGPQNVGGVINFVTRAIPEKASAELSTTLETSQHGGWKHTESAFVGGTADNGMGVALLYTGVNGNGYRESNNGNDIDDVILKTHWAPTDVDEFWLNFHYYDGRADMPGGLTQAQYDSNPYQSLRDYDYFAGRRKDVSFKWQRQLDDATQFEVLTYYTDSFRGSAIASRDMKTLSSYPRNYHTFAIEPRVSRIFFAGPTTQEVSVGYRYLKEAMREQSTRLALIDNVPTYTPTSDGHVFQDRSGGTEASAYYIDDKIDVGNWTITPGVRFEHINTDWRDRPVLDANNRPVPEKKRSITSNEPLPALSVMYHISDAWKVFANYETSFGSLQYFQLGQGGSGNNTANGLEPEKAKTYEIGTRYDDGGFAGELTAFYIDFDDELQYISNDVGWTNLGATKHQGIEASVRYDLAGLDPRLDGLSVSGGYTYTRATYEGDIPGFKGRDLPFYSRQVATAGVRYAVNRWTWNLDAYAQSKQRAPGTGINADGSFNGDYITEPSADGQYGDIPGYVTWHARGGYEFGPEMSNLKLAAGVKNLFDKQYFTRSSDNNAGIYVGEPRTFYVQASVGF

SEQ ID NO: 15337 - protein, 1163 aa, Pseudomonas entomophila
MRHVAYCFYALLAAATAFAQAGGTGSIQGTVTDPSGAVVAGASVSAANLATGVKTDRTTTDAGFFVLSLLPAGEYSVTVTATGFQTVTRPHVTVDALAIVALDTKLALGASTQSVTVQEEASMLKTDDVALGGTIQNNVYDSLPLAMNASARDPSAFAGLVVGVNNYSTQPAGPSTGSFNGGQTYQNETYIEGLPLTNAGTESDTRNLAFGVSVEAVEQFQVETTGAKAMYEGQGVSNYVLKSGGNQFHGGAYEYFRNTLFDARGFFAPTTPVEHQNEFGATISGPIKKNKAFFFANYDGYRFVSATSPQFQSIPTAKERTGDFSELPQVTYDPTSATGTNVRTPFPNNVIPKDRLSPIALSLASYLPAPTNGGIQNNYLAVLPQLINNDSTTNKVDLNLSDKNRAFALFSTGKYTTNFTGSYAPGTSALPLPYTQSRYVTEYATTAQLHDIYSLRPNLLNQFSLSFSRMYIPLGNPTAGGNYPTKAGITGLPPGIASSAMPDINFAGNNAPISWVGTNAHVNTEAANTFDLQNNVLWTKGKHFITVGFQFQALQDNFNNPLTGTLASFSFSNNETANFSPTGTLLTTTGLSYASYLMGLVDSSSVTQNAVAETGGRYKTYAGYIQDDIKVSSRLTLNLGLRWNVWGTFKEVYNRMSFFNPDLPNPLAGNRLGALQFAGSGANSCNCATPVKTHYINPGPRLGLAYRIGEKTVIRAGYSLVYAHAGGVGGRVNGRQGLSQLGFNTSASFSSVATGQPAFNWATGYPAFQPAPFINPSYGIGFITAAAGAPIAGPSTAQTITYGDPNLGGKPPYYENWNLNIQHTLTPSLTLSVAYSGSSGHFLPGAGNAGPFTNQIPLQYLTLGPLLGQTLTAATLAQAQAVFPNIGVPFPNFTGTIGQALKPYPQYNGISNPWMNLGISTYNALQATLTRRFAQGLTFTLAYTFSKELDDLVGSPRNPFDNSLERGPGAIDHPHVGSLIFVYQLPFGAGHKMNSGSRIVSAAVSHWQLSGLVTYTSGAPLTIGGTCTSGGILGTCYPNYNPAFSGSIWINGDFGSGGKSVTSTPYLDKTAFVDPAAYTVGNIARSAPFGLFSPHNASVDLSVRREFALREHLRLALQADAFNINNAVHFGAPGTNIDSANFGTVTTMANQPRKLQFSGRITF

SEQ ID NO: 15338 - protein, 777 aa, Pseudomonas entomophila
MDRPRGRSGHPTGSVETRRMKTLKLVISVSTAAVALAASMPAMAQDAQGAEDGASAGEIIVTAQKRAERLIDVPVAISAISADALTTQNINRLSEYFDRVPGLQYSNQRVSGLALRGVTTGGATSPTVALLVDDVQFGGTTGTGQPPLPDFDASAVSRVEVLRGPQGTLYGASSLGGLIKYVLKEPDTKEFSGRIELGGTAVSHGDTGYAVRGSVNIPINDWLAVLGSGFKREDAAYLNNANPAALKAKDVNSRDVWGFRGAALIKPADNFRVVLSALRQKTDAMNSDLAITAGGVPVCAACYADTSPLPNTAVTTFEPVYGDLTINSLDSINKAKFQLYSARAELELGGVTITSISAWSRADNVITSDVSKVFGGLLKAVYGLPTAPTVQIANADRTHKFSQELRLGGDIGTSFTWLAGGFYTVEHAATDQTLIASGSLTATPYIGTGPGSYREYAGFADLTWHATDKLDIQVGGRYAHNKQHNESTLNTSPQTAPVFGSGTTIADSSDSAFTWLISPSYHFSRDIIAYARVATGYRPGGPNIAAPPSVAKSYSSDKVINYELGFKGKVVPGLLTLDASLFQIDWKDIQLQGTDSISSLTFLTNGGKARSRGLEFAASLTPWQGMSIDASLTFTDATLTEDLPTIVNATGLAGLNGDRLPFSAKVAANVTAQQVFPLTDRLEGNVGLTVVYVGDRAGTFVTDAANATRPRMLLPEYTTVDIRGGLTFDEVWSANLYVRNLFDKRGVAAADNRNGVNVPTALFIQPRTFGVTLARSF

SEQ ID NO: 15339 - protein, 999 aa, Pseudomonas entomophila
MSFVCRLLVFGLLAGLSGWSQIGGGSIVGTVKDASGAAVAGAKIRAQHQETNEERLVTTNEEGYYEFPLLAPGHYRLEAEATGFEKQRGAVFQLAAGTRPRIDLTLQVGSVTETVEVKATAPQINTTTTDLGVVMPRERIDELPLNGRNFEDLVELQAGVVNAPGSSAGSRGGISFHGSTALGTNVLLDGVDMSFGEVNGTATFTAAGGPSTLVNTVSVEAVEQFKSTANAYSAEYGRAGGGVLNVTTRSGTNRFHGTLFEFFRNNALNANDFFSNKNALGKTPLRWNQYGANFGGPIKHDRLFFFVNWEGARVKRQAQVTGNVATPALLAAVKPAIREVLALLPATFTPSSSSYIGTHIRDDQSTNRDDTFLTRVDAIAGAHRLALRDSYNNQDYTSPNLQPSMPTIFPIRFNNVMLEDSLMLGPRAFNELRLGFNRVDLNRSPLGYRDVAASISAGGISTSLSNYIHFLPTTYTIADNFTVIRGSHSIKTGFELREVRSVRDQGGPPSYSYNSIADLIADKPTTVGLSFGGSKGLRTLNTGFYVQDDWHISKTLQVNMGVRYEYSPPLRGGFNVQGSDPFGPFIQAQQPMFASDRNDFAPRLGLVWTPGGKQKTVVRAGGGISYVMPQAIFYYDMAYINPALPGVASLTAADVPAQYLQFPAVTAFQNQVQANPALLPSTFRLSRSVADYNRRDTYVAMWNLAIQRQVTSTLAVQAAYVGQRTVKLISVRPLNLVNPATGTRQDPTLGQINFEENAARIAYHALEFSVNQRLWHQLSYDAYFTWSKTLGYYTPDNTITFTGGGLQDPLNIAASNGPVEGAAGKVFKNVFSYALPGAGLGNRALRAVAGGWTLRGIVGWRSGLPFNVTSGADLAGNGRNSGQRPDAVAGIDPYAEDHATQTWLNPAAFSVVAVKAEKRFGDLGYNALIGPSAFTMDAGLHKTFNLTERQKITVRLESFNALNHTVFNNPTAATNNVNFGRALSAHTPRAYQLALKYVF

SEQ ID NO: 15340 - protein, 1016 aa, Pseudomonas entomophila
MLGCFMLCIMFTATAFAQQKTIKGTVVDATGEPLIGVNVSVKGTTIGIITDIDGNYTLEVPSKSTIVFSYIGYQTQEVAVSNQSTINVTLKEDTQKLEEVVVVGYGTQKKVTVTGSVASVSGEELKASPTTNLTNGMVGRMPGVIGFQTADEPGGGGTTIRIRGTNSLGSNDPLVVIDGVPDRDGGMNRLNPTEIESISVLKDASAAIYGARAANGVILITTKRGKEGKPVVSFNASAGFSQPTRLPKMTNSYEYATMLNEVLPGSFSDEQLEGFRTHANPWKYPDTDWFDEIVKGASPLYRADIGVSGGTEKVKYYANFGANGEDGLYRNSANRYDQYSLRTNLDVKTSKYVDFQLGVTARLEDTKYPAKGAGDIFGAARRSRPDQVAWWPSGEPGPAVERGDNPAVTSTDLAGFDHYKNQYIQNNLSVNIKVPWIEGLTLRGNGSYDIHFQNRRLMKKPVYLYTWDGTTEGSEGLSASKQWLDTPQLERKHSEQIGWMLNGLIDYNRTFGQHTIGVTFGMEGQKKQYEETWAFRQGFISDSKPELSLGGEEGQSARGYSWKETRLNYFGRASYNYLERYLFEFVWRVDGSYRFPKESRYGFFPGVSLAWRASEENWWKDNIRFIDYFKLRGSVSQTGNDALVDGDGNYDHSIQYLTTYAFNNAGTVFGGQENKRLYPSRTPNPNITWEVGTTYNVGLDFKFLQNRLSWETDVFYHKRTNMLISRNASLPEITGITLPRENLGEMKNRGFESLVSWQDKIGEVEYGASLNMTYARNEITFWDEVQNVPEYQFSTGRPVGSRNMLLYVADGIFHTQAEIDEARAKGLLYSDNTVPGDIRFKDMNGDGKIDGLDRIRPEKNQEPRFVAGLTLTAKWKGFDLMMLWQGATGAEVYIETWSGLVGNFLKSDYDKRWTPENPYSEGPRTWDRENQYWINNDNTYFMRNANYLRLKNIELGYTFNFEGLKKAGISNLRLYTNGTNLITIDGVKDADPEQRDASLGGYPLRKIINFGVQATF

SEQ ID NO: 15341 - protein, 815 aa, Pseudomonas entomophila
MKIPSILPTLLFATGAVLSFSQPAQAQTLIQVTGIQLEPTPNGLKVIVETAQGNTPQAFIIPSGETVDIQLLDSQLNLPDKQSFQVENPVDGIASVTVTQGEANTVQVTIVGTQGSPQVELVPSPLGVVLDLRPSSTTVTPEEPTEEIDIIATTEANENDYIVEDATTATFTDTPLRDIPQSIQVIPEQIIEDQQVIRLDEALRNVSGVVQGNTFGGTQDEFIIRGFTSTSGNLLLDGFRLPNSGTTFRETATLERIEVLKGPAGVLFGFVEPGGVINLITKKPLPEPYYDAQLQIGSFAFFRPTFDLSGPLTEDKSLLYRLMFGYETEDGFREFDQGVNRFYITPVVSWKPSDQTEILFDLSFIDDERPFDRGIINNVNFNIPEVPVNRIFGEPDDKSEVEEFSIGYRLNHEFNENWEIQNNFRYISSFNFNYRAEPLYDADEFGNLSRNFRSNDAYEENFNLQTRLIGKVATGPVDHTLLFGFDAFRETFWQQQNRLPVGLTPSINLFDPQYNVIPRPFLSELTTRLFFFRNRTDYVGLYLQDQVTITDNLKLLLNGRVDIATQENKSRETGEETVNGDSDFTPRVGIVYQPIEPVSLYASYSESFVPNGSTRADGTFLPPEEGRQYEIGIRTELNEGRVVLNLAAYDITKSNVATDDPLNPGFSIPTGEIRSQGIEFDVIGRILPGWNIIASYAYTDARITEDNDPERVGLRVGYVPYSAASLWTTYTIQSGNLEGLGFGAGFFYIGDRIDGFIPSVFLSSYTRVDAAIYYRRKNWQAEVNFKNLFNDYYIESGFYEPGAPFNVIGSFSIQF

SEQ ID NO: 15342 - protein, 232 aa, Pseudomonas entomophila
MNKSLLSASLFALALAAPLAHAHEAGDIIVRAGAITVNPKADSSSVKVDQGPLSGTNLGGKATMSSDTQLGLNFAYMLTNNIGIELLAASPFEHDVKIKGTALPAANGKLGTLKHLPPTLSVVYYPLDAKSAFQPYIGGGINYTWIYDEHVGSEAQSNGFSNFKAKNSWGLAWQVGADYMLTDNIMLNAQVRYIDIDTRATVENNAVAPGTRARVNVDVDPFIYMVGLGYKF

SEQ ID NO: 15343 - protein, 563 aa, Pseudomonas entomophila
MLKALWCGLLGVSTWVIAAEVWAAENTDDSLAQVTSVSQLSDVQPTDWAFAALQSLVERYGCIAGYPNGTFRGNRAMTRYEFAAGLNACLDRVNELIATATAETVQKEDLATLQRLQEEFTAELATLRGRVDAIEARTATLETQQFSTTTKLSGEVIFAITDVLSGDSDPFGVDLPRNSTILANRVRLNLLSSFTGKDELKIRLQAGSTPHPQRAGGFRYGADPVLASLGSLQTTPEGSQTFNQEFPDQAGSVEIGTVSYKFPVGDKLRAAVFANRGEHVDYLPNVFSAVGDEDGGSGSLSTFAQYSPIYRIVSQGAGVGLNYELSPAINLTLGYLAPNASSPENLTPSSSNGTTAGGLFNGRYSALAQLTIQPTRNLAFGLTYVNAYTAGTPTFLNDVGTISANSPSLISDNSRRTINAYGVAGLWRVSPKFAVNGWFMYTNQQGQSAGEDNESADVYSYAIALAFPDLGKDGNLGGIIVGVPPYATRSGVVPLYRPFLGGATDVISTIPNRATPVHLEAFYKYQLNDNISITPGVIWLIAPNQTSDNPDVVIGTIRTTFRF

SEQ ID NO: 15344 - protein, 726 aa, Pseudomonas entomophila
MKMSQSNHAMRVIPRFRCNPSILGAALLASVGLVLSTASSGVLAQDAVTDSATLPTVSVKATADANAVQAGKINGGALGTRKQVDTPFSTHVVTSEEAKDLFANTANDLFQYDPAVSITSTNAISENSMFNVRGLPIDTLNSIKVDGQSFPSWDTDLALEPFEQVELLKGLSGFMYGFGSPGGIVNYVLKRPTDTPYRSVSVGYQSAGVFSEKLDVGGRFGKDDRFGYRFNLVNEDGNTAEANGHLHRQAASAALDFRITPDLTWSVDAFYTKRKQEGTIFGLMFGPDAGGIPDASRVTHDLSQPQNYYQVEMASFGTGLDYRLSDNWHASVKYRFAKENRTNSDSLLYVYDNAGNYSNTLYAAMTRYFYQNVDAMVEGKFNTGSIKHDVVLGAGFQSQVTEYDNSEGWNVGYPLGIGNIYSSTYLTNADVHIGENLYRQSRTTQAAVYASDTVQFTSRISALLGLRYTQFHQFTYDPTGATTANYAASPVTPTVALMYKTDPYSTLYISYVQSLEQGGSAANTNVNYPATFGPLRSKQYEIGFKTDRSKWGANIALFRVDQGYYYTNSANVFTQDGTKRYTGVDASGWLQLASDWRMMGGVMWLDTKAVDIDDPSIEGKRVYGAPRWTLTGRVEYNPSYMRRLTLAFGGRYVSDMAVDAANTQFVPAYTVFDLSGKYDTRIAGKEVTFRAGINNVFNRRYWTTAWGYYVSPSATRTAVASATMQF

SEQ ID NO: 15345 - protein, 439 aa, Pseudomonas entomophila
MLKTRISLVALAMIAATQAQANDQADSKGFIEDSHANVLLRNAYINRDKKHGTDDQIEWGQAFIANFSSGFTQGTVGVGVDAFGLYAVRLDGGKGHNGGGGVDFFKPHETTNAEGNASSPHNLARGGAAVKFRISNTVLKYGDQMPALPVLQYDDARLLPESFTGTLITSKEIQGLELNAGRFTQEARKSAERRDGGGLKSINVLGGSYKFTDNFTASLYTADNEDVMKKHYLGLNYVFPIASDQSLTLDFNGYKSDINNKYVKAAGLNGDSNTIWSLAATYAYGAHSFTLAHQRSTGSTGYNYGFYQNAGGVGDGGSTIYLANSYWSDFNAEDERSWQLGYGLDFGAYGIPGLTYKLAYVVGDNINTRNVANPQGFGEGKEREIFNQIRYVVQDGPAKDLSIKLRSSFLRTNNAVQQNGYNDDGNEVRVFVEYPISIF

SEQ ID NO: 15346 - protein, 849 aa, Pseudomonas entomophila
MLANNFKKSILAINIGLVLTAGMTGTVYAADEVKVQEEVEVIEVRGIRRSLEAALNTKRFANAVVDSISAEDIGKMPDKNIAESLQRIPGVSITRNFAGEGGSVSIRGTNPELTAISLNGNYVASTGWFSQQAMSRSFDMDLMPAEMVAGVDVYKSPTASLDEGGVGGSVVMRTRKPLELDSMTIFGSLEMQDNSIADDNGFGGTGLVSWKNEESNFGILGSLSTLETVGRAHKAENYMDDGWAGAGIAEFNQTRKRDAVNFVVQYAPSDALEMSFNYFGVDLDAGNSNQNYLIIAGTDVAGFNSTVSGATEFGPLGFALNGTRTGGPFDDQNTRNAEVDTKVYSYEANYTAESYTAKFILGKTEASGGDGGNYNIGWTSTNPNQTIEFDMTRKNDMLLKPSNTDAGNHAEYVMNTPAVTEGVRSDEETFAQLDLDFAVEIGSITNIKTGLKVRDHEFLSYSNRWSFAPGINLGANGQPLTKADFADGHFDHSGVGLVAGSPTNIARTDGAALRKHINSFKNGSTLNKDGWGKVSEDITAAYVQSDYSGDGFRGNVGLRYVQTDTTSTYYDFVTLDFKTTEKRNYADWLPSFNLALDLDDTLILRMSAAKVMSRPNYTFMNPASSYNETTQTYTRGSVDLDPYRANQADIGIEWYFNESSLISASLFSKDIKSFIIQGGNVSQIQVGGQTRFVSAPAQGLGGQIEGLELQYQQAFGEFGVLANLTYAEGYGLQQSNGQIVKAGLPGLSKLTMNLTGYYETDLYSVRVAYNHRDEYLAESTGIGGTTLWDAHGYVDLSATWHINENLDLSLEMTNLLEETTTQRLDGAYDAMRLAAENGRNSYLKLSYRF

SEQ ID NO: 15347 - protein, 797 aa, Pseudomonas entomophila
MYKSLVSLAVIASISAPVAIAAEEGKNLERIQVIGSRIALRTATDSATPVDIITSEQLEATGITETAKALQFAAPSYSFPFSSITDGSDAVRPASLRGMSPDHTLVLVNGKRRHGSALVHLAGTLGKGSSNVDLNAIPMTSIKRIEILRDGASALYGSDAIAGVINVVLKDSDEGGSIVAQVGQTYEGDGEQVRVGINQGFSFSQDGFVNVSLEAHQKNSTNRAGLDPRQQYPTLADGSPDPREATFNRKNHHVGDSDYDNYGLFLNAQQGFDTKGKLYAFGGISKRSSTSGAFYRRALDSRNVIEVYPDGFLPQISPEIIDYSLVTGYEFELGQWEIDSSVGFGSNSFEYNVENSINASLGPNSPTSFDAGTLSTSELNLNLDASTYYDFANDSDLLVAMGITWRESGYQIEAGQEESYIQGDYQDKSGGSQGFGGFTKESEVDEDRTNLGLYIELENQLTDDFYWAAAVRYEDYSDFGSNTSWKLSGRYELTDSVALRLTTDTGFRAPSVQQLYFTNVSTFFDPDPDTGEFIPRESGTFNQLSPVRAELGIPDLKAEVSHSYSAGIVYTGDNGFAVTLDAYEINVDDRIILSGSIDKESSPAIAAILEGTNADSARFFMNAVDTKTQGVDLVITQGFDLGEYGDLKANLAYSYKETEIESISLPSILNGLEDELFDNIEVVRMTEANPKNTANIGFTHQYDDFTTNLRFSYFGEYTVGYSSSEVEYGARWTTDLSTRYRATDNLAVTLGVQNLFDTYPEKRPEDNNFNGIFVYPLTNTPFGFNGGYYYLDLRYTY

SEQ ID NO: 15348 - protein, 778 aa, Pseudomonas entomophila
MSRLSRWPARASRFTLQPLAAGVLLAAANGSFADEPVAATPALEQDAKLGTVTVNARRREETAQSVPTPISVLNSETLETQRIYRVQDLQQLVPSTNVAYVHARQSSISIRGLGNNPASDGLEGSVGIYLDNVYLGRPGMAVFDLLDVEQLEVLRGPQGTLFGKNTTAGVLNITTRKPTFHREGSVQQSIGEDGYLQTQGSFSGPISDTLAGRISAYHTQDDGYVKNIHNGDDLNGGKRQGFRTQLLFKPSETFNLRWIGEYNEEDSNNGILSLYSTGPTLNGVNRYESLAAQAGATLVSGKDRKVNFDADQQVTVFQGGTSVEANWTLPNDFTLTSITAYRWWDFTPRNDDGLNVPVFYSAGVSVRDKQYSQEIRLASPTGGAFDYVLGAYYFKQDLDNKSFTYYGPQADIWNLTPAGALNNVNTVGNGHIDTDSYALFAQGTWHVTDRLDFTAGVRGTYEQKSAWVTRDAPAGGAPVTGAAAAARQGRVGAYDSGDLNQYSFSPSGLLGLSYRFNEQLLGYATLTHGEKSGGINLTVGAAPRLGTDSLLVGTERVNNAEVGLKSTLFDDRLQLNTNLFWAEVHGYQANVYDQINRVQYLANAGRVRSRGLEFEATALPIRGLTLNFNGSWNDVRYTEYDDAPCPPEVSLANASATCDLSGHQVVGASKYIANLNGQYKWQLAEHIEPYVTASYAFRSKAVGTIDDSDFGQIPSYALVNLSTGVRLDQGDGVLDLSLWVKNAGDKTYFTSLWNSANGGYAGVLGTPRTFGATARYDF

SEQ ID NO: 15349 - protein, 600 aa, Acidobacteria bacterium
MRRLLIGGLLALLPGAVLRAQPLDWPSLPYDYVAQGESLRDVLANFGANYDASVIVSDKVNDQVSGRFDLESPQAFLQLMASLYNLGWYYDGTVLYVFKTTEMQSRLVRLEQVGEAELKRALTAAGIWEPRFGWRADPSGRLVHVSGPGRYLELVEQTAQVLEQQYTLRSEKTGDLSVEIFPLRYAVAEDRKIEYRDDEIEAPGIASILSRVLSDANVVAVGDEPGKLRPGPQSSHAVVQAEPSLNAVVVRDHKDRLPMYRRLIEALDRPSARIEVGLSIIDINAENLAQLGVDWSAGIRLGNNKSIQIRTTGQDSEEGGGAGNGAVGSLVDSRGLDFLLAKVTLLQSQGQAQIGSRPTLLTQENTQAVLDQSETYYVRVTGERVAELKAITYGTMLKMTPRVVTLGDTPEISLSLHIEDGSQKPNSAGLDKIPTINRTVIDTIARVGHGQSLLIGGIYRDELSQSQRKVPWLGDIPYLGALFRTTADTVRRSVRLFLIEPRLIDDGVGHYLALNNRRDLRGGLLEIDELSNQSLSLRKLLGSARCQALAPARAEQERLRQAGQGSFLTPCRMGAQEGWRVTDGACPKDGAWCVGAERGN

SEQ ID NO: 15350 - protein, 272 aa, Acidobacteria bacterium
MQPPKNLLFSSLLFSSLLFSSAAQAAGEGNGRGPYVQADLAYAYEHITHDYPKPTGAKKGTTISTVSDYFRNIRTHSVHPRVSVGYDFGGWRIAADYARYRKWNNNKYSVSIKELGRNDNSASGVRGHLNIQTQKTEHQENGTFHAASSLGLSTIYDFDTGSRFKPYIGARVAYGHVRHQVRSVEQETEIVTTYPKEQNVAPSPIPGAPTKKPAHHESRSISSLGFGAVAGVGIDITPNLTLDAGYRYHNWGRLENTRFKTHEASLGVRYRF

SEQ ID NO: 15351 - protein, 978 aa, Acidobacteria bacterium
MYQCSSHASAGTGVLARRLPSLRRSAMAISIGLLLAAPVYAQQAQSSQNASSSTASKATDLDAVEVRGVRASLIKSQSIKHDAEQIVDSVSAEDIGALPDRSVTETLQRVSGVTIDHFMARNDPDHFSAEGSGVMIRGMTQVRGELNGRDSFSAASGRGLSFEDVPAELMAGVDVYKNPSAEIIEGGLGGTVNLRTRMPFDQPGRIIGATADVNYGDFSKTYKPSGSFLFSDRWNTGLGEMGLMVDVAHSELATRSDGIQVEPFVRRTDAALLEGTSFDKVYVPGGVNWRQLDFERKRNGVAGAFQWRPSDDTEIYVQYMRSSYDMNWQERAAFFNDDTNAIGPAPGTQFTYDADGRFVSGSPASSSWRGNVTGNDGVRFYTNNRYAQQSTTTSDLSGGFTHKLTSNLTVRGDMQLVRSESDSLDFTLFDSIYLPGLTFDLSGKYPSVGIADSTYTSNPSNYFWSAAMDHLAKNRGRELATRFDLEYAFDGSAWLRTFRAGIRATDRTQINKNSGYNWGVISDNWAQIPGTANGTGLADLATYMTGTSQLYSYSNLFRGKIDVPNSLYFPSNAAVKDYAGTSKMIEQIVALRGSGWAPDQYQLQDINRQFERTQAAYAVMYFGNDEALGVPVDGNIGVRIVQTKTEANGYGQFPDLSGSAGSEALREQYTGQYFANNAKGSYTNVLPSFNMRFKFSDALQWRIAASKAMARPDYTQLQPYLLLAANTESNGTVSRWTGTAGNPNLQPMKANQYDTALEWYFDTSDMMYLTLFYKSVKDYFSNQTVTENYGGQDWLVTRPYNMDKGRIRGFEYGCTQFFDSWPGWLSGFGVNANFTFVDSSGGVNTATDPYTQTTVTGVSLPLEGLSRRSYNLAGIYEKGPLSLRLAYNWRSRYLLTASDVSTKLPTWSDDYGQLDASAFYRFNPHVQLGMQANNLTNTVTKVLMGPTSYTGGEVDYHLYTRSWFVNDRRYSLVLRMNW

SEQ ID NO: 15352 - protein, 866 aa, Acidobacteria bacterium
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQVCVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQTTLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 15353 - protein, 947 aa, Acidobacteria bacterium
MKQMRLWGFLFLSSFCQVSYLRANDVLLPLSGIHSGEDLELFTLRSSSPTKTTYSLRKDFIVCDFAGNSIHKPGAAFLNLKGDLFFINSTPLAALTFKNIHLGARGAGLFSESNVTFKGLHSLVLENNESWGGVLTTSGDLSFINNTSVLCQNNISYGPGGALLLQGRKSKALFFRDNRGTILFLKNKAVNQDESHPGYGGAVSSISPGSPITFADNQEILFQENEGELGGAIYNDQGAITFENNFQTTSFFSNKASFGGAVYSRYCNLYSQWGDTLFTKNAAAKVGGAIHADYVHIRDCKGSIVFEENSATAGGAIAVNAVCDINAQGPVRFINNSALGLNGGAIYMQATGSILRLHANQGDIEFCGNKVRSQFHSHINSTSNFTNNAITIQGAPREFSLSANEGHRICFYDPIISATENYNSLYINHQRLLEAGGAVIFSGARLSPEHKKENKNKTSIINQPVRLCSGVLSIEGGAILAVRSFYQEGGLLALGPGSKLTTQGKNSEKDKIVITNLGFNLENLDSSDPAEIRATEKASIEISGVPRVYGHTESFYENHEYASKPYTTSIILSAKKLVTAPSRPEKDIQNLIIAESEYMGYGYQGSWEFSWSPNDTKEKKTIIASWTPTGEFSLDPKRRGSFIPTTLWSTFSGLNIASNIVNNNYLNNSEVIPLQHLCVFGGPVYQIMEQNPKQSSNNLLVQHAGHNVGARIPFSFNTILSAALTQLFSSSSQQNVADKSHAQILIGTVSLNKSWQALSLRSSFSYTEDSQVMKHVFPYKGTSRGSWRNYGWSGSVGMSYAYPKGIRYLKMTPFVDLQYTKLVQNPFVETGYDPRYFSSSEMTNLSLPIGIALEMRFIGSRSSLFLQVSTSYIKDLRRVNPQSSASLVLNHYTWDIQGVPLGKEALNITLNSTIKYKIVTAYMGISSTQREGSNLSANAHAGLSLSF

SEQ ID NO: 15354 - protein, 694 aa, Acidobacteria bacterium
MSLARSPRVAALGVLLFGLPAQAEEPAVSEDPVFTLPSLIVEARHWREDAQAVPGSVEVLTRDRLETPLWDSVGALPKLSPNVQIEDSSVQTRIVVRGMTSANTALQDPVGFFVNDVALPLGASQAPALFDIERMEILKGPQGSLFGRNTEAGAVRIITAEPASTAEAWASLTPSLLNAGDRWQPVYTGAAGMSGPMGKTMTGSLAVRAQGTEGVHHNRFDDGDEGGDLDRFTFSGGLGAQAGDATTLSLKSVVDRVDMGKQRMRYLTGPYATGPYVTNYNTDAWDKKTSAIQSLRVDHAFDALDLTSITGWTSFHHDFQMDLDTGPLATRPTELDHWDNALSQELRLASREDGGRWRWLGGLHTYRQWSDISYKAQTPRVVRDTTITQTGLAGFGQGEVRLWDDLRLGIGTRVEWIRQKGDMALTSAGRRADFDATLDTVTVLPKLSLAYDVTPEVMVYGSLARGYLPGGYNYSMATGASSLSYDAEYSWTAETGVKARLWDDRLAAGLALFHTRTTDKQILDLEPGGAQKFSNAAEAEVSGLEGSLDARLTPRWSLFGTLGLQRAEATEYSTTVSRNGRQVAVDYSGKALPMAPDVTWSVGGRYDAGSGWFAQASLNGAGSSYFDSQNTLKQGAYILADAEVGYRFKGAEVALWSKNLTGETVYTRAVSAPLGAIVEDGAPREVGLRLRLTW

SEQ ID NO: 15355 - protein, 218 aa, Acidobacteria bacterium
MRTTTLLAALAVSSSFTTIAAAAEPGDLLVRGRLIGVLPTEETSGVEPAFPDGSVEVENAYVPELDFTYFFTDRIAAELILATSPHDLEGTGDLEGLGKVADVWALPPTVTVQYHFPLANGIKPYVGAGLNYTLFYNEDASDSLTDAVGDTKIELDDSFGLALQVGVDMPINDTWMVNADVKYIQIDTTATLTTGALVNTVDVDLDPFVVGLGVGRTF

SEQ ID NO: 15356 - protein, 317 aa, Acidobacteria bacterium
MRAKLLGIVLTTPIAISSFASTETLSFTPDNINADISLGTLSGKTKERVYLAEEGGRKVSQLDWKFNNAAIIKGAINWDLMPQISIGAAGWTTLGSRGGNMVDRDWMDSSNPGTWTDESRHPDTQLNYANEFDLNIKGWLLNEPNYRLGLMAGYQESRYSFTARGGSYIYSSEEGFRDDIGSFPNGERAIGYKQRFKMPYIGLTGSYRYEDFELGGTFKYSGWVEASDNDEHYDPGKRITYRSKVKDQNYYSVAVNAGYYVTPNAKVYVEGAWNRVTNKKGNTSLYDHNDNTSDYSKNGAGIENYNFITTAGLKYTF

SEQ ID NO: 15357 - protein, 803 aa, Acidobacteria bacterium
MSKTPQHGACAAVCPYVPVLLVAAMSSCVLALSPSNRPPDAAREPSPASEHAAAGTGTSAHDDVPPFVNTERQAPPAASAITSVNSPAEADASPANEPGQLPKEASPPHPITQTADVPSSEETSSHPLPSEQEASLTSASDFEAKEPPSKSTVVRGARPAQSASEVTLGRDILDAAPRRNAVDLLRAVPGLVASQHSGEGKAQQLFLRGFDALHGQDVELDVGGLPVNEVSHIHALGYADINFVIPEVVQTLEVTEGSYRAAQGDFAVAGTVRMNLGVAEPGVHLLGTLGQYGQRRLVATVRPGDDAGTFAAVELGEGRGFGAQRGYGRASLLAQANATLGDGLTVRALAGSYVTRFDSPGVVREDDLLSGRSDFFSAALGRQGGSVSRHQLLLGVDLPRTGNGRTKLEVFGILSDLRLRNNFTGFRVDERGDGLEQTNNATTLGARAEHRRSVTAFGRPVALELGLGARRDSVEQTQRRYRESDGTFFSDEIDAAFTQTDVWGWAEARMPLGRWSFRLGGRADALGVEVFDALAFRDPRYYDGQGYSRSAFGVHLGAKAGVEYALGDDADAWRLFASYGDGFRSPQARSLSEGERAPFVSIRGAELGSRKDGEHWALQLSLFGSQVDNDFFFDHTVGTTVYTGQTLRSGVSAALQARPLQGLVTSVSATFAHAYVRASDTLLPYFAPFVARADVGWDGPLTWTGFGGSTLSLGTGLTFIGPRPLPFSERSATVFLADAHVAIRRGELGLRLEVSNLLDARWRDGEFVYGSRFDPAAAASLVPARHFTAGSPRMASLSLEVHL

SEQ ID NO: 15358 - protein, 401 aa, Acidobacteria bacterium
MKLKFTLVAITLIAFTSINAQEISDTSFGKGLINFTAKDSSFSVKFAPRFQVRSMSSWNHDGNQYGSPEHNFIVRRARLKFDGFAYSPKLKYKIELGLSNRDISGANQFNRNTPRYILDAVLMWNFAENWELWAGQTKLPGNVERVVSSANLQLIDRSLLNSRFNIDRDLGIQLRHKTNLGGDFLMREKFAVSQGEGRNVTEGNEGGLQYTARLEFLPFGKFKSKGDYSQSDLKREEKPKLMVGFTYNYNQDAVRERGFAGDYMIRTDGTIYETNQTTIFADMMYKHNGFSFMGEYAKRSADDAIATEADGTTPTGDIVLTGNALNLQAGYLFKSNYEIAARFTTVDYESETGALPTEQYTLGVNKFVVGHKLKVQSDISYTTLDGNENNITFRLGFDIHF

SEQ ID NO: 15359 - protein, 524 aa, Acidobacteria bacterium
MNVTDAQIPQVIFGDAGAEQAYFDADSYEFDDLEFLDGVAKDDEWSAEFNARREMNFGSYYGFIQSGLQYRTREKSYDATTLVYDGFDGPDLLLSQFQTTVDYPLAVNFGPAVDAGALRDFFFANRGDFELNDIDTAVASNADNYGAEEDVFSAYLMGSVDINRLRLVGGLRVEDTQYDAHGFEILEQEIETAVSGDVTGAFESFIAPSLTGAELLASDLDVEYDAGADETVIEGDRVYRRRVTAENSYTDWLPSLNLRYEASDNLIVRAAYYASIARPNLAQAAPRLAFEENDKGEVEAEAGNPDLERQEAQNFDLAFEFYPTEDAVLSAGVFYKSIDNFIAQVVYEDTVINGVALEEATTFINLDEADLTGIELNYQQALTMLPGLLQHTIVGANYTYVDSEATLADGREITLPLQSQNVANLILGYDDGRLDLRAAVSYRDAYIDELGDSAAEDRIILEHTQFDFSAKYDLTENFRLYFDYKNAFDEPFRAAFRDAGRELSSQYEEYGWQAQFGFRYTFGG

SEQ ID NO: 15360 - protein, 1043 aa, Acidobacteria bacterium
MRFFYLHTYYLWTILTFVLFLASPTWAQDSIQVKGKVTYQNQGMPQVQVWLKGSKLTTTTQANGTYQLSLPTSNRPTLVFSLPGFVKVTQVISQERLVNIELQKLPAPAPPQTYTMRTLRPEALTYTTDIFKSIQNRVAGAWVTSSSGAPGAATQLLLRGHRSINGNNSPLIILDGMPINNLTLGNSVVGVDQTNRLMDVSPHDIASVEIIPSFSSRLLKYGMLARNGAVLLTSKKGKADTSPRVVFYNRFSVDNVNKLPELQNTYAQGLPVSGRSVHFGPESRMSFAWGPALADLQYNGRPTLYSRQGSLVPLRAGGVAATPNNPYDFFVQGFTFDTHLSVSGGSKNRQYYFSAGRMQQNGFVHTTGFYRNNFSAGIRQKITPNLVIGGKLYLFNTRGQRAYKGNTGASIPRGVMRTPPSFDNSHGNGSSRKASRNPSTFTLLANGAPRSFSSFFIENPYGSISRNPYGDVLTGQLVQADLTWKVSPHWQFTTQVSVDSRSDLRSIGFDIQSSSSFFGSFTEENIEMNNLYFTTELSYRTKLWNKLSVDASVGYFQNRQALINTSAFATPLQVRGDFSLDNGVEVNRFSLPDERSMRNVYLSGSLNYLGGLMLDVGLVNANHSVLSTATLTPTVGLGVDFAPLFFKNSKIVSQLKLNAHYSQISSDADVYTYGQGNLNRTQLLFGLGTTSLDLSTANASYLPALKPEMTSTIEYGASVTLFNHRLRASISHYQTTTTDQIIALNDVTRGNVLNNGGTINTQGWEFQLGGEVIKNKAVRWYLSVNLTRLNSKVNDLPREVARINMGGIDGLRPAYSSAGNGQPYGVLYGTYYQRNDQGELIINNQGLPTLGVTGAVGDPTPDWLWGIESNFSWKGVSVGMRWDIRRGGDMWNATQANLDYAGMSQRAAAARTVTNYIFPGVKLDGSPNDIPVNFYNLNATQAAETSPFTFYGVTGISEANLQDASWLRLRELTIAYTLPARWLKNWLISELTLSFIGRNLWLATNYTGIDPETNLTGTGNGFGVDLYNMPQTKSIGGAVMMKF

SEQ ID NO: 15361 - protein, 513 aa, Acidobacteria bacterium
MGFIQPILIASAALGVLASTSELKSRASHADLNINDVSDVAAHFSDVVPTDWAYQALSNLVEQYGCVAGYPNGTFRGNRAMTRYEAAALLNACLDRITEVTDELRRLLEEFETELAILRGRVDGLEARVGELEATQFSTTTKLKGVATFVVGANQFRGSANALTQHSNGSFGATTFNNDLQLNLETSFTGKDQLISVLRAGNFNADNNVFGGAGPTNLSTLETAFQEGDKPNQLTIDKLFYSFPIGSQLTVTAGPRVGQEDMLAIWPSFYPSDAILDVLTLNGAPAAYNKNLGVGAGIRWDEPTGFRLAANYVAANGSTSTTSEGGLATTHAGSTGTVQMGYAREAWSVAAIYTAIQNGDDLITYASPFTQASLNTKGMTHAFGLGGSWQVLDERWIPSISTGWGINVSDASHNGDVQTSQSWTAGLEWNNIFMDGTSAGIAVGQPVFATDLKGGNSPNDGQFIWEAWLQMNVTDAITVTPALFYLSRPLGQETPRGETFEQLGGLAKITFKF

SEQ ID NO: 15362 - protein, 417 aa, Acidobacteria bacterium
MSHWQSRTLILSSLSLLPLAAVQGAGFIDDSSLKLQLRNVYFNENFRDEHGLSAKAARSAKSERTEWAQGFLLDYQSGFTPGTLGVGVDALGLLGVRLDSGKGRSGTGLLPVHDDGRAAGEFASAGATAKVRLAKTTLKYGTLLPKTPVLVYNDARLLPQTYQGTQLTSTDIDGLSLTGGYLQRFKLRDSTDSVGLVPDGYSGGQSGDFRYGGAEYKWSKSLRLSYFHGELENFYRQDFVGLQHDLALGRGTLTSDLRYFRSADSGAAFDGKIDNRMLSGQLTYAIAGHSLGGGYQRLSGDAGLPYISGATVYSFSNAGIGKFIEEGEKTWMLGYGYNFAGLGVPGLTFSSRYLSGNGGKSRTRVDEWERDSELAYVLQQGSFKGLGVKLRNYVYRSDYARGRDSNRLYITYDIALW

SEQ ID NO: 15363 - protein, 519 aa, Acidobacteria bacterium
MRSSFTIKPLVTAIAAFSVASVAQAAGLDRSGQDTTAFFQDGTYAEAVYTYIDADVTGRDAAGNKVKDIAEDYDFFRYGVKTDIDNKFSIGVLYDEPWGAAADYHGNNDFVGSPSRVADSLISSRLGNGAPEADNIGVNNVEQFKGFINQTADKLAEGRQQLATLQGFEQQLDAAIASGAPMSAIDQQVAETAAQLGRPEINSFAAFQQLVNGTEQSLADGEANYQRLKGLEGVLDNALTNTEATEVEVRSESLTGLLGMKFGQNNNYQIYGGPVAQRLKAKVKLRGNAYETATGYDLNVNPDIDYGWIAGLQYSKPEIALKASLTYRSEIDHEVTASEYLPLAALRGVPPNQANKMEITTPESVNFDFQTGINPTTLATAKVRWVPWGDFKITPPLYNAASQFDYGPKGLNLVDYDDDQWVVELGLAKRLQPNLAISGTIGWDSGSGDPTTSLGPIEGYYSVGAGAKYNLDENWAISAGGKYLWFGDAKGQIPNGNIVSDFKDNDGFILGVKLSYQDK

SEQ ID NO: 15364 - protein, 406 aa, Acidobacteria bacterium
MFKYNKYVLVLLAMSNNALSNDDIESFSEWIHNGNVGGTARSYYFEQDFDDSNTENSSIWVNGGNVTFNTSEFNGFKLGGEVQGSYVSNINDDDDTTAGDMNAQGLVLSEAFLKYQFGDTVFSGGRQHFSSPLIANSGTRLINESFEMYQVSSSHFDGTDISIGYVTKYQTRTDKSFYVDNEFVDFDFNGSGSPGDFYKIGNDGVFFVQVNKRIAKKFKVNSQYANVINEVQALYADVEYTLPTNFNSYIAMQYYKTKWDKNELVDNDLLGFKVGFSQGGVDFFAGYTLAGGNEGENRVFRGIGQGAYYQFTATTKTAGVGAFESGTNSYQLGLGSAISNLKGKIFYTSFDNPIVGKDLNEWTVNLAYQFDGKLENIGISIDFSILDYENNQKDATDLRTKFIYSF

SEQ ID NO: 15365 - protein, 1046 aa, Acidobacteria bacterium
MKKIQILFFTFLLCLFAADVCAQKQDKVSGKILSSLNTPVKGAVVSVTGSEDVTTDENGVFQTECKDLKKAWISVWAVGYYTVRQALDGRKDINIILIPESKYKYNETTVLPFRVETNEVTTSAENITKKDFTPASMNIDRALAGQIAGLQVTRGSGMPGEGSYMNLRGVRSFVGNNAPLVIINGIPYIPDVHNSQMINGYSRNIFQAYNINDIQNITVLKGAEAAIYGSMGANGVILIETDGATSDNMNTEISYYGQFGMSWNDKRIPLLSGIDYKSFLSDMGMNYYGNMENFFNNFPFMNDAEGKNGYLYNNNTNWQDELYRNGFVTDNLFRIEGGDNIAKYDLSLGYANEQGILKSTKQDRYHTQLNGNFLVSKNFEVYATIGLAYMNGHFQEQGMSRHTNPILAAYAQSPLLAPYQKTSNGDFTPLYSSYYYGICQDLTFAVSNPVAIVNEVDANNRQYDVNIKAGFNYRIIPGLSVDGVFGIYYNYNKEHIFMPGVSDPVIVPAIDTYGEQKNVVREGVAETQNYFYNLNARFNKVFSNRHVLNAMAGCQVLTTQNELDGAFARNTTNDFYQVLNSANKVGSYFDGYLAKWNWMNIFAHADYTYNNLLNVSANMSVDGSSANGKYTNRFRVYPSAGLTWMAKNMSFLIDKDWVNRLELRAEYSVTGNSRFSSNYGRNYYSSLPYMAVSGIVRTQIPNTHLKPEVTTQMNLSLDAAFLRNRISLGVDYYRGRSKDVIMNVNTSAVYGTSGYYTNCAKIDNKGVELSFQASLIHLRDFEWIVGGNIAFTDNKIKSLGGYDQKTLEYSDGATVVSRVGGSPYEFYGLQADGVYATQAEADKANLVNSSMQAYQAGDVRFIDQNNDGRIDIKDRISLGSAAPDYFGGFYTNFRYRHFALSAEFAYSKGNKAYNAVRRTLESASSFSNQSVAVSNRWSVEGQVTDMPRATFGDAIGNNNFSSRWIEDASYLRIKNITLSYNFDKPIWNFFRSGTIYVTGENLLTATKYLGLDPEFAYSSSDNATQGFDYAKVMQPKSVKLGINLKF

SEQ ID NO: 15366 - protein, 652 aa, Acidobacteria bacterium
MSTLRLPVLTATGVLAFVSVPHVFANDSVSKMETVVVTASSYEQSQADAPASISVISREELDSRYYRDVTDALKSVPGVVVTGGGDTTDISIRGMGSKYTLILVDGKRQSTRETRPNSDGPGIEQGWLPPLQAIERIEVIRGPMSTLYGSDAIGGVINVITRKDALEWTGNVQLGTVIQENSRSGGEQSANFFVNGPLAENLLLQVYGQYTAREEDDIDYGYEDKDMQSISSKLIYQINDRHSVQLEGGTSAQSRRGNVGLSVPTTGCRRGCEDSLNEYRRNYVTLSHTGEWELLGNSDTYLQREESENKSREMTIVNTTFKSSLVKGLGAHTLTTGVDATHAELEDFTSNKASSKTKASNTQWAVFIEDEWKIAEPFSLTLGGRLDHDENYGAHFSPRVYGVWRVAPAWTVKGGVATGFRSPQLREITPGWAQVSGGGNIYGNPDLDPETSLNKEISVLYQGDSGLDVTLTAFHNEFKDKITRVVCPDTICTDGPNQWGADPTYRINVDEAVTQGVEATLAKPLTETIYLSSSYTFTDSEQKTGEYKGMPLQQLPKHLFNVDVTWQTTDNLESWTKVTYRGKEMDPVTGPSRNSIVEPAYTFVDAGVTYQLTDNTKIKGAIYNLFDEDINYKEYGYVEDGRRYWLGLDVAF

SEQ ID NO: 15367 - protein, 401 aa, Acidobacteria bacterium
MYRFIIAVALCAVWAASAHAAGFAMHEFGARGNALGGAMVARPATDPSSIAFNPALVTHLDTPQVLAGVTMVQPEVTIDTPGESTTTEANVWAIPHAYATTPLTDTMYFGVGAFPRFGLGNEYSKTWPMASELTYVGIQSVSVNPVLGFRPTKDFAFGFGVEAMYFDFEEKMRPLGMDARIKGDSTGFGLNGGMWWQAFEDIALGASFRTPVKQHVKGRATFDNVPAGYGPLFRDTDAEGDITLPGEVRFGVYWQATERLGVEVGAMRTFWSSYDELRIDYGSPVGGKPASIKQTEWEDVWRLSAGAEYRLTDNVDLRAGYVYDEEPVNSAHLDFMVPANDRHLMSLGVGYHEGPWRVDLSYTYLLITDREGEVHTAGGNVPVRFHDGYAHLLGMSAAWEF

SEQ ID NO: 15368 - protein, 107 aa, Acidobacteria bacterium
MRLLILTLSLITLAGCTVTRQAHVSEVDAATGIVRLVYDQAFLQHAHTDRYVSRGIADRACQQEGYTHAVPFGQPVGNCSLFAGSLCLNTEFTLSYQCHHSAFPVFL

SEQ ID NO: 15369 - protein, 706 aa, Acidobacteria bacterium
MLVAPLALALFGPPPTDAPDTREDQDVEEIVVERQDEGERLAQSAEAVQVIDTETAKREAADLGEVLARSQGVAIRRGGGLGSSTRLSLNGLTGDQVRLFLDGVPLGFSGFPAGVGLANVPVNLVDRVDVYRGVVPIRYGSDALGGAVNLASRPPGPGTHGAVSYQGGSFQTHRLTGSLQSRLDPIGLFARVSGFFDTTANDYPIDVEVADMQGQLSPARIYRFHDGYLAGGGRLELGAVDVRWADRFIVRGFGTYARKDIQHNVVMTVPYGEVETEHLTTGANLEYRKAFARHVDFDAVAGYSWAKTDFSDMGECVYDWFGQCILDRPQPGEIGIGPVDQAIWEHTAYLRANVEWQPFAAHGFGLSVAPTFVTRGGEDRTLDDPEARDPLTFQRDLSTVVSGLAYTLTVLDERLENVAFGKNYVQLARSEEELPGGDPRQRDRDTVRFGFGDTLRYRFAPWIWAKASYEWATRMPRPDEIFGNGTRIVANLELEPETSHNANLGLSLDKADTKAGGWRLDLNGFWREADRLIVLLGNDQVFSYQNVFKARSVGVEAGAGWTSPGDYLALDGNLTYQDFRNVSSEGAFGDFEGDRIPNRPYLFANGSARLQFSSLATQRDQLSFTWTSRYVHEFFRGWESVGLVAFKQTVDAQLLHGLSMTYLIYGDRFALSFTGEVQNLTDRTAFDYFGVQRPGRAVYFKTTLEF

SEQ ID NO: 15370 - protein, 588 aa, Acidobacteria bacterium
MSNILWKSLVVSPAVLGATLLVSAAAVAAPSTTTEVSANEQQAATEVAQKPELFAQATNNTNVVISQVNSSENQENNTLSQVTSVSQFSDVQPTDWAFQALQSLVERYGCIAGYPNATYRGNRALTRYEFAAGLNACLDRVNELIATATADMVTRQDLATLQRLQEEFSAELATLRGRVDSLEARTAELEANQFSTTTKLSGEAIFALTDSFGDTVGDNNNTVFQNRVRLGLESSFNGRDVLTTRLVSGNANNFNLGNDTAVGPALAQSGEGLQTFNVDNTGGNNVEIDRLTYQAPIGPAQVYLAANGGQHSHYAAVNNPYFADGTDGGNGALTTFASQNPIYRIGGGAGLAFTLPLGQGGGILRPSSVTVGYLGSEANESNPGSGVFQGNYGALGQLNFSVSDRLALAATYVHGYHGTGSAIFNSGSNANLFNPASARPVVGTTIANYGGINNQTGDGSAFATNSYGVSAAFRPSDRLSVSGFVSYTDVNGFGANDSSEVWSYGVGVALPDFGKRGNVLGVFAGAQPYALNRQEGSNQVPYQVEGFYKYRVSDNVSVTPGVIWVTNPGQNSDNEDAFIGTLRTTFTF

SEQ ID NO: 15371 - protein, 702 aa, Acidobacteria bacterium
MKRTYLLLLLLFMYWMYASAQQVQTAQEPADSVKNVAYIDSLYRELPEVMITGERPVVKAEQGKLVYDVPRLVSSLPVDNAYDAVKNLPGVVSMNDALTLGGQPVTVVINGKVTTLSVEQLSTLLKSMPVSRIEKAEVMYSAPARYQVRGPMINLILTSGMGKEPSLQGELYTAYSQLHYESLAERASLLYSGRKFSADLLYSYSYSRERRETDKEALHTLADGSVHPMNMYDITTSRHNNHQIRLGMDYAFTDKHLLSLVYTTAFTDVKPYATVTGAQNSVTDSHSEGQLHNAKLDYQTPFGLKAGAEFTYYHAPGSQLLYSTLGEETLNFLSKDNQRINQWRFYAGQEHTLGADWGLNYGVAYTTALDNSYQMYFDPETETLLPDNNMQSRRREQTLNFYAGLSKSFGEKLSTDVSLAAEQYHTDMWNEWSLYPVANLTYLPAPGHILQFSLSSDKEYPEYWSMQNSTSYMGAYSEIQGNPFLKPATNYEANISYILKGKYVLTAYYSRTKNKEMQTLYQSPERLVEIYKCFNFDFSEQAGLVMVVPFKVKKWLDSRITAIGFRYRQKDSDFWDIPFDRKLYTFVLTMNNTFTLSTKPDLKFTLSGFYQNKAIQGIFDLPRSGNLDAALRYTFAKGKAQLTLKCDDIFNTSTISTNVRFGQQNVKNHYMKTTRAFGISFNYKFGGYKEKKREEVDTSRFK

SEQ ID NO: 15372 - protein, 1010 aa, Acidobacteria bacterium
MRKSFILLLAFFLCVTGYAQKLTISGVVIDKDLNEPLTGVNVLVKGTTTGTITDFDGKYTLEADANSILVFSYLSMKTIEEPVNGRTKIDVTMVSDAEALDEVVVTAMGIKRESKTLTYSAQTVGGKDLNEIKNVNMINSLQGKSAGLQITPNSTGAGGSSKILFRGNKSISGSNQPLIVVDGVPMMMSVSDSQVKMAYGGERDGGDAMSTINPDDIAQITLLKGASAAALYGAVAANGAIMITTKSAQAGKVAINVSSNTTVESAMSLPKFQNNYGMSDEGTFSWGSKLGATSPNYARKFYQPGYTTNNSISLSGGTENISSYFSYANVSSNGIMPENDYLSHNLMAKVGFNLWKKVHVDVSARYNKQHIENQPSAGYLNNPITGAYLFPRGEDWDYYKSNYEVYDGVRNVNVHNWTNTKQEQFSNPYWMLNRQTPITDRNRYEFGGSVKYDIMEGLSVTGRLRYERGDEKWILNEYASSTAGRNLLGTMKDTRTFSEQTYADALASYNKTWDETYSLSVTAGGSFTKTSASSIELIGWGDKEFKVNNGVITPGAYYPNIFSPKNYYTMQTTETLKEKRLNSVFATAQFGYKEGLFLDVSARNDWSSSLAFTDGVSFFYPSVGVSALLDKFLDFGKNVDLFKLRASYSIVGNDVPIYASNKRYTIGDQGSIDPPEEAAFRTLKPEKTNSLEVGFDGTFFQNRFNVNLTYYKTNTKNQYFNITAPWETGLKNRYINAGNVENQGFEVSLGWYNQFTDNFSWSTNFNFSYNNNKIIELSNELKDWTLASYCTGAKVILTEGGHFGDLYVRDFKRDDNGKPVKTESGAPELGGTDNKDLVYVGDMNAKVNMGWTNTFHYKDFTLSFLIDAKVGGKVLSMTEATLDGWGVSERSGAARDAGEVVIDGVSFDPKAYYTTTGGTSYNSNILTSQYVYNATNVRLRELSFGYTFRNLFGANKNLTASIIGRNLFFFYKDAPMDPDVAAGTGNGWQGVDMFALPTSRSFGLNLKLNF

SEQ ID NO: 15373 - protein, 710 aa, Acidobacteria bacterium
MKRATLWIAMLAAFSPSSHATGDSLDELGLEDLVKTEVTSVSRKSQSLSDVAAAAFVISSEDIRRSGAQALPDVLRMAPGIEVAQIDNGRYAVTARGFNGRFANKLQVLIDGRSIYHPMFSGVLWELDPIPLEDIERIEIIRGAGAVMWGANAVNGVINIISKHSRNQTGGAANVTVGSQGYGNVYARIGQSLDVKTSFKLSVQGRYAEPSKQFDSRDDAEDRLKNGVVDFRFDRDLGAGSDLAIWANASRSSLGDLWQIKPENIGGSIALSPMSFMQRLHSETLVGRYRWLSDIGIESSLQLSGSRSGIEITDFIDESRTTFDLDYLGRYAIGTHDVQWGLGLRNSSDDVSATGSYLQIQNPSFIHRTSGIFVQDDWTLIPESLKLGLGMRWDKATRNDSSYSPHATLLWTPSQMDSVWLKYARAPRTAARAEQDVSILAGLTVQQTQFGNLPIVQYARPSAQGLNAEKAEGLELGYRKQFSNTVSADMTAYRYRYTKLRSGSQSGLIGCNNAFLFVPIPGMQVDPARCPGILSGQMVLLQEIQAVNGLAGWSTGLELAADWLVTPNWRLQLSYSWSKLNMDEGKDQISNADAEMTQRAKPRESASLRSQWNMTTSQQLDLWLRAMSSYERVNITDATPSASSEPNYVRIPGYVTLDLRYGYRINKDLEVAVIGRNLIGARRFEYLSDYIPTIANEIKPSVMFTTRWKF

SEQ ID NO: 15374 - protein, 3949 aa, Acidobacteria bacterium
MRRYGVGGEHSGQSGAAHPPCGRVESALRFVPERPARWPASSGFSVRMSVPSAPIAPALRAALPPDRRRSRMAQVLLSSCATVALMLAPVVVSLGVALPRPAQAQTHTLNPTNTGVVLGNYSGSTDFLITAATTVSASTASAVYGGNTNVWTLTNQGTVSAPSYTGVTFTAGGLVTNSGTGSLISGGSGVRITGGAGTVINEGAITASNLGVYLNSGGSVTNSGTASSITADVFGVYIRDVAGTLTNAGTIRSTSSSAVAISYTAASVNNAATGVITGANRGVYFFALGANATLTNAGQITGQTSFGVTFDQGSVSNTAGGTITGAGGLQITGIATVVNDGLITATGTFSGTTSTDSNSAGVRNSASSTLITNSAGGTISGAAMGIYLASGGRVTNAGTIITTGGFAIYSKAGSPTITNSGLIQGGTTTPAVYLGFGGTVTNSAGGTISGGSRGIAVKGAAGVVTNSGTVTATAGSGVGVGLTNGGRVTNANGGIISGSVGVTGAGAATTVINYGTIIGNSGTAISMTGSFNDTVQLRPGAVVTGIMNAGAGTDTLQFAGTSAGTISGVRALSFENVSVLANADWTLTGTNSFGAATFANNGKLTVAAAATASSSGPIQNATTASVLTVAGSLNSSGGLTNAAGASLVVLSTGTFSNSGTLNNSGTSASISIAGSMVNGGVVNNSGVGAGITIAAGGVLNNSATLSNSRTLTNRGTLLNTYGTFINTGLLTNSGSIAGTVTLTSTGTLDNQLGGIISATSVAAVTNASGVTPTLTNAGTIAGTNGPGVSLTAGGKVTNSGTASFISGSFGINITGAAGTVINDGTISAPSSYPRTGINLSGGGSINNTGTASVIAGGNYGVVVSGGTATLVNSGTVTGGAGNAVFFTAGGAVATITNYGTIASTSRQALYLQSGGVVTNAAGATISGTAAGAYLLNAYGAGSTVTNAGTIIGTNTTSGVGVLVNVTGFANTVVNSGTIIGNGGTAVRFVGTSNDVVRLLPGGVFTGVVDAGAGTDTLEFGGTTSATFTGLGGSGFINFEQFNVLSGANWTFTGTNTVASALAMTNSGTMTVASGGTFTNAGTLSNAGALTLDGTLLNSGSMTNSGSIAGAVTLTGTGVLTNAATGTITGATTSVGVFAYAGASGGVQNAGTITGLEAVWMNGSGFVNNAGTGSQIIGTYIGVVGFGVPINVTNEGTIRATTLTNGHAYGLYLQNGGTITNSGSASLISSADRAIQFISDAGVVTNAGTITGATYGVLFASGTFNNALTNSGTISGGTKAVAFGAGNDLLTLQAGATFIGVVDGGAGTNTLAFDGTGGSFTGLGGASFVNFGLVQVNSGASWTFTGANTISSGVTLTNSGTLANSGTLINAGVLTATTGVLTSSGLLSNSGTITGTETLTSGGVLDNQLGALVTTTGTGVVGISGTPTVTNAGTISAGGTSIFLNTGGVVANNGTASLISGGSGINVTSGNLSLTNAGTIIASSGQGVVVQAGAGSVTNAATGTISGAMSGVSFANTSSVVASIVNDGLISSSGGFGANMDWGVVTNHAGGTISGAMGAQLGTGTLINSGTITGATGPGVVSNGGGNIIGNDANGRITGATYGVKMFGGTLTNSGTILATGTSGVGVYSFNTDTVTNVGTAARIAGTLTGVQLRNAGSLLRNEGTILGSAGYGADQTTNGIIVNFGATALISGGLGGILISNGTTGNVMSVSIANAGTIAGTGTAGFGIKTMDGLGTIANTGSITGGTAGTGVFLDAGGTVHNAATGLISGGNDGIYARGAAGTITNAGTIAGTGTAGVGIAFSGTLANTLINSGAIIGNGGTAVQFGAGDDLLQVLSGAAFTGIVDGGAGSNTLEFVSGTGTLSGITNFATVLVDAGASWTLTSAASATTLSNAGSLSNTGTLTITGLFSNSGTLVNSGTVLAGSGTLSNAGLLTNSGSIVGTVSVTATGIVTNQAGGRITGVLAGVTGAGATLANAGTISATSTAGTAVVLSGAAQVSNSGSAAVMSGGLTGVSLGGLGTLTNSGSITGGTGMGASLAAGGSIANSDTAAVISGGLTGIVLGGLGTVSNAGTIIGALGYGVGLALGGSISNSGLISGGIAGVQVASGMGTLTNTGTLGSATSIGVSFAAGGTISNSGSAAVISGGMTGVVLGGLAALVNAGTIAGTLGYGVALALGGTITNSGTISGGTAGVQISGGTVLITNTGTIAGTGTAGIGVLFSAGASGTIDNYGVISGAGGTAVKFAGGTNRLILEGGSTLIGTADGSLGSNTLVVRDNATLSGVNAIGFQYVGFINATNAIGVGSTVTNATVISGTLTNQGTLNGRVTVDAGAVLNTSGVVLVSASSTNSGVIANSGTFTLSSTLVNNGTLANTGTFITTAGLFQNSGLLTNSGSIFGTLGVGGTGVVRNEVGGSIVGDLHAMFISGGTMANAGTLIATGTAGRGVEISTGTISNIGTASLIRGGQTGVASTSNGTVRNEGTIIGSSEFGVWVVNIGAVTNTGSASLIQGAISGIKMVGGGPVMNQGTIIGLANSGIDLSVGSTITNAGVGSRIQGAVNGVIVGNGAVLNEGTILGTSGIGVSLSGTSLANAGTASFIQGGQTGVDFGSAGTITNEGTIIGVSGSGIALRMGGNVTNSGLVSGATAGVSVAFGTTMLTNTGTIAGTGTAGVGVLFMGYASGTIDNFGVISGAGGTAVKFAGGTNRLILEGGSTLIGAADGSLGVNTLVVRDSATLSGVSAIGFQYVGFMDATNAIDAGSTITNPVVIAGTLTNQGTLNGKVSVDAGAVLNTSGLVAAGASSANAGTIANSGSFSVLASLLNTGTLINTAALDVAGTLATSGSLSNAGRLALAGTLANSGVFSNSGTLLNSGVLSNATTMSNSGVISGAGLFTNAGSFANSGSVLGAIALVGTGSVNNQAGGRISGTQAAVVGGSGGNVVANAGTITTSGAGSTAVALASGTIANSGSTALIQGAATGVSASGIATVANSGTIAGISGTGVDLAAGGLVTNSGLITGATTGVTISSGTATITNTGTISGTGNAGIGVLFTGGASGTIDNFGTISGAGGTAVQFAGGTNRLILESGSALIGLADGSLGVNTLVVEGSAVLDTVQVLGFRYVAFLNATQAVDAGSTISNAVVLSGTLTNRGTLGGNLQVSAGATLDNSGVVAATGTTTINGQVVSGGTFANSGTLTSTGTIASSGTLSNSGSLVNDGTLANSGSMANSGTISGSGTFANTGSFANTGAVLGTVNGVTGTGTITNSGTIIGTADTGVNLGSGGVLTNTTGGFIQGGVFGVQVGTGGTVVNAGTILDDAIAGLALGSNASLTNSGTIGGVIGLQFTGTGASATNSGTITGTGGTAIQFDAGVNSLTLTTGSVLEGGIDGGGGAGRITLAGSGTLSSTIANFGSGSALTIAGGANWIASGSWTIGAVTNSGTLQPGAVGSSLKLTGNFVQTSGGTLQVAVNPQGQSSQLLVSGTATLSGTLAVLAGSGSYGASTTYSILTSTALSGQFDTVTTDLAFLTPSLTYGSNTVSLTLSTGSTPVRFSSVALTLNQYATANAVQAGGANSALYQAVVGQNAAGARTAFTMLSGEAYASVITALLDDSRVVPQTLMNRLRQQAYGEAGGAVVALGTGGPVTLSSSALASVGQGSTGTVQPSGVAIARPNGGMADGGASRLVAWGEAFGGWGQISGTSNAAAVSHDRSGFMTGLDALIGEDWRVGLAGGYTSTDLTISGRASSADIGTYSLGLYAGRAFGPVNVRLGAAYSWSDVDMARTVAFPGFQQGVSSSYGVDTAQVFGEVGYGFSWNGLALEPFAGLAYVHMNTGAGQEVGGAAALTLHSSTADLTYSTLGLRLGTSWTLGNGTTLMPRLMVGWQHAFGDLDPAAYLAFGTGVNFSVTGAPLARDAALLDLGADWKLDDSMKLGVSYRGTLSNAVQDHAVTGSFTWSF

SEQ ID NO: 15375 - protein, 82 aa, Acidobacteria bacterium
MKVGDGGGDASHDPSGHAMMYVLGTTYDLSKRTFLHGTVAYVRNGGDSNFSLLVTPCDATSSTSPMTGEPQMGAYVGMMHTF

SEQ ID NO: 15376 - protein, 219 aa, Acidobacteria bacterium
MTTMTRLLTVGAVAAAALLAAPAAMAESAFDGPYIGAFFAYADLDVDARATVGSVTTTGDGSGDGWTFGAYAGYGMSLGPVYAGLEAEYGLNGSSIGVRAGNIRTSFDAQDSYGVSARLGTVVMDRILVYGRFGRQWTQFDVKNTLGTVAIGSDDRLDGWRYGGGVEYALAGPGKGDNMLVRLEYSYFDYDDLATTAQLASTAAQVDESQIRVGFAYRF

SEQ ID NO: 15377 - protein, 799 aa, Acidobacteria bacterium
MSRRFSFLLSPVPLSLLLTCLAPAAQAAEPSTPNRQLLTFDVPAGPLENSLTTIGRQSARSILFDPELVRGEHAEALHGNFSVEQAIERLLHGRRLRLRAAESGALSIEALPVDGALELSSFLVSDFSREDARGPAHGLVARRSATATKTDTALRETPQAISIITREEMQTRRHDSLADTLQYTSGVITQPNGYSRVADDYRLRGFDIGPRTGGVLRDGLKLQSTQFEGGQEPYGLERVEVLKGASSVLYGQLSPGGLVNTVSKRPSDEPLHEINFEYGNYQRRQISTDHGGPLDEQGRFTYRLTALWRDSETQYTSIDDDKRFFAPAITWHIDDDTRLTLLATYQETRTTLTPAMSYNITKYSAAPGRKIPYDLFAGEPSFDDYSGDMGTLGYLFEHRLDDGLELRHALRYFHSESDYDYISLNSSRVTGANLSTLTRSYNSREDISTGWASDSNLQWSFDSGRWQHTLLAGLDYYYKTYDSHRWSGNAPSLDLANPTYGNLPRVDTGIDRGSDLHSRQAGFYLQEQAKFAERWVFVLGLRQDWASSHTRNYRDRSRSTKSDQELSGRIGMVYLADNGLAPYISYSQSFLPADGTDSEGRSFEPTEGEQYEIGLRYQPPGRDLMLSAAVYRLTQENVVSSIPGSDFDEQTGKERSKGLELELKAGLTPLLNLSASYAYTDAHIVADNDPVLEGSRIEGIPYHSASLWLDYRLAGFGLPKLKVGAGARYNGTTRTSANVSDRNIPAYTLVDALLGYELDDHWQMTAKVQNLTNKRYLYCANSCRYGDERTAIATLSYRW

SEQ ID NO: 15378 - protein, 747 aa, Acidobacteria bacterium
MYAYSTIEWLWEPGGSARAERGKSGASPALCRSCDGLRASLSQNARPTKAAFHSTRVARGRSIFVRGIVLVPLAVWLLTWPAGAERVQDFRPQAAPGAKDLLAQEVPGAPRPLEGFADTRLNQPLYAPFRREGTLKEASRPAYVITRRQIEAQGARTVQEALRYLPGILSDGTAGTQLGTLSSQFIRGSNSSQVLVLLDGRPLNDLGFFGGYDLSELTTDTVERVEVVPGGGSTLYGSDAVGGVINIVSRAPSERPSTTLKASAGSFALNEQSLQTSGRSGAVGWRVDYNRLQANNNFPFEIASVGYAGTRENADVTYNNFSARLEADLSERTALSASVLSQNKDLGVPGGVPIPIPGSVGQFNTLTTDTRQFTNNWLADLGLRAKLGLGEDSLLTARLFADFLNYRYDAPLSQGSRDEIRRRSWGAQVQHTWRVSPEHHLTYGLDYRTVSAFNSTYLYPLAATNINYDGQVGQGALFVRDEIALGEDLKLNLGLRQDISGLAKGSFTSPSAGVRWQVGEDMALRANYARSFRAPLLSDLYFKLRGFFTVDGNPDLRPEQGDSYDIGIDQKIGEAALVRLTYFANTVADTIAFTFTGPTSGSYANLGLVRSTGIEASIEVRLAPSWYLSVNFTGTEPRILADANPAYVGKELSFRGADSFNASLAYESTGGWFAGLFVHSVGRFFTDNANTEALGGYTTTDLKLRLPLTDNLNFNAQVNNLFNQQYQVYPGYPGVGINFRTGLSWTI

SEQ ID NO: 15379 - protein, 209 aa, Acidobacteria bacterium
MRRALLVSSLALTAALVPATSAFAYGEGDFYTRFGVAKVAPQSDNGDFGAPLDMQIDADDDSGFAFTLGYRFHDKFGVELLAAQRFEHQVALDGDDLASIKHLPPTLTLQYYPLGGTDARVQPYLGAGLNYTHFSDEHLDGGKLDLDDSWGAAAQLGIDLLIDDHWALNAAAWYLDIDSDATATLAGNDYDAKIHIDPIVVMGGLSYRF

SEQ ID NO: 15380 - protein, 730 aa, Acidobacteria bacterium
MKRLKSHPFKVNLISLTLLFPLYSYAETTPNEELEVIGVRYAKPITVAEPAQTTINWSEIEEQQYSNFASMIDAVPGASLDGGGRSGGERINIRGFDDPSDIAVFVDGAPIGFQQYRYGTFFFDPFLIGEAEIIKGAHDYRALNGKFGGSIRIKTKSVDDLLYGNRNFGARISSAYNTNGDENAYTLTLYGKNDAGFYFLANGSVKDSDDIKVGGGETLDYSGYEQENMLVKVGYENNDHEFEISHTRYKDEGRKPWANRRGKMPNITEYNIKKYGSLEKAKYAYTVDNKYTDNTTTISYHYMPTNPYIDFNIKMARSENDRHWVRPDVAFEKMFVSVGSYGHESWLSYERDYADVFNQAQFGEHTLVTGLQYQKTDRDSLVFNASYDSNEAKNYGWYTPYYEPSGTQSIYAAYIADHYQATDRLTITPSLRYEYIKSEGKGNTAPDYNDPAAGHDYGETTHKGFSPRLDIDFDASNNTRLNASYAYALKAPTVDNIYSVQYARATATATALNLDVSRIHAYQASVINLTEGLVNSRDNLATELTLFYNDVSDTVDIRTGENLDKNTTELQSWNTNLDGFKNYGFELISQYRIEDFYSNFSASYIRGKNKGSLSDSTGSDDDHPDVPPLNINLGLGYEWIPGLRTGWEVRWYDAQTKTKTKASGNNLKVKSPSEQYTLQNAYVVWEIQQVEGLSVGAVVKNLTDRYYEAYLSNGVPSPGREVKLHLTYQY

SEQ ID NO: 15381 - protein, 660 aa, Deinococcus geothermalis
MPYLALYDWNGWYAGVHVGAIRGLSNWSAIPPGAGAPGLSGSFDLPFNFDFIGGTGNYVAGLQGGYNHVFPSRAMLGFESDISFPNSDVQVPFSVRGSQTVSSPLTGQVTYGEAVIHYGSARARAGYAFDHFLLYGTGGLAWSYDQVTRTQVDGVSVGGAATPGTVDTRLLWRLGWAAGAGIEIPLAANWTAKAEYLATGFGHKGMRFTGASEAFNSDLTMQSIRLGLNYRIGDASHIPDFLTKGPSALETDRFALHAQATYVSQYAPPFRAPYSGRNSLDPNTGRETFDTTLYAGVRLWDGAEAWVNPEVDQGFGLSASVGAAGFPSGEAYKVGASYPYTRLHRAFLRQTIDLGGEIQKVDAGLNQFSGSQTSDRLVLTVGKFSVGDIFDTNKYAHDPRSDFMNWAIIDTGTFDYAADAWAYTVGAAAEWYQGPWTFRGGLFDLSIAPNATHLDPQFGQFQWVGEIERRYAIWDQPGKIAISGFLTRGRMGGFQDAIQLAALNGGPADITAVRRYQSRGGISMNLEQQLIPNVGFFARAGIADGNKEPYEFTDVDRTVAAGLSISGKQWGRDNDTVGIAGAVNGITNVHQAFLNAGGLGILVGDGMLSRPGNEKIVETYYSFPVLAAKVTLDYQLIVNPAYNRDRGPVSVLGFRVHSQY

SEQ ID NO: 15382 - protein, 271 aa, Desulfuromonas acetoxidans DSM 684
MAFTEKWSIAKNTFDAAVVLNNDLPQTTLVGAWIGQGNNAGMLGATTSGAYAGIVNTANASTDPFTTFANEGAYAVGAITKAIPNTTAQVWYYNVAELATAWWLQADVDLKEVASGLTFGVQYANIDPEATGADNASAWAVKVGYGMENLNVSASYSSADEDGAVQVANVAGQQTKLYTEAWWNYGWVGRAGADSFHIDASYNMENIADFAAYYTYADVDTTTVDDSMSEFTVTASKSFGSLDATLAYIYTDIDSASDDVNTIQVYLTYNF

SEQ ID NO: 15383 - protein, 356 aa, Desulfuromonas acetoxidans DSM 684
MKLRNALLGGVVVLVLPQGLAARTVEGPYLGVQGGYTWAKDIEASLSTVRNDIELKDGYTLLVEGGYRLGNGIRAGVEIGRSESTIGDIAGGLPGRAGGAGDVSAWTFMGVLYYEFAGMSRFRPYLGVGAGMASVGLNDAGELFAPGLIVDEDDRAVAWQLAAGVSYALSPTLDLTLGYRFLDTGTVKIRAAGAGLGSAPVDFDYQSHTALVGLRWTFGAAPASVPAPEPAPAPVVPPAPPPPAPAITRNFTVFFDWDRSDLTADARQVLRSVAGDARSGNIFAVQVTGHADTSGPADYNQRLSIRRAEAVRDFLITQGIPADQIAIEGRGETDPLVPTADGVREPSNRRSVIIFP

SEQ ID NO: 15384 - protein, 390 aa, Desulfuromonas acetoxidans DSM 684
MKKRLTWGAACLALGAGSACAVPYQDVLLAAVPEFNGGLKEGVALYGSVDMGINYQSVGGRSTWQTQSGGEWTSKFGFFGRENLGGGWRAEFNLESGFLANNGAQQDTQSFFNRQSWIGLMSDRYGRLRLGKQIGTGLPLFIDVFGTVGTNSVYTWLGAAAVQTARGVGYNSDLGPGATQLPARVDNAITYRTPIVAGTTTLMLMYAPSNVAGRAPAASAQGALLQWYNGTTYLAASYNQVWGVNGASTVRNDLYGLGAVYDTGRLVLSASFNQYAPKLAGDGIARVYTLGTIVPFGVNAVRASIVYRDTSGVRDAAGRPAKDSALGVMLGYDYLLSKRTGLYARTGFIRNYGMSTVLLNGNPLPTEPGGTTPRTGMTPVTMSLGMYHNF

SEQ ID NO: 15385 - protein, 704 aa, Desulfuromonas acetoxidans DSM 684
MNIIKNRIVFLLSFLLCLVSPELISQTVEEIIVKGDWRQISIEKEDSSIIVLDKELIKSQPIKHFEMLSYLIPNLNFAASDSRARYFQIRGIGERGGYEGTPNSSVGFLIDDIDYSGQGGIATTFDVDQIEVHRGPQGSRIGANALAGLIYIKTKDPTEEFEGTSEVTIGDYGVLNSGVAFGGPLDQNKDITYRIALRKDYSNGFRKNVYLNKSDTSKKDESTLRLKVNWKASDKTAIKFLVTEIDMNDPADIWTIDDSLNTLSDRPGMDSQKTNAYGLKIFHTFNKFELQSLTSITDTNVIFSYDADWGNANSHAPYTYDYFSETLRNRESFSQEFRIVSNSADLASDFPAEWVLGVSYSDINESNLKNDDGVYGDPSDPYGPYASESSSSSKYNSENLSVFGNLDYFIDETTKISIGARSEDWDANYSDTLGESFNPSKRMSGGKISLVKTLTNNSTIFTSIAKGYKQGGFNLGLGLAVDSKNRNIYYDPEFLTNYETGINTKLLNSKLNIGAVIFYSDRKDQQVSISTQVDPSDPNTFSYLTQNAAEGINKGLELSMDMELTDSLNVFANLGILKTEIKNWKSRPDLEGRAQAHAPERSFALGFSWKPTARTYLSLDVTGKSSFYYSDSHSNKSDSYALTNINYGYEKNNWNYEIWVRNVFDTYYSTRGFYFGNEAPNFEDTLYKRHGDPRHLGLSVRYDF

SEQ ID NO: 15386 - protein, 295 aa, Desulfuromonas acetoxidans DSM 684
MLLQIGFAPKARKTVITINLNTLGKLLMRKNLLVLGAAAAISAPTFAADYTDGDIHKNDYSWSQFNLMYADGELPGESDHDYVEMEFGGRSGIVDLYGYLDIFNITADEDSDKQSNDKMFLKLAPRFSLDAMTGNDLSFGPVKEIYISTLFNISGGVDADGTSDVNNYFAGIGADVEVPWFGKVGVNLYALYDQSNRQMNGYQFSTNWFKPFKQFDDSFIAYQGYLDYQFAMDNDVTYGDATSGGAIFNGIYWHSDRYSVGYGLKSYNQIYGVENGIDGVKSTGNSHYVAFTYKI

SEQ ID NO: 15387 - protein, 863 aa, Desulfuromonas acetoxidans DSM 684
IDKDYYLSYKRGYQTMNNQKFNSLTLAGRHKNFDILIIDTTRNGHEIENYDYKIYPNKQADLSAVGPTREKADPYQITRQSTLIKLGFQPNENHRLSVALDDSTLETKGMDLSYVFRPCKDTACAETHGERIINDQSKRKNIQFSYENFSQTPFWDHIKLSYSSQKITNKARSDEYCHQSTCAGVLNPQGLHLEEEKGVYKIKDKYGGELKYEQDGWYRKFKNSKNEDADNDIDSSKGSLDSVLINCEKLNCEGKTFRIYQETDEKWEGKYKYEDREIITETLPNGKKYGKIQLKKGDLTPWGTQKEETARFLFPKSHGYSTDFVNDRDLNTHTQQIKLDLDKEFHLWHTQHQLKYGGLYEKTLKSMVNHQYNTAANVQWWADYFFCARGDNGNLGGEKKPRPDVSVAGCASGTPIYSDKGKDTYLIPVTTKNNVLYFGDNVQLTSWLGLDLNYRYDHVKYLPGYDEKTPVPGGLIAGIFVPFDEKDVVYGSSAQTIRPGYKDCRYTTSCYQDNVRKNLALLLRKTDYKHHSYNLGLNLDPTDWLRVQLKYANAFRAPTSDEIYMTFKHPDFSIGPNTNLKAETAKTKEVAFTFYKENSYLTLSAFQSDYRNFIDLVFEKNKQIDKGSAIEYPFYQNQNRDRARVRGIEIASRLEIGDLFEKLQGFHLGYKLTYQKGRIKDNKLRSGYAEFLKLNPEYTAIASQDQPMNALQPTTSVYNIGYDAPSQKWGVDVYITDVAAKKAKDSFNSQWTSMVKRKENIYGEVKDIDASKANGKEVKDSRGLWRNNRYTVIDTIAYWKPIKNLTFTAGVYNLTNKKYLTWDSARSVRHLGTINRVQTETGKGLNRFYAPGRNYRMSVQFEF

SEQ ID NO: 15388 - protein, 175 aa, Desulfuromonas acetoxidans DSM 684
PFYTKVDGIKYEKESKAQDPLKASFIAGGGAFGYKMDDIRVDIEGLYSQLNKNDVTGAAFTPDTVADNVTAFSGLVNVYYDVAIEDMPITPYVGVGVGASYLSNPSKADAVKDQKGFGFAYQAKAGVSYDVTPEIKLFAGARYFGSYGASFDKATKESSDKVKVLYSTIGAEAGV

SEQ ID NO: 15389 - protein, 438 aa, Desulfuromonas acetoxidans DSM 684
MISFRFLLLSGLCALGISSYAETPKETTGHYHRYKARIQKKHPESIKESAPSETPHHNSLLSPVTNIFCSHPWKDGISVSNLLTSVEKATNTQISLDFSILPQWFYPHKALGQTQALEIPSWQFYFSPSTTWTLYDSPTAGQGIVDFSYTLIHYWQTNGVDANQAAGTASSMNDYSNRENNLAQLTFSQTFPGDFLTLAIGQYSLYAIDGTLYDNDQYSGFISYALSQNASATYSLGSTGAYLQFTPNSEIKVQLGFQDSYNIDGTNFSIYNLTKSKYNFYGYASWTPKPSCGDGQYSVLLYSTRKVPEQNSQVTGWSLNAAQHIHEKLYLFGRINGATGTALPINRSYVLGLVSENPLNRHSQDLLGIGFATNKVNAKAISNVNKLRRYESVMEAFATIGFGPYISLTPDFQLYIHPALRPERRTSQVYGLRANLSL

SEQ ID NO: 15390 - protein, 826 aa, Desulfuromonas acetoxidans DSM 684
MTRYFCQLLAGTALLACVQSAYAQGVQYKRPDGSTQALKGNQPSAAAHPAPAATTGAGTRGRTPTAVSASHPIPNEPLLRKEDVTQPRAKDDGAGGLISRRVGRDDIANIGFGQTRQQMTITQDNFSRMTPGTSALSVMATLPGVNFQSADSFGLDEKSSNLNIRGFSQDQIGFTIDGVPLGNMMDSSNGLSINRMIMPENIDSVTVNSTTGSLGLAANNNVGGSVQFASHRPGDKLDIVGSGTYGSNNTWRGFVRVETGDITGNGLRGSFSYGYLTSGKSRGWGKEKEHQVNAKITQDLHDGYDGEVGVFFNYANLNENNYMTSSYDMQKRLGTDTDYTHNWDIAQQMATAYQNGSNAYPSPYNSVNDTYYSASTLRRDYIGGLHFKRHVTKEISVDLTGYYNREYGQDLMYNPYVATPGGSSLSLMGVTSTQNRGGVTGHVAWDHDFSVFKNHLEAGGWYESSVSHQATDYYDLAGDESGPSRNILHYQRNPFSSQWAHTIGSETTMYYVSDRMDFGKVTLSGGWKGFQTTSQNKAAGNLADYNRAVGKLNSTDWFLPQFGILWKPDSRIDLFFNYSENMQAMNANLLAATSQANFNSLSSNHKLRPEKSTNYEIGMRYHEGRFQTSVAAYYSYITNNLLATSTKSANAPINVYNVGGIKNYGVDVTAMYRILRPLSFLASYSYTHATYANNITGQDGSVLYDTKHKWVQGIPRNMFKADIVYDDRHLLMRVGGTFMVHRLADAVNNVHVPGQYILNGAIGYHFGDEVPYMKGWTVIGNVTNMTGQRYVSTIGANGFVASGSDLTQNLQGGAPRRFFITLKRGL

SEQ ID NO: 15391 - protein, 829 aa, Desulfuromonas acetoxidans DSM 684
MMKNIFIYFIFLVGGSSIAQTVKVLDKETGRGVKNVSIFNEDNTVSLSTDKEGFADVSLIKDNEVIIFSHISYAVYRIKKSNLKNRNFVIQLIKESEQLDEVVISAFKKDVKTKRIAERIAVVSKKDIRKISPQTSADLLAAIPGIKVQKSQFGGGSPVIRGMESNRVLLVVDGVRMNNAIYRKGHLQNSITLSPNLLEKTEVVFGPSSVIYGSDALGGVIHYYTKTPQLSENNEVKSQLFSRFSTVNQEITTSVSAELSFEKWASFTSISYSDFGDLRAGKNRNHGFEDWGKVFYYSENVNGNYAANPTLNSNPNLLRNTGYNQTDFLQKFFVPLSKDTDLKVNLQYSTSSDIQRFDRLTELTDLTDVSSLKFAEWYYGPQQRFLLSSQLDVHPHKNWLETGTITAAYQNIKESRIQRKFGSLDRSYREETVNVFSLNGDFSVPLANNNSRILSYGFEFAYNDVASNSFGKTLNIENGQINGFSNDFKVQSRYPDGGSNFLTSAVYIGYRQDLNRKSTLNSGIRFTNIQKNATWIDETFLTFDDKDISRNNSAVTATLGYVYKPNTNWQLNSVLSSGFRSPNIDDVGRVREKSGNVTIPNINVNPEFAYNAEFGLQKYFNNKKFRLGANFYYTLLDNYIQRDFVYNADGSIQQVEFDGEFGNAVNNQNKGTAYILGYTINYLGKISKTINTSGFVTYTKGRTYDTEEPMSSIPPLFGQFEVNYKKEKLALGAEFRFNSKKDIEDFNFTEGTDNHDLTPIVNANATSDEDIYFGSPSWMTFGLNGSYDVSTNFSVQARLDNIFDEHYIEFASGVSSPGRNLSVSFVANF

SEQ ID NO: 15392 - protein, 785 aa, Desulfuromonas acetoxidans DSM 684
MKNRFFISVVTSLILSNNVVNAKEISLQEAVDSIVKEYKVTYISKSNSLKDKKIDEKKINYKENALNSLNNILESNDLKAIEEDGVIYIIEKPKKTTNSKTTILEEISVNDKYLGSTTENSDSYTTGSMKTATKLDLSIRETPQSVMVISQQMLEDRKTDEFYTLIKKVTGVSVTEAFDGRATYYSRGFDLDYYLLDGLPVTQNWYTINNYNMDAYDRVEIVKGANGLMVGAGNPAVSINMVRKHANSKVFKGDIEASGGSWDMYKLKTDIQTPLNEDGSVRARLVASYKDKNSFIDKKSQENSLIYGIVDSDITDNTTISVGASYEENNKDGVMGGGASLPSFYSDGTKTNFSRSKSYMFDWSKWDTSITSYFTDVKHYFDNDILLNASYSHNEIHTKDRMDTNIQGSLNKDGSGLTAGWGKNPEKIKKDSIDIYASIPFELAKKEHEIIVGTQYNKENDKKYKPEFSGKYNITNYFTQNGSEFTSEPNTGSSILRQDADTEQKSIYLTGKFELVDDLKLIIGSRLTTWEYDSYSWDTNSRTKYDHDNIFTPFVGLVYDLDENHSIYTSYTDIFLPQGNVKDKSGNILDPKEGSNYEAGIKGEYFDKKLNAGLTLFRLEQDNVAESINGVFVDGSNGTEQAYKSMKGVTSKGIELEIGGEITDNWDISVGFTHFEAKDANKDKVNTTTPRNNINIFTKYTINDFSFGAGVNWKSKGYEKSDTREITQDAYAVVDLMASYKFNKNLSTQLNINNLFDKTYYIGYGTSSYNYGDPVNGILSLKYKF

SEQ ID NO: 15393 - protein, 803 aa, Desulfuromonas acetoxidans DSM 684
MRILLSLFLLLSFTSYSQVITVLDVDTREPIIGVAIFNNDKSKSALTDFDGKADVTAFAKAETLYFQEVAHKDAQYTKAQIAAFSNRIFLKQKDNQLTEIVLSASKFAQSRKNVPQKIVGLTSKDIIRANPQTAADLLETSGSVFVQKSQQGGGSPLIRGFSTNRLLITLDGVRFNTAIFRGGNVQNVISIDPFIINRTEVLLGPGSVIYGSDAVGGVMNFYTKQPKLSFSDSLTVTGAAVARVNTANNEKTGHFDITLGKRQWSFLTSASYSDYDNQRQGKHGPDDYLRSEYVQTIDGVDVAVTNDDPLVQVGSAFNSLNLMQKVRYTPNEKWDFNLGVIYAATSDYDRYDRLTRKRDGEFRSAEWFYGPQKWFMTNLQVNKEGNGQYYDRVIGTFTYQNSKESRNDRDFNATDFFETDESVDAISVGLDFVKKLETKRNKIFYGLEYIHNKVHSDGQVTDITTGDIANTASRYPDGSTWQSLAAYASAQIELSDKTHLQTGLRYNHILLAADFSDNNEFFAFPFQNADLSTGNLTGSFGVTHEVSKKVSVKANLGTAFRAPNIDDVGKIFDSEPGSVVVPNPDLKSEYAYNGELGVSLNFSNVLQFDVNGYYTLLENALVRRDFNLNGVTEIEYQGETSNVQAIQNASKAEVYGVGIGANANLTKHLKLTSQFNYTSGVEQEEDGSYVPFRHVAPLFGNGHLIWAKDKWTLDASVAYSGKFDFDELAPSQQSNSHLYALDGDGNPFSPSWYDLSIASRYVLSDSWSFTANLENITDQRYRTYSSGIAAAGRNLILAATYNF

SEQ ID NO: 15394 - protein, 932 aa, Desulfuromonas acetoxidans DSM 684
MMPPPAVPPQLPEVPAADLPRVRAPLSTYRRPQRTDFVTPTGGPFFAKQDKALNTIDLKMAHDLKLRGYRVKVAVVDEGVRSDHPLLNVEKKYGGDYMADGTRTYPDPKRQGRHGTSVALVLAGQDTDTYRGGVAPNADLYSANIGTRAGHVSDEAAFHAWNDLLGHGIKIFNNSFATEGPEGEQRVKEDRNEYHSAANKQNTYIGRLDRLVRDGALLIFAAGNGRPSGRAYSEVGSVGRTPRVEPHLQRGLIVVTAVDENGRLETWANRCGQAQQWCLAAPSTAYLPGLDKDNPDSIHVEQGTSLSAPLVTGAAVLVQDRFRWMDNDNLRTTLLTTAQDKGPYGVDPQYGWGVLDVGRAVQGPAQFAFGDFVARVTDTSTFGNDISGAGGLVVDGPGALVLAGSNTYAGRTTIKRGTLDVFGSVTSAVTVEPGGTLTGIGTVGTVTNQGTVVNKEAGLHVKGDYSQTAQGLLVTDIGSLLDVSGRASLAGRLHVDDIRPGYVGGDGKSVPVIKAGAVSGVFATLTRSPGLLLNARLDYRPQAVYLTMRRAERVHAAAQRGADDGRRASVLAVAERLDAAMRELDALPESQRDAAAPAAAIGRIQRVQSRKVLQDNLYSLAGATYANAAAVNTLEQNRWMDRLENHLAQAGGERVAAIAEYRHGQLRWRPDGLQGRQRGNGIMLGLAREVSAGLSLAAALTHSRTHWDESSGAPARDNAAMTTPGVLLGARRAWEDGWFVQGALGYSRYRNQATRHISLGDAGHTVGATARGHVWQADAGLGRQWTLAPGHTLAPRAGLQLTHLRQQGFSESGAQGLGLRAHALTRTVPTLWAQLQSRHAFMLGATPMTAQLQLGVWHDLRARRYAASGGFAGLAQDQGASGYWPVPRTRVQGALGLRAEFAPGLVLGLGYTGQLATHWVDHQLSASLTYRY

SEQ ID NO: 15395 - protein, 999 aa, Desulfuromonas acetoxidans DSM 684
MKTMMKRFIIGAMLILGLCSWVKAQKIDVRIRVVDEWNRPLQGVMMRIGGNDDESFLSDKDGMIECRADKGAELNFEKYNQLQRKLKVTGEVMTVKLDKDNRLFELGYDQRVTKENTTAAIDGVSADEMKLSGEINPLNTLYGLIPGLGVYHNGSLPYNSTPDIYVRGMASNQGNKVLVLVDGVEREIGSLNVDEIESVTVLKDAASLALYGNRGTDGVICVTTKRGGNNKMRTHVGYNFTVQTPFRIPGMADAVSYANAVNEALGYDGLAPRYTQADIQALQNGTSPLAIVDWKNQILRKTAFNHDLNLSFDGANERMRYYVFANYTSNRGFFNNTDLNDGYSTQVEMYALKLRTNLEANISPTTMARMNLMGRLMQYQQPTGGTSLANVYNTPVIAAPIYDRNGVWAKNQMFTNPLAVQAANGYGQVLQRTLFADLTIEQDLSMITPGLSAQVRVTYDNSADIADFRTKSYAYSIATPVRDAAGNISDLSYSRYGNDTEMSFASGLQAQVMRTYIWGKVNYERDFGKHHLDVAGIYSQGRRKYLGANGTNAFRDYMAHLSYNYDNRYLADVVCSYSGSLKMPVGDKYRVYPAVSVAWIASNEEFMHRFSVLDYLKLRASFGVTGNDSRLFYDMDKQFNGPGQEYIFVGTTSTGGLAQGGFPSKGIEPEKEYKANFGVEVGIWKGLSMQVDAFYNRRKNIRQYAGGVYSSVVGRDVGSLFTGEVKNYGGEITLGWQQQLDKFSYFIKGNFSYAKNEIVNINEEYHPYKYMYATGNSIGQLYGLMAEGLYQKEDFDAQGNLLPGLPVSTYESELRPGDVKYKDLNGDGKIDDYDHCHQQYSTLPEIYYGFSLGADYRNWGIKAHFQGVAHRSVSTMLASIYHPLYGNDKNVSEHYLENRWTDATPDARYPRLTTLSNNHNFQTSSLWMEKGDYLKLRVLELSYKLPARFAEKMRMSDCRLFLKGMNLFSIDHVGIMDPEQMDMEYPSSRSYLIGINVLF

SEQ ID NO: 15396 - protein, 1145 aa, Desulfuromonas acetoxidans DSM 684
MFASGIVELHRFKREAIRRSRYGAPPSHAIDDWRLSACRERDSPYFRRIVTRISGPVSIEVSFVMQRKVLVATVAAAPLLAMGFAASAETPVSNARTTPIATSTATGTAADDIRITADGSIKPTTAGAIVTIDSNHKVTNLGTLSTTGVNNGVGVLIIGGRTGALTNSATISLLEDYTASDSDSDGDLDGVFAQGANRFGVRLTNAGTFTGNIINEATGVISIEGNNSAGVLLEGPVVGNITNLGSISVTGDNAYGMRIAAPVTGKVTLGGQINVQGVNAVAQAIDANVSGALVLQGATSATGYRYTSRPSTTDALGKLDADDLQQGGPAVRIGGDVSGGLLLQGLNYSTKVNSDGTTTTTTISSSSSGTSSINVFGAAPALQIGSASQNVTLGAVGSGDNAYGLIAKGAISAAGVYNGVSATGVSIGAGGGRTTTLVGGLRNDGQITATSYEANATGVVLNSGATAASILNRGALTANAASFAGSGVTASARGLVIAAGASATSFGNSGSVSATRTGETGDAIAVLDQAGTLRTITNTGSIRATVAAPTFKADGTVASVTATGRTIALDLRANNLGVNFTQSGPADFTSTSTFPSTDTTTSATSATTTVAPSTIGDVLFGAGADTLNLWSGTLLGEMSFGAGQDRLSIDGGAIAVGKLYDTDGKLDLSIANGSLAIANSDTINVSSVNLGSKAKLLFSADPTAGTNTKLVVSGATTIASGAELGIRMANLVKQPTTFTVIQGSNISVGTIGNSLLAESPYLYVATSRTDANNVYIDVRRRTAAEIGFNRAESSAYDAVFSALGADSTLAATFLNQNSRDGFRDLYDQMLPDQGEGLFAALQTVNQQVSAATMFRPDPGDRYGPDSVWVQEINSLTRRDTDQTLGSDTQAFGFVGGYEAMGDAGGALGLTLAYVSIEEHDTVAKVGEQTTASFVQSGAYWRRSVGGWRFNAGGGLGYAFFQGDRRFIAPDSNGDGVADLVLKNSADWNGVTANAYAGMAYEQKFGRFFARPEGRFDYVWLREGKRAEKGGGDAFDLTVDKRTSSNLSGELGVVMGADFGKQVWWRPEVRVGYRQTLAGSVGDTVARFKGGNAFSLAAMDDKQGALTAGFALRAGTPMSYLALEGGVEAAKKQKRYNLRLSGRAMF

SEQ ID NO: 15397 - protein, 234 aa, Desulfuromonas acetoxidans DSM 684
MKLLVLTTTALLISGSAFAADAVYGDVPAAPVAEVAAESFDWTGLYLGAFGGVSTGDFKYEAGPTGGDPLGGIDISGGGFIGGAQVGYDWQIGNWVIGGVADIAATNHDADISADIDGFGSAEAESKLKYLGTVRARAGYSFDRTLVYGHGGFAYGETEQKIDLGGTELFNESQGRTGWTAGAGVEFAVTNRISVGTEYSYVDLGEERVFEDAGVFVDEDVAFHSVKALLNVRF

SEQ ID NO: 15398 - protein, 673 aa, Desulfuromonas acetoxidans DSM 684
MNVKYGNISKLSLAIGLVLAANSVVAQDNTETMVVFGEQQPTYKPADNQSALKVDMSLLEVPQMVSVVGQQEIQDKGALTLGDALKGVPGIASPSGEGARDHFTIRGFDALYDVYRNGLRDGGSNQAFRSMANVERIEVIKGSAGALYGRGSAGGLINLVTKKADGRSVADVKLQAGSFDRTGITADLGGRLTDNLNGRINLEYKQGDSHVDNADYNTLFIAPTFRLELSDNTQVDLDLEFMDQEVSPVRGIPSVDGQPIDVDNGTSYASSSDFQENTSFNGALSIKHYFNDNTQWTNKIHYSRVEMEQAGTRNVKVVGDVLERKVVAFAFDPQEDSGLQSELNIELGSHQLLIGADANRMKRVSTSGGTTAPDAPLYASTDFSYDRPELALNRTNQVDSTALYFQDVLSLGDSWKVLVSARYDWIKSTQDKPGAESFVIKDDKLSPRAGLVFQPTENSAIYAAVGRSYALPWGGIYAAPTKGALLKTDLAELGFKLDLFDNRLALNSAIFNIERENPETNDQGVVTAVNNDRHRGVELELKGELAADWLISSGYTYLDAENKDTGYKANDVPEHTFSFWNTYQVSNGFKVGGGANYIGERFVGSKEAVKLDAYTTLDLMANYQWDAHMLQLNANNITDEKYYSGATGNSSALTQINQGAPANFLLTYSYSFK

SEQ ID NO: 15399 - protein, 1012 aa, Desulfuromonas acetoxidans DSM 684
MKKLWLASTAIISASLFTSAAWSAPCASNSNGTFTSNNATNNGGCSIASVAATIGDNSIWNTGFLLYSQNINRTMTIENDLTTTLKGSTGISVYGTAPTAFSTFDASGRTINLTIENLTANASLPIGDNIAKAGVGVSHGGTMTIGSLNLTMLNLPNGNDGSTFGLGQRFEHYGIVVGSTVNAAETLAFNGYQSKAIFDNMNIKMQSTNNGWNVYPLLAGIRVIQGAGGNSGNGSAGYVEVKNDLAIDINATSNDAIGIYISGSEHNGVVPEVHLNNSNIKIKSTSSRANAIRLGKTASIGTGEGRLFSTGHMEIDTLQAANDAAIDIIWQGAVLDANADTSSTTISAGREAITISGNASQATAQTVTSFNDLVATTASTTANLINVANNQNDYRLNIRGVNSDLKAASAGWLLNVNGTVQSPSAVTFNVSDGKITGLVNKAAPSTLEITVQDGAQWIMQEKGGATPSTTATFTQLNIANAAILDATAGAGALSDFVLQGNVLAETAGEIRLYDGTAGDRLTINGSYTGNGGLITFDTALGDDSSTTDMLVITGDTAGTTNVAVTNAGGEGAQTVEGIKIIEVGGASNGTFSLQGDYVHEGENAVVAGAYAYKLYQGGVASPADGDWYLRSQIKPVDPVDPVDPVDPVDPVDPTNPVDPTDPVTLPSEPLYQAGVPTYESYAQSLLGLNGVPTLQQRVGNRFWASNGNRVIAQGADPVGTPYAAPEEAGVAIEGNGVWGRIEGAHNSIEPRFSTSSTEYDQNIFKLQAGLDGMLAEIESGKLIGGVTVHYAHGKTKTKSVHGDGEISTDGYGFGGTLTWYGENGFYLDGQAQLTWYRSDLNSTLANSTLVDGNDGFGYALSIEGGKRIAIDQAWSLTPQAQLFYSSVDFDDFADTFGSQVSLDRGDSLQGRLGLTLDHESSWQNANGKLDRAHVYGIANLYYEFLEGTKVDVAGTSFASRNDRLWGGLGIGGSYNWNDDKYSIYGEGLVNTSLNNFGDSYSLKGQAGFRVKW

SEQ ID NO: 15400 - protein, 661 aa, Desulfuromonas acetoxidans DSM 684
MRKLFVPLLLFSALEANEKNGFFIEAGFETGLLEGAQTQEKRRTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFNSLKEAFDKIDPYTFFFPKFEATSTSVSDANTQRVFETLNKIKTNLIMKYSNENPNNFNTCPYNNNGNTKNDCWQPFTPQTAEEFTNLMLNMIAVLDSQSWGDAILNAPFEFTNSSTDCDNDPSKCVNPGINGRVDSKVDQQYVLNKQGIVNNFRKKIEIDAVVLKNSGVVGLANGYGNDGEYGTLGVEAYALEPQKLFSNNLKTINLADLRTILHEFSHTKGYGHNGNMTYQRVPTGQTENGKPKDSDGLPYNVCSRFNGSGQPAFPSNYPNSIYHNCADVPAGFLGVTAAVWQQLINQNALPINYANLGSQTNYNLNASLNTQDLANSMLSTIQKTFVTSSVTDHYFSSASQSFRSPILGVNAKIGYQNYFNDFIGLAYYGIVKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 15401 - protein, 358 aa, Desulfuromonas acetoxidans DSM 684
MEKIVIVLGLASLGLSHGAHAQSSVSVSGVLDAGLRNVSNSGLPALTTLVSGSNATSRLAVQGTEDIGGGLSAGFHLEHGLNVANGTATTATQFWDRRATVSLADSRFGEWRLGRDFIPTYTNWSRYDPFGHVGAASAGNLVSTTPVGPLRNSFGTNPNTTVRANSEVQWLLPKNLGGVEGSVMLTKAGDTSAASGANNVKGFRLGWSGGPLSVGLAHTRTRNDLTVAGALTDSSVGGIYNFGVVRLSAVVRHIKQADAKQTNQLLGAWVPVGAGEIRLSVQRADLSGRVGAAVVDANDAVQVGLGYVRSLSKRTALYTTWARIANSGAGTRTISGGTSGMAGGGTSKAIELGLRHNF

SEQ ID NO: 15402 - protein, 428 aa, Desulfuromonas acetoxidans DSM 684
MRKMSRLNKTIIIGTTILLPQLAYSAGFQLNAQSNAGLGRAFAGDAVIADNASSMARNPATMALFKEAALSAGFISITSMVEVKDAVYTRDLYSQGALVDSSSQSANYDDAGDNAIAPNIHFIMPINDKFAWGINAYSNFGTKTEYSEDYIAGEYGGMSEVKSYNLGLSGSYRMSEHFSIGAGLDIIASTGKLKRSLQPTDTNLLTVDAKGWGLGFNLGAVYELDDNNRFGLSYRYSPEMETEGDVDYAGYLGESGPIDDTVVIPLPSMAEFSGFHHLENSNIALHYSIQWIGWSVFENLDAETSGTLNRYEWQDGWHYAIGATYYLNSAWTLRAGYLYDTSAQDKLTSISVPDSNRQFFSTGFTYQLTPNSDLDFGFTYVLGEDVSVVESKPMIPIDIASGTYLATNLTATSHANAMMVGLQYNRTF

SEQ ID NO: 15403 - protein, 685 aa, Desulfuromonas acetoxidans DSM 684
MKRLSPENTATPFHPSLFMQRSLLSLAIMLAVSHQALADNVMTLPDMQVTAGKRVQSQDQTDLALSVASQADLERANVYASGDLERVFPELLMRNTGASVFPSLSLRGVSSSDPYNAPVGIYVDGVPQYLGTFNQQLLNIEHIELLKGPQGTLYGRNAHAGALNILTRQPDNTPTATLQSRFSNLHQQVSATGSTPLVDDKLFIQGTVYHDDTDGELTRSEHHGDSDNGGGNVGLTFKPNEDFSLKLAYARDRLTSYNEQYLADATYEKRRASVPLLESVYVRRVETSSATLDWNLSDALKLTSITSLQNYRHERLYGDLGFHWPETQRTVSQELRLSTQGDDRAWDAVGGLYWQKSRSHSERETDSSAPLFGVYGVADSRIDSSEKAVFGEFTWHLAPRWDLTLGARHSVEKAETDYTQVDAAFTPGFVYSGNDTFTSTTPKIALGFQATPDMRLYASVSKGYKAGGYNRIGAITPGAVAYAPEKSLNTEIGVKSSLFDQRLWLNAALYRIDIDDVQQFIGAAGTGTQSLSNIGKARSEGAELSMDWHADEATLIRLAGTVNRNRMLDSERQGNSLTYTPGRTLRASAEHSFYFDGLLGEVRPSVGISYTGKHYFDVDNEVSQGGYSLVDARLAWLPTPDLEVALYGNNLGDKDYRTYSYLSGGAQFSQPGQGRELGLSTKISF

SEQ ID NO: 15404 - protein, 194 aa, Desulfuromonas acetoxidans DSM 684
MSKKLGFALSGLMLAMVAGTASADMDGGQLNISGLVVDNTCETRVDGGNKDGLILLQTATVGEIDAGVLNDTVGAKAKPFSITVDCSKANPNPGSTAKMTFGSVFFGNSKGTLNNDMSINNPSDGVNIALHNIDGSTIKQVQINNPGDVYTKALDATTKSAVYDFKASYVRAVADQTATAGYVKTNTAYTITYQ

SEQ ID NO: 15405 - protein, 961 aa, Desulfuromonas acetoxidans DSM 684
MKKWFLATFLITVSSVFGQGKITGFVYDENGPLPGASILIEGDTNAISASFDGSFTINSASKNGKIEISFLGYKTKKVTYSFAQGEKMNLGNIILSNDSNLLGEVVIKSTVIDLAKDRKTPVAVSTIKGAEIREKLGSQEFPEILANTPSVYVTKAGGGFGDSRINIRGFDQKNIAVMVNGVPVNDMESGAVYWSNWSGLSDVTSALQVQRGLGSSKLAISSVGGTINVITRTADMKEGGTVSAMLGNNDYLKTLASYSTGKMKNGLSASVLFCNTQGSGYVNGTKFSEQNYFIGLGYEFNEKHNIQFTFTGAPQWHNQRSTSPTIAKFIKYGKNGEPNIHYNSDYGYLNGEEYSFKTNYYHKPVASFNYDFKINDKTKLSTILYGSWGRGGGSNGAGAIRGNTFNADNLRNSDGTINVNLIQAWNSGSPVSITPSTGGLPITTPRTQTGGAYQNDLTTTNNGANGISKISSINSHDWYGGVINLSRKLTDKLTLDFGIDARTYKGFHYTNLNDLLGATNYKDVANINNTNGLGVTQPRLLSEVYDTKSNWNPFFNSNNQERINFNNDGIVKWLGAFTQLEYSTEKITAFIQGAVSQQGFKRVDYFKYKTSDPLSATANEKILGGNVKGGVNYNLNEKMNVFVNAGYYSKQPFFNAVYPNNASLVNGNLVNEKIIGFEAGYGFKSSKFNANLNVYHTTWKDRYQRQNDTTDPLNVGGYYDFSGITEVHSGAELEMNAKPLAKLGLNAMVSVGNWVYKGNSLSNRYDNANNSIGGGTPTTLYLDGLKVGDAAQMTASIGANYEVAKGLKVDANYRLSDKLYAGISPNNFKNQINKGSLELPNYGLMDAGITYKINRIKDSKDSFTLRVNVNNVLDKIYISESRTNQFTATEAEFNSPTTGSDGLVDPTKTVTATNALKGTGNGQYTSYQDYQNRGVYNGVDVRNQVYFGFGRTWNFGISYNF

SEQ ID NO: 15406 - protein, 190 aa, Desulfuromonas acetoxidans DSM 684
MRSKVMRSPSILAGLALVTFGSSAIAGSSAAAQSVTDNYDAYLEAGYSWAEINGRTNDAEFGGVVARLGLNFGQFLALEGESVLGLDDEEDVIAGREVVVSQEYSLAGFLRISYPISERLSVHARLGGATVALKAEAVGFEETENEEGFAYGIGASVAVLDPFYLRADYVRYDIEDSDTDQYTLTLGAKL

SEQ ID NO: 15407 - protein, 388 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHK

SEQ ID NO: 15408 - protein, 282 aa, Anaplasma marginale
MNYRELFTGGLSAAFVCACSLLVSGAVVASPMSHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 15409 - protein, 282 aa, Anaplasma marginale
MNYRELFTGGLSAAFVCGGTLLVSRAVVASPMSHEVASEGGVMGGSFYVGAAYSPAFPSVTSFDMRESSKETSYVRGYDKSIATIDVSVPANFSKSGYTFAFSKNLITSFFGAVGYSLGGARVELEASYKRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 15410 - protein, 282 aa, Anaplasma marginale
MNYRELFTGGLSAASLCACSLLVSGAVVASPMSHEVSSEGGVMGGSFYVGAAYSPAFPSVTSFDMRESSKETSYVRGYGKSIATIDVSVPANFSKSGYIFAFSKNLITSFDGAVGYSLGGARVDLEARHRRVATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 15411 - protein, 282 aa, Anaplasma marginale
MNYRELFPGGLSAATVCACSLLVSGAVVASPMSHEVASEGGVMGGSFYVGAAYSPAFPSVTSFDMRESSKETSYVRGYGKSIATIDVSVPANFSKSGYNFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 15412 - protein, 757 aa, Ralstonia metallidurans
MKRTLFVGILLGSASCGTLALAQDARELPTVTVTQEKPKATTQRQNTTRSARGPRRATRSARQTAPQEPSSQQTAASQPYAGDDSGPSGFTPKSAEVGPLKRRALLDTPLAINVLDRTFIENRGATSLPDLLKYIPSAQMEARGGPDVGRPQTRGMQGNVVSNSHLDGMNIVATTSQPIEMIERLEVISGLTGAFYGPASPAGMFNFIQKRPTDTFFNRITGSWMNDSTLMAHGDFGGHVGAAKNFGYRVNLLKEKGDGYVKGSTLDRDLVSGAFDLHLSDKTVIELNASHYNFKKYGFPAGFGYGNTIRLPDAPDPTRPGYGQVFGGSELETTTYSGRIKHEFNENWSFTGGMLHQTADRMFQSVTNTMLDNAGNYRTSMSPSTAAGRFEVLSNTANLNGTVYTGGIKHELVIGTTGYTWDIYSAVNSSSTINFGNSNIANPVQWPAPVGLVQDGLRYKGSSNSQQVAIFGDTITFNPYWSAMLVGSYNWIETKNYTATGASRPGYAAEGFSPTVAVMFKPVSNITTYVAYANSLEQGGSAPTGAANEGTTLAPYRSKQIEAGVKANFGKVNATFAAFQLERPFAFTDTDNVYKVQGMQENKGLEFGLYGEVFRNFNVYGGLTLLDPRLKDTGVPATSNTKVVGVPDTQANILMEYLVERFPGLVFSANVHYTGERAGNNINSFMVKGFTTIDLGVRYTMVLPDKNTATFRVLANNITNERYWLSIFPGSINGVVGSNTAFLGAPREVRVSASVTF

SEQ ID NO: 15413 - protein, 607 aa, Ralstonia metallidurans
MLCQFTWAQSDSIKLKEVVVSDSNLKKYSTSQSVQVLNDSILDRNQPSLTSLLNFNTVIYFKENGLGMTSAPSFRGTTGAQTAVIWNGININSQFLGQADFNTIGTRDFNSITVKAGGGSVLYGSSAIGGSIHLNNDLRFKNEFSNHVFFSAGSYNTYSANYRTIVSSDKYSLQVSISRNSSDNDFKYPGNSDERNINGQYYNTSMNTTFGYKINANNTLKAYSQFYDSERHFSLTSPNASKTKYNDFNTRNLLEWESQLGRFTSKLRAAHIGESYKYFPSITSNNFTYGKVETSIIKYDLAFDVNDKIKLNSIVDYSRNKGYGSSIDNVKREVGTASLLLHHLLTEKWDYNASIRQEITDNYGNPFLFSFGTKYDFTSFYRLKFNASKNFRMPTYNDLFWERSGNPNLKPETSYQAEIGNEFFRKNFTLSITAYYNSIKDLLRWVPGEGGGDVWAPENTDKVRAYGAEVLVEWKPKFGQNNFTINGTYAYTVSESQQLIKNELIYKQLIYVPYHKLTGSVAYNWKKLSSYFQYLYNGEVYTTPFNNRASKIKDYNVGNIGVDYDFGAKNSYKIGFQVLNLWNENYQPVTSRQMPGRNYTIYINLNF

SEQ ID NO: 15414 - protein, 642 aa, Ralstonia metallidurans
MFTTVILGAIPGWGAEFSANFKDTDIQEFINTVSKNLHKTVIINPDVQGTITVRSYDMLNEEQYYQFFLSVLDVYGFAVVDMHNGILKVVRSKDAKTSAVPVASDVSPGTGDEVVTRVVPVSNVAARDLAPLLRQLNDNAGAGSVVHYEPSNVLLMTGRAAVMKRLMEIVERVDKVGNRSVATVPLTYASATDVARLVTELTKETDKTAIPAWMTAKLVADERTNSVLVSGEPISQQRIISIIKQLDRQEDVQGNTKVIYLKYAKAKDLVEVLTGISSSIENDSKKSPSTEALRKGVTIKSHEQTNALILTGAPDVIRDLENVISQLDIRRPQVLVEAIIAEIQDADGLNLGIQWVNKHAGVAQFTSTGLPITTMVQTRQNEILDSDQSNALSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFRAKSEQTAKRNLMLFIRPTIIRERDGFRHASAEKYQSFNQEQVQSRGKETTALTLNEEQLRLSPDQDDTAFRKVKAAIAAFYAQEM

SEQ ID NO: 15415 - protein, 804 aa, Ralstonia metallidurans
MSHQKARFSTRAAVIALAIGGCAAQAQTAPADEAPQASAGGGIEDIVVTARRQSESLQKTPISITALDSRALERNNIQAVDKIGQIAPNLVISQQSSALSAASINIRGIGQTDPSLGLDTAVGIYLDGVYVARSAGSIFDLVDIERIEVLRGPQGTLFGRNTTGGAIQIVSKKPADSFGVTAKGGYGSRDNMFGRLRVDTGEFGDSGISASGSYYHRQRDGYFNNLLTPSSKDPGSLNVDAFSVALDGDFGPFKASYGFDYDDRVGAPGFFQTVALSPAAQAYYSRSPQYGGPALQFVGADTRLKSGLQQPGGPGNTYTSHSRSQGHNLTLSYEVSPALTLKSITGYRKLLLENVLGLSGQGDLKGLVLDFTSPTLTSVQSVTPYNGYNSPQKQKQWSQELQLLGKAGDFSYVLGGYYFREKVSERNNQNLTLVLAPAALPFLGFPGAVADALTAQGIDLIGFNTSPVAAYSQTSKSYAAFGQVSWKPQALDEKLEVTGGIRYTEDRKNIFLQNSNGGVSTIVGPARGSTKNTNTSFLGSVSYQIDPDALVYAKVSTGYKSGGFNPRADTLNSFAPEKLVSYEAGAKLDLLDRHLRINAAAFLSKYDDLQVPQFAAGSGGASTLLVNAGKAEFKGFELEVTAIPARGLTLSGSLGYTDPKYKRFLFLNPNTNTISDIAATARFPNVAKFNSNLAVDYTFEPMDVGTLSARVSYAYRSHVYFYPNDAVNPYQHQVDSPATNTVDARIALSDIALGARAKGEIALVGENLLNEDQVLYGIDFGSLGFGGKFYAEPRRVSVEFKISF

SEQ ID NO: 15416 - protein, 351 aa, Ralstonia metallidurans
MKKSALMLLIILLPLAVKAQTPYRNEDGKKIDKEELETKDYLPEIHGTIRTKFEYQTEMAASRFEVRNARISITGNVLPIVAYKAEIDLSDEGQIKMLDAYARLFPVKDLTVTAGQMRVPFTIDAHRSPHQQYFANRSFIAKQVGNVRDVGVTLGYKLGTEIPVTLEGGLYNGSGLTNQKEWHKEVNYSAKAQFLFAQKLNLALSIQSIQPQDVRINSYDIGAFYESGRFHIEGEYLYKTYADNAYDNVHAVNSFINYDLPLRKVFNKMSFLVRYDMMTSQSDGKAIDEETGALVTTDYKRHRVTGGVTFSLSKAFRTDLRLNFEKYFYAKNSITKESEQDKIVLELMVRF

SEQ ID NO: 15417 - protein, 314 aa, Ralstonia metallidurans
MKKILFASTALVATAGVAAAELTIGGSARFGLAYDESQTEETRIEQRMRVNITGIAETDAGVKLEARFRLEANEDSHANDISGRGPGAAGFAVSYGGLRVDVGNVSNVLDSGDQVDYYGYGVGFTSFLEHNANFNGPATGFGAGSQDATTIKARYNVGDFSASLSYKETRAQAAVANAPGVLGSTAVAADEEWQLGLGYTLANGMAIGAVYSDTDSSGDYWVIGLNGTAGAVGYSVIVGDGDNQADASFGASINYEVSSATSIRAVVSDGGAANADTSYGLGFRHGLGGGVTLAGGVGSKNDNTLADLGVSFSF

SEQ ID NO: 15418 - protein, 345 aa, Ralstonia metallidurans
MKIKMISLILLTGMTTSSYAMSIYNKDGNTLDIYGRVEGKIASGENSYAGSETRTNLGGRLGIYLTRDLDFIPETKIVGRLEWQVRTEKNDSNTGDSDLKARYSYIGLSNKTWGELIVGRTKNPLYQVMKMTDKYKNFTPNIYSYGITTIDDSYQFNRQDGTVQWNAKFAGNEIQLAWVAGNGSSNEALDYGAMASYRNTLRLGDFRLTPAIAASRYKRQDGVKTTDGRNQNDQIMAGLQLSYKNVEAAVTALRTSIARDNKSDNDFKGMDSLLSWKYGKFKFLTGYSFLDEKDKSVYEKEDWRVETQITLADDTWLSFTYDKAFANKNQKVNDDALIVGLRYDF

SEQ ID NO: 15419 - protein, 196 aa, Ralstonia metallidurans
MQKIFFSFLIFWSFVFALDSKRAKDTAATPTQTTTGAIKRDFWKNGLISIEADFVQITHQGSQKLIYTGKLYAKNPSLAKWIYETPLKKTIYLNKKEAIIYEPMLEQATFTHLTKQVDFFAILHKATLGQDGKYHAKVGDAQYVLSFAKNLPHKITFIDELQNKIEIILKNLKVNPTLSDGIFVFTPPNNIDIIEQ

SEQ ID NO: 15420 - protein, 766 aa, Ralstonia metallidurans
MRLIYIFVLMLLPILAFSQEEAFYIEIKDQALHDALEEIESTYSILFSYKDDYVKDKRISIEGKKRTLIELLNALKKSTKLYFNVVDERYVIVSQSNSIETITEALDKVIIRGYIAKGIEKNSDGTFKIYPSRLGILPGLIEPDVLESIQLLPGVLSPNETASSFFVRGGASDQNRLIWDGINLYHKGHLFGMMSPLNPNVTSEIKFINKGTHARYGERLSSITDIVSGRAISNQLKAEMGFNGVNGDAILELPLIKDKLNLQASLRRSYTDVLETFTFKQLANKVFESTKISQNKRDNNDFSFLDYNLKLNYKPNNKNSFYASLIAIDNKLDYRSRELGNNRDFNDKLQIKNDGYGLGWNFIWNKKLNQNTQAFFSDYKLNYNFITSEDNEQVSNFEKRNTIFDSGISTELNYNASTRNSYTFGYQYTLKDVAYAFVNTTDLRFILDTEQKIVQSHSVYGNLDYKNSKLFDVSLGLRSTYFHELDAVRLEPRLLVFKELNSRFKLQASAEIKNQIISEIDETVLSDLSLENRVWRLANNDDFPILNSKHISTGFVYTKNDFSFDTDIYYKKLRNITALSLGFLNPENSGFNIGKQNILGVDVFMKKRFNGFNSWVSYSFNRARSQFNNLNENKSFKSKSNVTHAVSTALSYKLDGFQVALGWKWQTGKPYTIADTSNDNIEFNKGVNTGELPIYHRLDLSSTYTFKMSKLNNLRGKIGLSIRNIYNRKNLISREYRGNNSLDDPIELIERFSIGITPNFMFRLYW

SEQ ID NO: 15421 - protein, 1036 aa, Ralstonia metallidurans
MNKRKSGLITATHTGPGYPLKALSCVPYGALLCCLASLGTAQAAPYVEAGKLGDAASWRSNEFKADCGLGAVHADAAYAAGYTGKGVKVGIFDQPVYAQHPEFDSPGKVVTIVTEGNRQYTDPYIPVKAGDAFRYDGTPSKDSNGKLGNHGTHVGGIAAGNRDGGPMHGVAFNAQILSAENGDPGPEDGIILGNDGAVYKAGWDGLVANGARIINNSWGIGIGDQYAKGGRDPAFPNFTVNEAQAQFNVIRPILGTLAGGAYQGAIDAARSGVLTIFAAGNDYNRNNPDAMSGLAYFVPDIAPNWLSVAALQQNPDTASADPYVISTFSSRCGYAASFCVSAPGTKIFSSIINGTDLSNLTTDWANKNGTSMAAPHVAGAAAVLMERFPYMNGDQVSTVLKTTATELRAPGIDALYGWGMINLGKAGNGPGMFITGADIPAEFRIDGAYGNGQFVANLPGIGAVVDAGKPTQRLCTDVHCGLDVWSNNISGHGGLTKQGIGALVLTGNNTYSGPTLVNQGLLAINGSVTSDVTVSQNGVVGGSGRIGSLSAKSGGTVAPGNSIGTLNVAGNVTFDAGSTYAVELSPNSSDRIVPGGTATLMRTTVTLLLENSRTLLTNAQAESLIGRQYNILQAAGGVTGDFGAVLPNYLFIGGTLNYAANGVQLDVARNANSFASVAVTPNQRAVAAAADQLGAGNAVYESLLLAPTAASAQGAFQQLSGEIYPALQSALVNDSRYVREAVGERLRNGEMGATSETLDSRGNVWVKALGAWGKTDSRSDTAGYTTSLGGMLVGVDGALDEATRIGLVAGYSDTSLNMGNDTHSRASVDSYHFGAYAGHEIGALRLSGGATYSWHRADVKRDLQYGDVAGKQKVKVDASSTQVFGEAAYRVNLQPLALEPFANLAYVHLDTDGFTEKGDAAALKGHDDSRDVVLSTLGMRALKTFNVNDHQQLEVSGTLGWQHNLSSTDSEQHLAFASGSPSFAVESAPMVRDAALVGARVSLALSKEARVNFDYNGLLASKDKVHGVGVSLDWAF

SEQ ID NO: 15422 - protein, 389 aa, Ralstonia metallidurans
MAGGFYLHRDTDLNGEDRSSSAFLTTRRLTGLPGATFAKFGADTRTYELAGFGELTYHLTDKLSATGGLRYGKYGGTVDTYAGFNTAYFTYALLGFSGPLALTPSPASTTKYPSAEKASWKASLTYKPSRDLTTYATVSTGYRTPVYNGRAGSVSTVNPSDLVIPAGAGSDNLINYEVGLKGRWLDGKLNANLAAYYIDWKNIQVQANRQSDSIQFATNVGRAASKGLEAEVTLAPVRGLVLGLNGSLNDAKVTELSQQEAVISGAVDGARLASPHVQGALFGTYSYAVGDGATGFTSVQIQHVGSFPNGFPNKPGTPGTLSPLYGHTDSYTYVNLQTGLTFGKLSTTLYAENLGNSRATVYIHPEAFVYSRNAIVRPRTFGVRVGYDF

SEQ ID NO: 15423 - protein, 327 aa, Ralstonia metallidurans
MEPKMKKSLLALVLPSLFASTVGAVEVYKDDGQSVDLYGRAYAGHDFGSETSAGEVPTSEYGNDAYIRLGAKLKSDISDSLSAFARYELQFDLRDSESDPKSKTRLAYVGLDSDVGAFSFGRQYNALTIASDLTDVAYTNAYGGNLGNTSRDNSTLKYSNKFSGLQLDASYRLDDNQSDVESDAEYSLAAAYKLDFGLTLAAGFSAKSPTDDYDASLFLVGASYKAGPVNIAATFAQGSEFEGKGEDHSAYELAVEYKITKQLRAQVLYNFQELEDTVSSTKTDSVDDLVFGVRYDFNKSLRTIAEYRINGVEGADNDFHLAARYSF

SEQ ID NO: 15424 - protein, 921 aa, Ralstonia metallidurans
MNVQRMDKIMKNNKFKLSKVAIALLPLCYVTHGFAAEDETKKDTTPVAATAEEKVEVIEVRGFASTLKQSLFSKRTSSQTVETISTDDLGNMPDVTITDALARLPGVAADRDRGNPSRISIRGMGPRLNMATMNGREIVSGEPSRDVRYEQFPAELINAVQVYKSPTVSNIEGGISGLVNMDFVSPLAQSERKVTLSANGMYYDLADELPDGQTTGSKLSFSMVDKITDDLGYAFGIAYQDQPSVQRGTKSWNYNNGADRGDINGNGIQESAPWGGQSGTKIGNNKRLGTMGILEWQASDKLKLKYDLFYSKFKIEEHEDQMYFNNLGNYQSGQNWNYNHSAAQPDIITKADGSEQLVGGGLAYASHEVHNATWFQENQLLSTGLNAVWEGDVWRIKADVGFSKAQIDSVWVDIISSYNGPSYDLGWSVADGNSFSAEVLDNPAEGLSAIDIANPDYYTLGAMKWVETTPGVWEEQNIGMIGDNDRDLSDKMVNTRLDFERYVDWGVFDQLSFGVRYSDRDKQNRVVDWQKAVIAGNGLSNYGSSYTLGGDYKVPNLYALKDWDNVASVAFGGRGTADYSLQNNADKLASWGLTEKNSAAYAMLNINSEWGDMPYSGNIGIRVVNTRSTSEGYEQLLDGSLAPASVDHEYTEVLPSLNLLFNVTDDSQIRFGLARTMSRPPLIEMRTGFSIDTTVTPNTASGGNPELDPYIANQVDLGYEYYFSDSGAMIVSFFYKDMQSHIGIATSTKTLEGVDYEYSGPINGDGGAIKGFEVLYQQSFDFLPAPFDGLGVYANYSYTDSAVEEFTPQDNPYTLAGLSKNVGNVTLWYYKEGFEARVGYDYRSEYTGINSWDPSQISLYDAQGTVDASISYQFTDNFKVMLQGQNLTNEASTSYWDNDKTRLAENVEWGRRYVLGFTLAM

SEQ ID NO: 15425 - protein, 1071 aa, Ralstonia metallidurans
MRKPFMLISVLPITVHISHDTDTGSNRIGGIPEKYAFKNKVLRSICFVLFLLSIGLNSAFAQVRNAAGLVVDENGQPLIGVQIKLEGTTTGVITDVDGNFSINAQKGDILLFSYVGYEPQRITYKGEKILAIKMLPNTELLDEVVVIGYGKQKKNSVVSSINAIGPKELAVSSNRNLTNSLAGQVPGLIAVQRSGEPGYDNSEFWIRGVSSFKGGTNPLVLVDGVPRNMQDIEPDEIESFTLLKDAAATAVYGAEGANGVILITSKRGNSQKPKISLRAESTLLTPTRLPKFMNSVETLDLYNEALNNEGTASIRTAEEIAMYGPGADRDLYPDTDWLKEMLREHTYNMRYTLNVRGGSERARYFVSGAFYQENGIFKEGKKNEYDNNIGLKRYNLRSNIDFDATKTTLVKVDISGQYLQTNYPGTSTNTIFNSMCRTPSYLMPAEYSDGTIAGHPRPSGNRVNPYNLLMNSGYAKEWRTSIQSKLEVDQKLDFITKGLNWKGLISFDADMKYIAKRTKTPTQYLATGRDENGGLQFKKVVEGSDVLTEKLENSSNKKIYFETSFNYNRTFAQKHDVTAMVLYMQKETQYHNNALPYRKQGLVGRATYGYDGRYFIEGNFGYTGSETFAKGYRFGFFPAMGLAWYVSNEPFYPEVLKKVVNKLKFRFSIGRTGNDDTGGDRFLYRGTMKQDNGGYDLGFSDTGGMGGIGNGITEARFEAPYLSWEIEEKKNYGIDLGLFDNRIDLQVDYFNNKRKSILLQRNTVSNVTGFQQMPWQNFGIVKNHGVDASLTLNQKIGQVNLSARGNFTFARNEIIEYDQVPQVYPWLEKRGTRLNSNKLYIAEGLYTYDDFIINGEGLNRTYELKPGVVSGLSSGVRPGDIKYKDLNGDGKIDSNDQKEDVGNPTVPEVVYGFGFNAEWKGFYAGIFFQGAGNTSTVLGTGADATFFPFQWGVEESAVRSVVADRWTEQNPSQNVMFPRMHSNNFQNNTVASTWWLRDASFLRLKNIELGYNFDKKLLKKLNIEALRFYVQGNNLCVWDHIKMWDPEQGNSNGGFPYPLNRTFTFGLDFTF

SEQ ID NO: 15426 - protein, 1097 aa, Ralstonia metallidurans
MQRKVLVATVATAPLLAMAFGAYAETVVNTARTTPIATATAAGAAPGTPDDVKIDAAGSIKLTTAGPLVTLNSNNKVTNAGTLATVGVDDSTGILILGGNTGSVTNSLAISLTEDYTPTDDDKTAAGVAAPDGDLDGPFAKGTHRYGIRLTGPGVFTGNITQDSAGSIVIEGNNSAGISLETGLVGNLTTNGAISVTGDNSYGVHLTGPVTGKVTQGGSVSVLGDKAVGVALDADISGAFALQGSVAATGYRYITRPTETAVGKLDTDDLLQGGPGVRVAGDVTGGVLLNGPTSSTVIDGTTTTTTTVSSSTTGTGSISVYGGAPALLIGSDSRAITIGAVGAADNAYALIAKGSIAATGVYDKIAAIGVQIGGQTGQTTTLAGGARLDSSITVSSREANATGVNFTAGAVAPSLWNRGSISAVSASYAGSLLTGDARAVVINAGANVVNLNNSGAIAATRSGETGDAVGILDSSGTLSTLINSGSITAQVVAPTVKTDGTTTTTTAKATGKAIAVDLSASTSGVTFTQTAPTSTAATSTYPSADTVTTASATSTTSTPTIIGEVRFGSGADTFNIRAGNVFGDVSFGAGADALNISGGGVLLGALSDSDGLLAIDIGKGSLGLTNTGNINATSLNIGAEGKLVFTADPTANNGAGANTHLVISGAANIATGAQIGLRLTGLLTAPTTYTVITAGSLTAGTINQDLLGGTPYLYVASSRTDANNVYLDVTRRTAAQIGMNKAQSSAYDATFAALSKDKDIATAFLGQSTKDGFLGLYDQMMPDQGEGFFAALQNANQAISSATAYRPDPGDRYGPDSLWIQEINTLVRRDTGDTMGSDTQAFGFVGGYEAMGDAGGALGLTLAYVSVEEHDIAAKVGEQTTGNFVQLGGYWRRAIGGWRLNAGGGGGFGWYDGDRTFNSGDINGDGTADVQRHNTAKWNGYTFNAFAGTAYEAKFGRYFARPEGRLDYLYLSEGERKEKGGGDGFDHIVHKRKSSSLTGDVGVAFGADYGRDLWWRPEVRVGYRQTLAGDIGDTTFGFTNGGAPVTLAAMNDKNGAVTLGFALRAGTPMSYLALEANAEAAKKQKRYNLKLTGRAMF

SEQ ID NO: 15427 - protein, 276 aa, Ralstonia metallidurans
MKKALCTALGVAALTPLAAHAQSAGSNVVTLGWFHVMPQQSSTPLTTNVAPTPINTPLRLPSSFTSAGTGLSTSGADTVGLTVSHFLTDHIAVTSVAGVPPIFKVSGHGTITPPGPAGALGTQNIGLGPVNPIVKSVRQWSPAVVFQYYFAQANAKFRPFVGIGVSYNWFSDLQLNTNFIKQTQNNLGAILAAGAGKPGLTQVSAKASSSWQPVFNAGLSYNITDHWGLVASVTYIPLKTTSTVTIKAADGTTLAESKSDLKADPIISYVAVSYKF

SEQ ID NO: 15428 - protein, 661 aa, Ralstonia metallidurans
MSAHAEEGYFETLPVVLSVSRLPQAMEDTPGAVTVIDSELIAATGYRDLARLFRLVPGMQVGQERANHHWVTYHGLGSDYPNQMQVLVDGRSVYSPYFFGGADWGSLPIALEDIDRIEVVRGSDSAAYGSNAFLGVVNILTRHTGAETGNSVSLRGGTNGIADATGRAVLHDGAMGLRVTAQHIEDRGMADLHDSQRIDVLNLRADLRVSAVDEVTVTAGMSSGARSAGYEGTQFDVVAPRTARHEDGAVHLKWRRTLSPDDEWSLSWYRNREQSREDWLLDSHKNLRPEVAYLRNLPRLVVTVDNDRDSLRDNIEFSQRLRPLDDLRLLWGTEWRRDWLRAPMLFYGGDSHSQQEWRLFGNAEWRMAPRWLWNIGAMAEQIEGDRLRLAPRVFLNWQPSPTQTWRAGYSRAWRQPTLFERSADIRVVHPQLGLIMLDHLPNPDIRPQRIDAWEVGFLGQLPQQGSFDLRLFHERIEDFIVRRAVDPAELPDNDIQRAAGATRWVNSGDGVRLVGLEYQLRTRPWSGGQLVLSHSLIRAHSDDDAVRRSVAPYTASLTWLQRYGPWQSTLSLLRMGASDSGSGYVPGYRYKVPAYTTLDWSIARTLQVGPNPVELRLTGINLLGKHQELVLRPLQSMPGYGDDRPANELDRQLHLSVRVGF

SEQ ID NO: 15429 - protein, 389 aa, Ralstonia metallidurans
MSSQPRIPAERGMKKTLLLALPMACLAAVTDAGAFEIKLGGRLHLDYAAHRADVKPLDNGFLVRRAKLGVDGRLVDDWSFELSYDFADPYQVTDDGSTKVGRFKDGFDDVALRYEGWKPADIDIGQFKVPFGLEELTSSNNIGFIERALPTAAFAPARRLGAGLGRNRERYTLSAMGFGSSIDGGDQGRGAAARATFTPVDGGAGGTLLHLGLAAVVERPKGDVKFNARPESRVADVKLLNTGTLRDVERIERGGLEAAWRSGPLSLQAEWMRAALERSHGSPDAHLRGWYVMGSWLLTGESRQYRNGRFRGVPLQRPGGAWELVARYSHLDLDDGRLRGGEESNLALGVNYYATKHLRIMLDYIDVRSERRGRRDDPEILALRTQLAF

SEQ ID NO: 15430 - protein, 655 aa, Ralstonia metallidurans
MAHFMRTPLALLVGGLACHGAAGQEQVQRLEPMVVVASRPTSTLEVTLDPKKPGSPMPAADGAGYLKNVTGMSMVRKGGLGGDPVLRGMGMSRLNVQMDGGMLAGGCGGRMDPPTAYVFPQSFDRIRVLKGPQSLEQGATLAGSVLFERDRPEFSAPGVKAEASALYGSSGRDDQMLDTTVGAPEGYLRGQFTHSDSDDYRDGHGDKVRSFYRRENGTAQLGWTPGDNTLLELTAERSNARAAYADRMMDGPMFDRESFGLKFKQEAISQQWRRSELTLWDNDIDHIMDNFSLRPNSGIKMLSNPDRRNTGGRWANDIALPADWLLTAGLDANRDQHRARSGVDYASQPRQRTLRFEQQGWFSELGRQQGYHSYKGGYRQDRVETTKYGTGDQTLYSDKLVLDSGFGRYEYQWSPAWSSYLAWGQAERAPDYWERSKDSVPFTLNPERSRQWDAGLALRSRDLDLTLSLFSADIKDYLLYHSKSNQVRNIEAQTRGGELEGRWQFAEQWRLDGGLAVVYGENRSDSKPLAQMPPLDGKLALGWQPDEDWSFTLLGRAVAAQKRVDVGSGTVAGQDQGETPGFFTMNLSGAWQVSEGWQLSAGIDNLFDTFYYEHLSKSVHASQAGLGYEQIGRIPEPGRAFWLSVNYRFASAGVL

SEQ ID NO: 15431 - protein, 447 aa, Ralstonia metallidurans
MKKTLCVAVCLVLGVMLTTPAGATHFGDTFGFSPEGMALGNAMTAKVDDWSAVYYNIAGLGRSQHLVNGKSQLFLGYINNAPDLDIEIVRREAATGDRLATNGDRDLDTGTIVIGGVLDIGTLVHLPEMVSSTRLGLAIGLNDDQSVVKINDLDPRTHNFMRYGRECQRMLITTGMGFGFLHDTFGVGLGVTSFFTGEGTALLERVELQTESQSPPGQAKMDLKMEQALVMGAYFSPGKLWRSLDTLELGVAYRAESQLDITPFRAIASTDLGGIPLNIKMALVDYYQPEMYSVGLAYSLNRLTLSADLEFQQWSGFEFSTPMQENYGGELKEFDDIFVPKLGLAYDFNPSLDLLFGYYYEPSFVPDEAVSGRMNFLDNDKHVVSLGCVYQLPKLSMVKGNSEFSIGYQYQHLMDRDVIKTAPTPENPHYSYGGSCHSLMLGVSINI

SEQ ID NO: 15432 - protein, 796 aa, Ralstonia metallidurans
MSSGSVRLKKAGVYSAALLASTMLSGVAYAQAQSSQSTALEEVVVTAQKRSENLQDVPVSIQALGSQKLEQLQISAFADYVQYLPSVSFTSSGPGFGQVYMRGVASGGDGNHSGSLPSVGVYLDEQPVTTIQGALDIHVYDVARVEALAGPQGTLYGASSQAGTLRIITNKPSTAGFAAGVDVELNKVAHGDSGHALEGFVNVPLSDKVAVRLVGWDVRDGGYIDNVAGTRTYTRGDSNRTNDFTINNKARVRDDYNSVYTQGGRAALRVELDDNWVITPQVMGQVQKSNGSFSYDPKVGDLKVKRFYPESAKDKWYQAAMTIEGQVANLDVTYAGSYLKRKTDTNSDYTDYSFFYDQVGYGFYWTDNAGNLVNPSQFIQGQDDYKKESHEIRIASPQDKKLRFVVGGFYQKQTHDIFQNYRIADIGSSISVPGYTGTIWLTKQQRIDRDKAAFGQAEYDITDKLMLTAGIRFFEAHNTLVGFYGYGKGYGSTGERACFKAAVVPGSPCTNLDKGVKESGNVPKVTLTYKLDSDKLIYATYSKGFRPGGINRRSTLPPYQADYLKNYEAGWKTTWLNNSFRWNGAVFMEDWNNFQFSILGANGLTEIKNANQAQIKGIESDVTWVPVPGLTINAAAAYTDAKLTANYCGKTDGAGVPITVCPKGSAGYPDGPQAPDGTSLPVTPKLKANLTARYDFSWGDWDNYVQGSMVAQSATWTDLRLADRAALGKQKGWETVDLSGGMEKDGLTIGLYVKNVFDKRASLDRNAQCAISVCGAQYYIVPNQPRTMGIKLGKAF

SEQ ID NO: 15433 - protein, 722 aa, Ralstonia metallidurans
MQIAVWLAFAGAAQSAFAQSAASGEAATPAASSGTTASAAPTSTPRGGGEALPPVNVSAAAQTDSPMHLRTPVSVGALGTRSQLDTPFSTTVVTGEELADRQANKLGEVFAGDASVTDNSNAYSAWATYISIRGLPIDWQNGFRIDGNPFISYGITMPYENLERVELLKGLGGFMYGFVQPGGVVNYVTKKPADQPVTSVSAGYRMDSVFSQHVDLSRRFGPDDMFGARINYTHEAGKTYNAGDINRNSLAVSLDGRLTRDLDVYFDAIYQQSRSSGQTPAIYTGSFTGTSLPAPISGGTNLLGGTDQHLNTNLQLYTAGLRYQITPDWSFNTSASYSKSARDRNESTLTLLNQAGDYIDNRWNGDEGHQDIYWQGVFEGKVKTGVFAHQLALGASWQYQTNDYSAVSHYFTLGDGNLYQPNPWRYYSGAGLDKYRASEITQKSLFASDTIQLTDRWSLLAGLRYTNFDQQSYNVNGSLASSYGQNGVLTPTVALMYKLEPHTTLYASYVESLEQGAIVADIYANAGALLRPLRSRQYEVGVKSEHERWSATAALFRIERGAAYANSQNVYVQDGNSIYEGLEAGASVRLGRSWQVAGNLMLLDTWYAKGQAYSGNRVAGAPQFVAAGRVTYDVPAVPGLQVGADAKFTGSTKVRPAGNLETGGYMIVNAGANYLTRIGGHDVTLRAAIDNITNRRYWMFQYSDYIAPGDPRMVSLNAKIDF

SEQ ID NO: 15434 - protein, 161 aa, Ralstonia metallidurans
MKCKDDMSAVLTAEQALKLVGEMFVYHMPFNRALGMELERYEKEFAQLAFKNQPMMVGNWAQSILHGGVIASALDVAAGLVCVGSTLTRHETISEDELRQRLSRMGTIDLRVDYLRPGRGERFTATSSLLRAGNKVAVARVELHNEEQLYIASATATYMVG

SEQ ID NO: 15435 - protein, 509 aa, Ralstonia metallidurans
MQRFVMKKKTLHQMLVKSGVASGLPLLLSLGIVQPALAQASSPAAAPAENAAPPAPATRAPDGVPGGNGATAAQTDAAPTGFWDRSNLFGDMGGLRTKLGDHGITLNLQETSEYLRNLSGGTSRGGAYDGLTQFGFSVDTEKAIGLPGGTFNVSGLQIHGTSLTARNLQLLQTASGIEAEATTRLWELWYQQSFANGRADVKVGQQSLDQEFMVSQYASTFINATFGWPVLPAVDMPAGGPAYPLSSLGVRLRAKPSDAWTVMAGVFDGNPAGGVGDAQQLNRHGTNFNLRNGALFIGELQYALNAPPADPKAPQAGLPGMYKLGVWYNSERFADPRYDTNGVPLADPASNGVAATHRGNYGFYAVADQMVWRPGADSPRSLNVFARVMGAPGDRNAVDFTLNAGVTLKAPFAGRDNDTAGLAVSYAKIGSRARGADGDTGVFQTPGYPVRRAETLIEATYQYQVTPWWQLQGDFQYAFRPGGGIPNPNEPGSRIGNEAIVGVRTTITF

SEQ ID NO: 15436 - protein, 684 aa, Ralstonia metallidurans
MKFKKSLLCFLILSGALLKAEEKYQLNDVVVSASGFEQDLVDAPASISIITKEELEKKPIKDIGEAIGDIPGVDVTMNKTGTYDFSIRGFGSSYTLVLIDGKRQSVANGFYDNGFSGSESGYLPPLSMIERIEVIRGPASTLYGSDAVGGVINIITKKNPDKTEANIEFNTLLQQHSNHYGNAGGFNAYVATPLIEDILSISARLKYYDKAASDLKWPTPVWNNGNQRPDNYQIASHSPGAFTSLGFGSRLNWTVDDKNNIYFDIERYINEISVNSTSSRAIKSERQLFKDNIVLNHDGNYDFGSTNSYLQYGSTKDKELHSQIWVGEGKVVLPWNLGQYGNLVNTFGARIDYEILKNDQASAGSQIRGKNLDQTTVALYGENEYFIADDLIFTTGLRYIYSDLFDSEFTPRVYLVYHLNDNIALKGGVSKGYKTPAAKQLTNGYYNYANNNAYFGNPDLKPEESINYELGVDFMVFDFAHYSITGFITDFTNQISSEDLTGMQNDINCSNGIVCKRPINLGKTQTKGIEFAFNTKTYNGFSLNSSYTFMDNRYKDGQKNWFGGDRIENLPRHIAMLKLNYERGKFSSYIKTRARLDAIAKAKGGGNGSLPWQKYKPFYIVDLGINYKINKQSSLSFAVQNLFDKNFFNPQVTRWDGANPAGYANRYQDYTEGRSFWLSYKYDF

SEQ ID NO: 15437 - protein, 940 aa, Ralstonia metallidurans
MKARKYRNKNSVSKKTKLSQAVQQVLLGMALSSSAYALQAQELNENDSAEKDDIEVIAVSGSYVKSLEKAVDIKRSNISFSDSIVATDIADFPEQNLAEALQRMPGVTIERNKGLGSRVNVRSLPTEFTHVSINGLATASGSGGRDVEFDIFASEIIQSVTVKKSPTAADEEGGIAGSVLISTARPFDYDETQLVASVEAAHNSISEEVDPKFSFLASDTFGDWGALVSFSRSERTNRTDSNSGIDFRPLSRWTEKSGDSQWQSDQTIAVLERDTGVVIDDPLDSDETGRAVFMNKVGDRAYLNEQEKWGATASIQYKPSNDFSLTLDAMLGGYDNTEDEYDAAAYSASSVSALERIHEYDDTTFSEYGMVVLSDVSYAATQHEFLSKENVHETDFSQLSLSLDWQLGEWTVTGLMGYSGAEKTSDRTNLKHTAYAPSRTRYTSTGGETIPSDNPDTIDMYNSPGSYLFDFYDVDLEEITDDKYAAQFDFSRGIFWDAFPALAKVQFGARYTDKSKERNLGNVQVKGPTAGDSSWSGERTLEDSELTLISDLVPGGAYLPEVEGKGGWSQVSNGYARNEFRYDGFNVPFQDNQFYRVDEEVLSIYAMADFEFNIGQFPVSLNTGVRAVDTSVLSFGYHQVQMPDGSTGYTDEPVSKKGSYTEVLPSLNMVVELSDSVLLRAAASETFIRPALGDIAYKRTVSVNEFKYFDGNPDLKPTYADQWELGVEWYLDNGGILAASYFDKTVEGVVRESLTGVVKDVTKYNDNGTLDGVYDFDVYQKVNDEGSYDVSGIELIAQFPLKALHSSLEGFGINSNYTKLDNSLTGSSDLGIPTPPPGLAETTYNFTAYYENNSFDARVSYNYKDDYVERIERSMYPVYRDAYGQVDVSLGYKINDSIKVVVEGINVTDEATKGYTMDPKFPTMYEFSGRRISLGIRGSI

SEQ ID NO: 15438 - protein, 483 aa, Ralstonia metallidurans
MTRVATATLLSLAYCNLAHAGGTAFDATSISAMGNASAGQAAEAGDASVLFANPAALTRFKRAELTQGAAVIAIGTDYTSTQNNDGADSGAPQGQNGQVFSRKDGYDAAALAPNLFIAIPINEKLVMGFGASASHGLVIHYDENFPGRNQGRDIDFKVTRLNLGFGYKLSPTLSWGLNGSYERYFQSIKLKLNYREAVEALAPGSAALLEGPAGALIGAPPIPGESNAGLRMFGWAFNAQLGGLWEPTENTRVGISYRPKTEFTGNRGKFKLDDSPEQAAFRAFLNSDSLINNLAFGALGVNGPQAAGDLAPEQIIKQEISLPDELRLSVFHHATPKLDLMATYTRQDFSVTTLNFVRESNGRTLENIPQNFVAAESYRVGLNYKLYKRLTLRAGYAIENSVIDDATRITILPDSDRQYFAFGGQFDLSRDTSIHFAYQKLDTDPAPVGNNTGITPAEVRGGDFQGNVQLDTHFFGIGFTERF

SEQ ID NO: 15439 - protein, 710 aa, Ralstonia metallidurans
MPSRHPRLPLSLLSLGLALQCQNVLAEDSVVLAPLQVSDTYANDGYQARQAAVSGFQPAPLLDTPASVSVFSQPLLEDRQVRMLSEVLQSDASVGESYAPIGYYENFNVRGFELNAASSYRINGQTIAGEQNVALENKQQVELLKGLSGLQSGVSEPGGLINYVTKRAEEVRSLTVSTNEQGERYLATDLGGWFGSEKQFGLRANLAHEDIRSYVDHADGKRDFASLAFDWQINPDATLQLDAEYQHREQRSVPGYQLLGGTEVPHGIDPDDRLAYQHWAKPVQSDSLNLAGRFEYRFDEAWTGTLSASRSKVVIDDYSAFAWGSSEGAFFGSNGDYDIYDFRSPDDTRRTDEAQAMLNGRFDALGVGHELTMGASAQRRTLDQRPSYMEWVGTGNIHTGAPAFDPSDNPIKSSERRLDSRQYGLFISDRISFNEQWQTVLGAREVRLDEKTWDENGLAGRHTRQYELLPNAAIIFKPQPNTTVYASYAKGLSAGGTAPWFAENTFENLAPTTSHQLELGLKHDWQGLSFSAALFQIRQAYQYARPDGAGHFTYVQQGQQKNTGLELGASGWVTSNLQLQASAAAIRARVQNSGTEAYEGHQAINVPKFRAAMHAEYSLPVPGLALLGGARYSASKYASQAGNVEVGGYTVFDLGSRYRTRIGGYDTVLRLTVDNLFDKRYWRDVGDYLGDNYLFQGAPRTARLSASVSF

SEQ ID NO: 15440 - protein, 268 aa, Ralstonia metallidurans
MKLNPLACLSYCFLPLCALASAGAQASPLMWYDNSLSYLYGHNYKVDGTGNDIQQTVTFEHASGWTWGDVFMFVDNKWSNGLSGNDGHSYYGEFSPRLSLGKVSGQNLRFGIVKDVLIAATYERGEGRTRRYLLGPAVDLTIPGFDRFSLNTYYRKPDGITGKASGQWQINPTWAMTIPLGRSDILFDGYLEWYVNDVGSKGTSDYVAKSFHFNPQFKYDVGKALGHTPKRLYAGLEWDYWSDKYGIEDSHGFPTDQNAVSALVKAHF

SEQ ID NO: 15441 - protein, 227 aa, Ralstonia metallidurans
MKLRGQGKSVLMLSTVLLAGPVMAHQSGDFIVRMGGIKVAPDVSSDAFDSALPVVGGLEVDVDDDTQLGLTFAYMVTDSIGVELVGATPFTHDIILDTGGSGVVIGETSHLPPTLLAQFYAPQLGPVRGYLGAGVNYTLFFDDSIDDAVVSPLLGGADVDVKLSNSVGFAWEVGADFLINENWLLNASVWNIDIDTEARLYVNDARVDKIDVEIDPWVYMVGVGYRF

SEQ ID NO: 15442 - protein, 454 aa, Ralstonia metallidurans
MHNKKINQLLIGAALAAMVPAVSAAETPAWNGSVLGFEAGQQGLLGDMLGIRPILEENGFHYNLGYLNEMAYNAGGGYDHDKHLAYIDQVALTFTQDLERWTGIPDARLEGNIVNRNHDDNLTTKRLQDPRVSFNDLSQESWGGGSITRLGWLTFARSFDDRRLTWRIGMMNKVQTFDQIIPCDFQLLTQCGGKSANSLTWNNWNIHTWGTTLEYKLTPTVTLKGGVMEQNPQATARSHAWSGSTKGSKGILLPMEIETRPLMNGLPGAYNLGVVWTNAPQTDLYSGKSGGAGATDPQGYAEHDSTWFMYAGLNQQITRHADDPLRGMSVSLSGSLSDQRSNYIHSAVAASMRYRGLFDARPEDWIGFGLTWIDMSSHYARNQRYMNQLSGATDYNDPAYQPVAGHSLNGELYYRFRPVSWLELQPGLQYWHRPGGVAQTQDAWVVEWKTVVTF

SEQ ID NO: 15443 - protein, 993 aa, Ralstonia metallidurans
MKTIYKKLLFLFLLLPFSVLAQNTLTGTVVDKTTGQPIPGVNVNVQGAPNGASTGFDGNYQLSNVKNGSKIVVSFIGYKTETIDYTGQKTLNVSLSEDTNQLQEVVVQVGYGTVKKKDATGSVSQISAKEFNKGINVTPESLIGGRIAGVNVVGGGAPGAKADIRIRGGSSLSASNDPLIILDGLPLSNAVPSGATSILSTIDPNDIESFTVLKDASAAAIYGSRAANGVIVITTKKGTKGGVKVNFSSQVGVNTVANTVDVLNADQFRNFVNTKGSDAQKALMGTASTNWQDEIFHTALTTNNNISVSGALFNKLPVRLSVGNVDNPGILRNTSFERTTTSISLNPVLFDNHLKIDISGNLSFSKNQFQDEDAVIGSAISFDPTQSPYQAGSRYGGYFEWLEANGNLALLPAKNPVARLNQEDKRSKSTRKWGNISVDYKFHFFEDLRIVAEAGIDRFDSSGYNRQSTESALGFQPTAFSSGTWVNLGNYDTYTDDLQNKNLNAYFVYSKNLGKLKLDATAGYNYQLFQKEKYQSGALTQPAATRNEDVITDPDINLQSFFGRLNLGWDSRYLLTLNYRRDGTSRFSESNRWGNFLGGAFAWNVAEESFLKGNETLSSLKLRAGYGTTGQQDISPQYDYLRRVTLGTVNTQYVFNGVVYRTARPEGYNENIKWEELSEMNIGVDFGFLRDRITGTINYFDKKSSDLLADVLVPDGANLRNQGYNNIGNLRTKGLEFSLQSDIIKKDNLTWNVAVNATYLDQKIENLGQTVEGFQGYEVGDNIKGGNGNKVLINTVGFAPNSFFVYEQLYDANKKPIAGAYVDRNGDGKIDANDRYRYKKPTADYTFGLFSTLNYKKFDFTMNWRASLGNYIFDNVNSNMGYSDAALRRQTDLSNVSSDYLNTGFTFEDNGTQRYLSNYYVKDASFIKLDNVTLGYTLDKSLLKDVSLRFSAGVQNVFVLTKYDGLDPEKFNGIDGNVYPRARTFLFGVNASF

SEQ ID NO: 15444 - protein, 502 aa, Ralstonia metallidurans
MRRPAWLPVLILTLAFDHGIAYGQGATSVAAPAMALSPQPPEGAGGDPQTAVAQPETSSKPSANVTTSIQGLLGPYADPGGIRSFLAKRGIEYSLTYVGEVLGNLSGGIRRGAIYEGRLDLQVDADLEQLAGWKGATFHTNFYQIHGTGLSRYYIGNLDVISGIEALPSSRLYELWIEQKLFDDQLGIKIGQIAADTEFIVSQTATLFVNSTYGFPDITGVNLPSGGPAYPLATPAVRAKYTPNKNFSLQVGLFNGDPAGPFKPGLDPDPQRRNRTGTNFRVSDPPLLIAEAAYAYNLDSEHRGRLVIDEPGTITLGGWYHFGHFGSPRFDQTGRSLADPSTTGIARRFRGNGGIYGIIDQTLFREPDKKDEGASAFIRVSGSPGDRNVVDFYVDTGIAYKGLLPGRSDDTVGISLAYSRISQSIRGLDLDTILATGAPRPVRNFEAQLEVTYQALIAPGITVQPDFQYVFHPGGNAVNPRSPTGQRIKNAAILGLRSTIRY

SEQ ID NO: 15445 - protein, 1028 aa, Ralstonia metallidurans
MHAQDFEVTGTVVSADNQSPLPGVNIREAGTSRGTVTGPDGGFSLAVDSPQDTLTFSFIGYQTKTVPVDGRSEIRVVLETESQELEGVVVTALGIERQQRSVGYATSSIEAQDLVDVTESNPANLLQGNVPGLVLSSNASGPNSSSSINIRGVSSIAGNNDPLFIVDGVPIDNTVIGGAGKFGGRDGGSALSVVSPENISDISVLKGAGAAALYGTRARDGVVLITTKTGRTSAPGEVSVQYSSTVTAKDVISGFSDFQSQYGQGTQGRAPSNQDAALSAGLSSWGAPLGEVDEAPQFDGTVRPYDDVADRQGFYRTGLSQRHSLSINAGFENTSLRLSASHQNTEGVVPNSGYEQTNINLRGQTRLGGLTADASVTYQNELTDNRTFLNDAARNPNYLISFLPNNIPKSALQPGATEEGVEKQFTSDGLPTNPYWAVNELEADDDKDRILGNVNLNYSINDWLSLQGQTGLDWYSLRRTNVDAFGSAFEPGGSMTEDTYRVWESNSKLLATATPSLTDELSLRLDVGGSLRHRQFEQVGVFGRNFSIPDLETISNTANPTRNYDFSEQQIRSFFGSASFTYRNYLFLTLTTRSDWSSTLPEDNNPFVYPSVSGSFVFTDAFDLPDALSYGKVRASWAEIGGDTDPYRTSLTYGIIGQHQGQALETITQLSVPLLDLKPTSTREIELGFETQFFNDRFGVDFTWYRRSTVDQILDVTVSSASGYTARTANSGEIRNTGVELLLTSIPFSTADWTWDSRVNFAANRSQVESLAPGLDVRVGPENRLATANIAQVVGQPANAIYGNTYVRDDQGRIVHGEDGLPLSGEKEVLGTGAPDWTLGFSNTISYQNVSLDFLIDAKWGGKVFSGTNANAYGNGLHKATLDARAACDEQAGSNGRYPEDCFVGEGVIGSVNGEGEVTVDRQNDVGVRPSEYYGRISGEIAEEFVYDANFIKLRQLRLSYDLPSSVMSRVPVRSASVSVVGRNLFYLYDSVPNISPESSYNSEATPGFEQAGVPQSRSIGASVNLRF

SEQ ID NO: 15446 - protein, 283 aa, Ralstonia metallidurans
MEVMMKNIKNAALAATTLAAISCNAFAADYSDDIHKNDYKWSQFNLMYAVGEKPSGEDNLKHDYLEMEFGGRSGVVDLYGYVDVFNLTNSRSSNSDKNSGDKIYMKFAPRFSLDGMTGKDLSFGPVQEVYVATQFNWGGGDISSSDTTNNAFVGLGSDVMVPWFGKVGVNLYGLYDMNAKDWNGYQFSMNWFKPFVNFDNGSFISYQGYIDYQFGATDKGNAGVPKVSSGGVMFNGIYWHSERYSVGYGLKAYNDVYTIDDGAGSVGLKSTGFAHYFAASYKF

SEQ ID NO: 15447 - protein, 265 aa, Ralstonia metallidurans
MDWRRGLCSVAFCAGLSAPFFAQAADEDFLDAPEITISSEEAAGGGLYLRGDIGYAAWLDEGDPYYRSPGSGNVAFDNARFEEPASATIGLGYQFTDVIRADLTAEYFEGRFDGTSLSAPPCAGEGAGTGCAFSHRANFSALGLMANGYVDLATLAGFTPYLGAGIGATRIDWKTAHETSSCVGPGGACSGNAGGASYGGRDSWRFTYALMAGVSYDVTDRLKFDAGYRYSQISDGDMFGSGDAQGYDDGLSRHEFRVGLRFALW

SEQ ID NO: 15448 - protein, 179 aa, Ralstonia metallidurans
MPRRRVIGQRKILPDPKFGSELLAKFVNILMVDGKKSTAESIVYSALETLAQRSGKSELEAFEVALENVRPTVEVKSRRVGGSTYQVPVEVRPVRRNALAMRWIVEAARKRGDKSMALRLANELSDAAENKGTAVKKREDVHRMAEANKAFAHYRWLSLRSFSHQAGASSKQPALGYLN

SEQ ID NO: 15449 - protein, 727 aa, Ralstonia metallidurans
MKRKCLCAALAVSCAINVSFAQVRLQGKVVDESNEPIPGANIRVSESLNGTTTDAGGKFELNLPDGRHRIRVTYLGYEQGVYQTDHSEKDVVIKLKEKYVNIDQVVVTGTGSHRRMSNSPIPVKVLTGKDLKEASVTNFQDAMTKLNPSIVFMENGQGATMNMNGLTEKYVVILENGKRLAGDDTYSRIDMSNVKRVEILNGAASALYGSDAIAGVINIITDDSRNKVNVTSNSRYGSKNQFLQSVNADVNVGKFGSYTSYQYQRADGWQLNPYTESKGELVPTNKQASEGFHRNVINQRFTYDATDRLSFYVRGTFFGRSSDRPMPMDKVNTTNYDMRKETFTYGAGAQYMINKNSYLNADYLSDNHSTYKDFFDGKKSGESDMTKRIHYHNLNVKGIFRLGKYNKLSAGTEFIKELLSSETDNIAGKSMYTTALYAQDEININEHFQAYAGLRYIYHENFKSYATPNVALLYKVGGFNFRGSYAAGFRTPELKELYTESEKKASGATRLTIGNPDLDPEKSDNFTLSAEYTMRYFSLSVSAFMNNVRSMINYKMLDTAERDAYNTAHGTDYDEIQMRANIDKAKIKGINVAFNSYLGAGFTLNGGYSFMDGKNVYEDEPLDKTVKHSGTVAAMWSHTWNKYKLNVNFNGRIQGERYSTSYGYAPKYSLWNLNTSHTFRAGDFLLEPGVGIENLFDYVDDRPFNYNYATLTPGRTYYVSLLVRFKQ

SEQ ID NO: 15450 - protein, 678 aa, Ralstonia metallidurans
MPPHVLLTRRALAGGTALTLLSAQLAHAQDEVYDLGTITITAGGFEQLVENAPGSVTVIDRQDLEGRQIRNLEDALVGVQGVVTTGVAKEKDISIRGLPGEYTLILVDGVRQGTRESRPNGSAGYEQSFIPPVSAIERIEVVRGPMSSLYGSDAMGGVVNIITRPVADEWTGEVSTAVTIPQDDDDGASKELSFYLSGPVVSDKLGLQVWGRGYGADESGIVDGADGARDRYLNGRLSWAIAPGHTLFLEGGKTELDRTRTDGESVEEGSGDSRQRNTRDHLNLRYSGDWSGTQADLALSREWGERNTWSEDDDGSMSKSDRTPEIRNTTFDAKFTTPLQAAGEHTLVYGGQWTENALTDQNPGRADPGDETFSVEQWAVFAEDEWWITPSFALTGGLRYTEHESYGGEWTPRLYAVWNATDALTIKGGVSTGFKAPGVRQTVDGYYYTTQRGAGVIVSNPDLQPEKSTSYELGAIYTAATWDVGATLFRTEFEDKIASFNSGETVEVDGTTYNRWEYTNIGEARIQGLELSGSWAPRDDLSLRATYTWTDSEQLSGEYEGLPLMRTPEHTASLRADWQTPVSGLDLWGAANYHGREINAGARIGSNGTPYEYDDDGDAIAYEYDPYTTVDIGGSYVFNDAISLDAAIYNVTDVRLTSSDNNAVSEGRRFWIGATARF

SEQ ID NO: 15451 - protein, 861 aa, Ralstonia metallidurans
MSSRLTRQTSSPSRVLSLLTAAILMAGTAPLMAATEQPTRNMGDYSFAIPQQPLVSALNAFTAVTGWQVGLPAELGQDVSSPGVRGSLPPEKALERLLVGTNLSFRKLSNNNVVLEKRASSGALNLDQVTISATRQEQSINSVPATVTVQTRQDLDRNNVNTIKDLVRYEPGVSVGGAGQRGGISGYNIRGIDGDRILTQVDGVEVPDGFFNGPYAKTQRNYVDPEIVKRVEILRGPASVLYGSNAIGGAVSYYTLDPDDIIKPGKDVGARLKTGYSSADESWLKSATVAGRADQFDGLLHYSQRDGHETDSYGSNNGTGLERTAANPEDVKATNVLAKIGWNYNEGSRLGLTYEKYKDDRDTDQKSAYGGPYFNGAPTIPNSVLPGGMYQWRTGNDTITRERFGLEHSFELDSLLADNVKWSLNHQTAKTDQSTDEFYYPITRKVLRTRDTIYEEKQWVFDAQLDKAFAIGDTDHVLTYGTTIKQQKVTGSRSGDGKCLAVGRGCTAIGATSAADVLKKSSDFPDPTINTYSLFAQDQISWNNWTFLPGLRYDYTQLKPHITQEFLNTVAADGNGTVSDSNKTWHKVSPKFGLTYALTENYTWYGQYAEGFRTPTAKALYGRFENSTTGYNVAPNPDLEPEKSKSYETGLRGNFEQGSFDVAVFYNKYRDFINEDAVTPGYDELTFQSSNIKHATIKGAEVKGRLNLDSFGAPQGLYTQGSISYAYGRNNDNGEPLNSVNPLTGVFGLGYDQDNYGGLLSWTVVKKKDRVDDSNFKSPDGVSSQFKTPGFGILDLAGYYKVTDDVTVSGGIYNLTDKKYWLWDDVRGYDSVGEASVTQPANLDRLTQPGRNFAINLVWDI

SEQ ID NO: 15452 - protein, 1132 aa, Ralstonia metallidurans
MKLKFWALAFPLLLLLTSFSVAQNVVTGDVSGTVTDPSGAVVPNSKVELKSSETGFDKVVTTSNAGDFRFSLLKPGPYTITISNSSFTTVTRHLTVNLGQITNASTALSVGASTTTVEVSGEAPLLQTENGNIATTFDSRAVAQLPNPGGDITYYAQTAPGIAMNTSGGGYGNFSAFGLPATSNLFTENGNDENDPFLNLNNSGSSNLLLGKNEIQEVAVVTNGYTGQYGRMAGANVNYTTKSGTNQYHGSATYDWNGGVMNANEWFNKGQGNPRPFANSNQWGADFGGPIVKNKTFFYVDTEGIRYILPSTQNIYMPTPAFATSVLANIGANSPSQLPFYQQMMGLYQSSAPYGQMKPFNASPASATDNTGGCGDISASTGFGAGNPCVGYFLASGKNLNKEWLLTARVDQNIGTKDVLFGRFKMDRGTQPTSTDIINNDLFGSHSVQPSYEGQLNETHTFSPNMVNSLILSGQWYSAIFVRNSGEPAGLAALPYSSVLFGANPLSTLGGTSTPDYFFPQGRNVTQYQITDDLSYTKGRHELKVGANVRRNDISNYDVQTLTSGFLNFGSMADFYNGAVNINNGDYFYQAFSNANRVPLAIYSLGVYAQDTWKVKPNLTLTLAIRADRNSNAVCQTDCYANLAAPFDSLSHDSTIPYNQAINTGLHRPFYDIEAAAIQPRFGFSYNPSFAHNTVLRGGIGLFSDLYPGVLLDNIIQNPPNYNSFLTYGMGSGVTAAPGLATSASSLAAQSNSSFLTGFANGATLADITATNRFFTPPNVFSPAGTIHNPKYIEWNFQIQQEIGASNVLSLNYVGNHGYDLLINNPGLNINNAGLALANVPDVSPDIRFGTVTGLASDGISNYNGLVTSFSHRFSRGFQAQVNYTWSHALDELTSLPATPYNYGEAASITTQLDPNCLRCLNYASSDADVRHNLTFNYVWDLPFKFGNRFVNQVLGGWQFAQTLFLRSGTPYSVIDTAAANQLSGSFSGGTFLASWANDPNGPGGVSFGDCSTPGTGATPNQCLSAGSFLGPGAESSFGNVSRNAFRGPGYFDSDFNAMKNFNLTERVKLRVGANFFNIFNHPNFQNPVNDIASGSFGQILATVSPATSPYGSFQGAGVSGRLIQLEAHIQF

SEQ ID NO: 15453 - protein, 202 aa, Ralstonia metallidurans
MKTRIIAALAATLAASPVAAADLSYGNSYGYAPAAAAPASWTGFYVGGNIGYGWGSAGADSPKGFLGGLQAGYNLQMAGSPIVLGLETDFDWAGMNDGNYSQDYIGTVRARAGFAFDRVLIYGTAGFAYGKGSYQVFGLSNSQTSYGWALGAGAEYAIDRNWSARAEYMYVDLGNSTYGTWVGPTNVSYDTSVLRAGVNYRF

SEQ ID NO: 15454 - protein, 373 aa, Ralstonia metallidurans
MKRKALAILVPVLLVTGAANAAEIYNKNGNKLDLYGKVDGLHYFSEDTGADGDQSYARLGFKGETQINELLTGYGQWEYNLQANNTESSTNQSWTRLAFAGLKFGDYGSFDYGRNYGVLYDVEGWTDMLPEFGGDTYSKADNFMTNRANGVATYRSTDLYGLVEGLNFALQYQGNNESAGNGNEGTNNGNGRDVRHENGDGFGISSTYDIGMGFSAGAAFASSDRTTDQVNSTTAAGGEQAEAWTAGIKYDDNNIYLAAMYSQTRNMTPYGNKNYAVANKTKNFEGTAQYQFDFGLRPALSILISKGQDLNTAFGSEKDLVKYADIGASYYFNKNMSIYADYKINLLDEDDMFYHVNGISTDDITAVGMVYQF

SEQ ID NO: 15455 - protein, 1025 aa, Ralstonia metallidurans
MKINQRLTLCFSLLFCLLSISYASAQQLNISGVVISSEDNEPLIGATVSVKGNPTKGVITDINGQFQLSVETGTKLLVVSYVGMKTQEIRVPRKEKELKIVLIPETMDIDEVVVTGYGNFSKSSFTGSANTLRTDMLKEVPVMSVEQKLQGMTTGVQITSSSGQPGANQSIRIRGMGSFNASQEPLFVIDGVPVTSGSMSSGGPDAAYMNNSKTNIMSTLNPSDIENVTVIKDAAAASLYGSRAANGVILITTKKGNTGKVRVDLNVSGGFSHAAVDFRPTLNGDQREELLYEGLLNYATDNGMESPTEYASSNIGTYAYKPAMGYTDWRKELLRTAMHQSYEASVSGGNDRSTFYASLGYNNQEGLAKNSSLDRYSARLNVTQKVGKYGEVGANMMFSQMNQEMNEERGSSINPFLCVAMTMTPSMVVRDEEGNYVGAYDGTSLNPLRDILTDYNRVRMTRMFSTGYAAIEPIKGLKLKETLSYDYTIQKDSRYYNPLSSAGPKSGSDAQTAKGFIEYGKLISSTSLNYVRTFARKHHLDVLAAYEIESYQTDHASGEKSKLPSDKLTEPDNAAVLNSFKSATQAYRMISYLSRLNYDYDDRYYIAGSYRRDGSSRLSPNNRWGNFWSVSGMWHLGNENFMKAVKPVLSDVKIRASYGVNGNQPGSYYGYKGLYSYGENYMEAAGSYESAQPNDLLTWEKNYSLNLGIDLSFINRIFASLEYYNRDTKDLLYSLPISATTGFTSYLSNIGRLNNKGVEFELRTLNVVSNDFNWTSVFNLSHNRNKIVSLNGLLDQTIEGTWFIHKVGLPYHTFYVKEFAGVDPLTGSAQYYLNTKNEDGSYNRELTTDAAKAESIPYKTATPKVSGGFTNILNYKWIDLTFTLTYSLGGYSFDKLGTYIENGSSSIYSSRYNLPAYMMNRWQKPGDQTDIPRFVYGEPATSTNSSRYIHSTDHLRLKNFTLGFTLPNQWTQKLMIDKVRVYFSGNNLLTWAKWKQYDPETPVNGEVFCEAPAMRTFSFGAQLSF

SEQ ID NO: 15456 - protein, 967 aa, Ralstonia metallidurans
MTHSDTFKPALIALSITAALHSGAVSAQETSEDAEVEVIQVSGIRGSLMRAQAVKMDNDSIVEAISAEDIGKLPDSSIAESLARLPGLSGERVGGRTSGISVRGFKEDFTGTSLNGRELIGIGDNRGVEYDLYPAEIMTGATIYKTSDASLIVQGIGGTVDLQTVRPLAAQETLTVTGVYELGGNDSDNPEFDNSGNRFALSFVEKFADDTVGLALAIASTESPRNERKYGVWGYGENDDGQILPFGLDTQAISRVLERDTISAILQWRPTDRLDIVFDALDIDYSDSGVIRGFIDPFAAANVSGSGVNSTGTQINANPVLRTDPAQKDGELQTFGLNIRYDVNDDWSVSLDVADSESSKRDLRGESYAGLARSGALTNDELGSRQFQMSADGIYFTDSSGLDAFSDPALLQLAGPQVWGGGMANIADQFATDVLQANGQPYSYFNAQDGFLNFADFEEELTTARFEAVGYVDWGIFNTLTAGVNYSDRSKAKDNKGFFATASSYPFSEAIPSQYLYNGLADLTWAGMGYVVAYDGFAPYNDGEYTLNDAGLLEPDRLGDSYTIDEEVTTLYAQLDFETEVQGFNVKGNVGAQYVQTDQSSTGFIGIVGDNFAVCDDDGNQVVDADCIITDGDDYSHFLPSLNVSVELNENRYLRFGASKTISRARIDQMKASGFVKFDQNIELIATPNTEAAVEAYGSPWSKFSGNPTLRPLEANNFDISFENYFDGEGYVSVALFYKDLVNWTRDGNQLIDFTNDVTNDGANYFIPGFHDRIIDVAGNYGPEDTPYEVGDLVTPPDQGFYSFFEDGLEGEMKGIELTANIPLRMLADALDGFGIAASATILDAELEDGTAIPGQSDNTYSITAYYEMKGFEFRVAATDRSEFLTYQRGGSNKIEAATRDAVTQVDAQISYDFADSGMEYLAGLRVSLQGVNLTDEKEETIDGNGIVTLRREFGPSYMLNLNYAFY

SEQ ID NO: 15457 - protein, 510 aa, Ralstonia metallidurans
MPCPFVRQLAAPAAAAAVLSLACAPLARAQVSSVSPFTAIQFTDVMPTDWAYQALQNLVEQHGCVAGYPDSRFQGQQSISRYEAAALLNACLDRITAMTDEVKELIHVFRRELAIIQGRVDGLEARLGDLEAPQFSTTTKLSGLATVVIGANHFSGSDDESVDQNNQGFGATTFNNDLHLILETSFSGKDLLTVTLRAGNFGGETPFGGGGASSLATLETSYEADGGANQVAIDKLFYSFPIGEDVTLTFGPQVGQEDMLAIWPSVYSSDPVLDVLSLNGAPAAYNKNLGAGAGVSWSPSSGLRLSANYVAANGTLSNSAEGGIGTDHAASAGTVQLGWEGEGWALAGIVSKVQNGHGLIAYATPFTQDQLSERGVTHAFGLGGSWQPADSGWIPSISAGWGMNNSESQQNDQVTTSHSWSLGLEWTDLWSDGHAAGMAVGQPVFATDSKGGDTPADGQFLWEWWVQLQMSDAISITPAVFYLWRPLGQNTPAGESFSQLGALVKTTFRF

SEQ ID NO: 15458 - protein, 1160 aa, Ralstonia metallidurans
MSMKTFASILALIVLAGVPGRAQESRGTITGRVIDPSGAVLVGAEVRAVSKETGAVLSARTNDSGSYTLPYLLPGVYDLTAEFTGFKKTGRSDVAVRVNDVLTIEFRLEVGNATESVEVSGGAPLIEASNVTLGQVIEERQIKDLPLQAGNANELVLLTPGVVNSTNLRQRKSSFNSASSQFTTNGNALYSNEYTIDGVPDTFFNGGSNPLIAFQLPQNSVAEFKVQTSSFDSTVGHTPGAVLNTITKNGTNEYHGELHENMINAALDASTFFQNASGGPKPEYQDNRYGAAFGGPVRIPKLYNGRNKTFFFAGWEGNKWGKPTANIGTVPTAAEKNGDFSALLALGPQYQIYDPATTQTAANGRFSRTPFQGNIIPANRIDPVAKAIQSYYPAPNTVGTAAGLNNYTRNTKDIFDYNVIVGRVDHTFSDKNRAFARLSYDRYLETDSAFSNNIAGGLDLKRINRGGVIDDVMVLSPTTVLDLRYGLTQEETPEFRPSRGMDLKSLGFSNSLLSLLDPASQTFPQVYLNTKAPTNRCTGSCTGTFSGFGNYNTGDGTLTGIVHDWAATLTRLHGKHTLRLGADLRLYRTFGFAGGFDVSPQLTFLPTYTNGPLDNAAVAPLGQEYASFLLGIPSGQMTRSASYASQNTYYAGFIQDDWKLSRKLTVNLGLRYEYESPMSERFDRAVRGFDRTTPNPIAAQAIANYAKSPIPQIPVSQFQVRGGLLFAGPDAHNLWNGQNKTFLPRIGLAYQVDTNTVIRAGYGIFYDTIGVNRTPEIQTGYTATTPIQASLDNGLHFVANTANPFPNGLLAPQGASASLQTNLGQSLTVYPVNRLQPYSQRWTFDLQRTFFKDVLLDVGYVGNKAIHLGVDRNINATPNQYLSTSPVRDQATINALSATVPNPFFGINPIYPKTIAVSDLLRPYPEFGDITETQPIGYSWYHALQVRAEKRFAHNYMFGVSYTFSKNMEATGFLNAGDAAVNRSIAALDRPHRFNLQSMVELPAGRLWFKPLRWVAGGWQVNNIFTYQTGAPLGFGNIIFNGNLHDIPLSSGERSANRWFNTSAGFVTASAQQLASNIRTFPKALAGVRGDGQTDWNLSLIKHFKLRERVNLELRFEGYDIMNHPNFSDPNTTVTSSAFGTVTSQAGLSREFQGAIRVTF

SEQ ID NO: 15459 - protein, 397 aa, Ralstonia metallidurans
MKKQWIAAPLLMSFAGIASAQSAVVLYGIVDAGVSYRSNERTGTTGNYSGHSNVAATSGNLSGSRWGIKGQEDLGGGWNALFQLEDGFDITNGKTGQNGGLFGRQAYVGVGSKQYGTITLGRQYTSLNDFVSPVAPVAMVGGYGAHPGDIDDLDQTARVNNSIKYTSANYAGFTFGALYGFGGQPGSLKQQNTWSVGAAYGNGPLHVGVGFERSDNSKTGARDTTYGKWNGTDDGLFNSSINEGYASAQSQQIIATGATYNFGPAIVGVNYSNVQYRSGADSLFKGHATFNIAGVFGQWTIRPAVQLFAGYSYTRGGEVDGVDERAQYHNVTLGGQYALSKRSTVYLMGGYQHASGGTLDALGNPVAATASVSDKGNGHSSAAQSQAIVSIGVRHKF

SEQ ID NO: 15460 - protein, 1120 aa, Ralstonia metallidurans
MQQIYEFIANKQTISRVFMLFLCCLLLSIPTFAQNSSARITIHKKNISVIEALKEVEKQTKLSVGYNESQLKNKPSISLALEKATLENSLTEILKGTGYTYQLKGKYVIIVPQEKKEAEQASVKRIAGQVLDEQGEPLIGVNVLVEGTSIGAITDMDGNFSLEAPVGSTLSISYVGYTPKTLKVGGANKYSVQLASDTKLLNEVVVTALGIKREQKALSYNVQQVKSDELTQIKDANFVNSLNGKVAGVTINTSSSGVGGASRVVMRGTKSIEQSSNALYVIDGIPMYNFGGGGDTEFGSKGATEAIADINPEDIESISVLTGAAAAAMYGSNAANGAIVITTKKGHVGKLQVGVSSGIEWLKPFKMPDFQGRYGTGSNGKAGNSSIYSWGPKLNAAAQTGYEPSDFFDTGAVYSNSVTLSTGTDKNQTFFSVATVNSAGMVPNNRYNRYNFTFRNTTSFLNDKMKLDVSASYILQNDRNMTNQGQYSNPLVSAYLFPRGDDFSVIKNFERWDEARKISVQFWPQGEGDLRMQNPYWIAYRNLRLNNKKRYMASAGLSYQILDWLNVAGRVRIDNTHSEYEGKLYASTSTTLTDGSTQGHYTVNNGQNSQTYADVLININKRIQDFTIVANIGASYSGITSKELGYAGPIRETGIPNLFNVYDLDNAKKRATQTGWREATESIFASAEIGWKSMLYLTLTGRNDWASQLTHSPQASFFYPSVGLSAVISEMVKMPEWVDYLKVRGSFSSVGNPYPRFLTYPTYSYDATNMDWKSQKNFPIGKLYPERTDSWEIGLDAALFKDFKLSGSFYYANTYNQTFDPELPVSARYDKLYVQTGYVRNYGFEAMLAYNHRWGDFGWDTSFTYSTNKNEIVELVRNYVHPETGVIYNVDKLELKTNEGRGFGKAKFILKEGGTLGDLYTHADLKRDINGNVLIDDDGNVTAVDNAGDIKLGSVLPKANLAWNNSFTYKGINAGFLVTARLGGIVYSATQAYLDLYGVSETSAAARDAGGVWVNDRSQVNPQSFYSVVASQSGLPTYYTYSATNVRLQEAHIGYTIPRRWLGNVCDINVSLVGRNLWMIYCKAPFDPEAVATTNNYYQGIDYFMMPSTRNIGFNVKINF

SEQ ID NO: 15461 - protein, 874 aa, Ralstonia metallidurans
MNHDLLSIIKKKHINRKNIFNKKKIADKTKKDHFICGIKLLSVLVLFALSAIQTGYAKPAIEFNTDALDIGERANIDLDKFARAGYIMPGHYIMGVRVNKNEFPEMYPIDFIAPPDDPKGSEACISPELVKQIVLKPEWMEKLSWQYDGKCLDLNTLPGVSARGDLATYTLYLIVPKIYLEYDLPDWDPPSRWDNGIAGLLFDYNVNAQTSKPSHGSSNQQISANGTTGMNAGAWRFRADWQARYNRFKTKEENKSDNVGERERKWDWSRYYAYRALPRLEAKLTLGEDYLNSNIFDSFRYTGVSLVTDENMLPPNLRGYAPEVTGVARTNAKVTVSQQGRILYETQVASGPFRIQDLSDAVAGTLDVRVEEQDGGIQQFQVNTATIPYLTRPGRVQYKLVGGQSTNDKHRREGPAFGLGEFSWGINNGWSLYGGLLAAGDYNALSLGLGRDLMMFGALSFDVTESRARLPGENKTLTGGSYRLSYSKRFDEYNSQITFAGYRFSERNFMNMGQYIDRRYRNVSSDSGKELYTIIFNKQFTDIGLSTHFNYSHQTYWNRPANDRYNISLSKYVDVGRYKNISVSLSAYRNNFDNKKDDGAYLNLSIPWGDSSTFSYGGMVNRQDNAHTVSYFDRIDDRNNYRISAGSSMGGRASADGYYTHYGDKALLTASASYQDGGNTAAALGLQGGMTITANGAALHRINMPGATRLMVDTEGVSNVPVRGFGSAVHTNYFGKAVLVDVNNYYRNTANIDLDNLPEDVEALRSVQQATLTEGAIGYRKFQVMSGLKALTAIRLPDGSFPPFGASVMNAAQRELGIVSDDGYAYLSGMNQGEKLKVYWDGRAQCEIIVPDNISSESLTEILLPCQFLKGDDK

SEQ ID NO: 15462 - protein, 778 aa, Ralstonia metallidurans
MGLVKKSWIAPGLAMLLSSALYAAGAYTVTTSSLSEAIEQISEISKKPYIVDARILEGKKANPITGIENLEKALELLLEGSGLEAVIQSDTIVIRSKGGEPAMLNTISIAEPLLSENTEETHSYTAPRMRTATKLGLSIRETPQSVTVLTQQRLEDMGVTSYQDMLGSVAGISLNRWDERIYPTARGFEVDYYLIDGMPTYNISDSTAGDVDLSIYDRIEVVKGANGLMTGAGNPGVGLNFIRKHANSKTFKGDVEVSAGSWDAYGYLADVSAPLNKEGTIRGRLIAKHEDKNSFMDGYQKSNDVVYGVVDMDLTETTYLSLAGEYQRLERDGIRWGGLPAFYSDGTRTNFDRSKTVSEDWTYWNSETRAFYADFKQYLYEDISLNLSFVDRKLYSETSLLYFGGTVDRDTGNGQGYVYQYVNDALYHEQNMDAYLSIPLELSRLEHEIVMGFTQTSSKLKHNDWSMSVLASTLASPKINLYNINVANPNLTKNTSADPHKTTQTGFYLAGKFSLAEDWKLIGGARVSDWKYKSDTGVGNREFTHEVTPYAGLIYDLNENHSVYVSYTDIFKPQDKRGASGEYLDPIVGKNYETGIKGEYFDKRLNASLSLFKIEQDNVAEEVPGVFAPGTTEKAYKAASGVNSKGIELEINGEITDDWSLGFSLANFEAKDAEDKKVTTTSSRTMANLFTKYTIDKLSLGGGVTYRSKIYAGSGVTEVIQDAYMLANLMVAYKFDQSMKLQLNVNNLFDKKYYEGIGSDSMVYGAPRNATLSFRYSF

SEQ ID NO: 15463 - protein, 140 aa, Ralstonia metallidurans
TDESTMTYRLGAQFDFGTSWFQTSVGRLTGYWDAGYTYWEGDDSSSNHSVSLAPVFVYEFAGESVKPYVEAGIGVAAFENTEVEGNRLGSSFQFEDRIGAGLRFAGGHEVGIRAIHYSNAGIKKPNDGIESYALHYRMAF

SEQ ID NO: 15464 - protein, 448 aa, Ralstonia metallidurans
MFSLPNIRYTGTALIALTACFSSTASASEMFASDSPWMLGDWGGTRSELLEKGYDFTLGYTGEMGSNLHGGYDHDRTARYSDQFTFGSHLDLEKILGWQDTELQLTITERHGDNISNDRINDPRVGGFTSAQEVWGRGETWRLTQMWIRQKYFDGALDVKFGRFGEGEDFNSFPCDFQNLAFCGSQVGNWVGGIWYNWPVSQWALRVRYNINDALYAQVGVFEQNPSNLESGNGFKLSGSGTQGAVIPVELVWSPQVNGLKGEYRAGYYYSNAKAQDVLKDSNGQPAAISGAAYRSSSSKHGLWIGAQQQVTSLASDQSRGLSLFANATVHDKKTNAIDNYVQAGLVYKGPFDARAKDDIGFALARVHVNPAYRKNARLANQAAGHYDYDNPGFLPVQDTEYSAELYYGIHLADWLTVRPNLQYIRHPGGVSQVDDALIGGLKIQSTF

SEQ ID NO: 15465 - protein, 386 aa, Ralstonia metallidurans
MKKSLLSVALFGAFTMSAHAQSSVTLYGLIDTGLVYTNNQLGHSNWQEVTSSTQNTVFGLKGSEDLGGGLHAVFKLEQGFLLNNGAQAFSGDGFGSQAWVGLQSDPFGTLTFGRQFDVMNDLVGPLTAEFNTWGGSMAAHPFENDNLSANSVVINNSVKYASPTYRGVTFETMYSFSNKAGDFGNNRSYGFGISYAQGPLNLAAGYLQLNNAGDGSGAVTSGDASANFLAQRQRIWSLGGNYTFGPATVGLVWSHSQIDNASGVFSFGTGSYLGAGDTSAGSLNGSLRLDNYEVNAKYALTPAVTVSGAYTYTHGAYNGSSPGWNTAMLQTDYAISKRTDFYLEGVYQNVHGAPADSVLSHAMINTLSPSATNTQVAVTVGMRHAF

SEQ ID NO: 15466 - protein, 767 aa, Ralstonia metallidurans
MKLGLAGVNAGRSSVVNALLLTSALIAPAVWPSSQAAAQDAKPQATQLPAVEVAAPEASRRQAQPARDRNRAAAGPSRRSAQAPQPAQPVQRPVFERGTDPVPGFVPSVSASGTKTDTKLIETPQSVSVISRDNLDARGIDTVAQALQYTAGVAVQTFGGDPRYDQARIRGFETNGFSNFRDGLRDTANGSAYFSVFRNEPYGVQRIDVVKGPSSVMYGQSPPGGLIDLISKRPTDQAFGEVVGLVGSADRLQGAFDVGGPIDKDKTVLYRLTGVLRDSDAQVAKFSDKVKDDRAYIAPAVTWRPTNDTTLTILSDYQHDVTGIASPLSVATVRGGKVVNMRALPLFLGDPSYNTFDQSQYRVGYQFEHRFSDDLIVRSRARYGHVDLEYRSITQAGTPLDTQTVFPRNARRVLENSDSFGIDNHVIAKTWTGPLQHTVLIGTDYQAFKLDGESFGGLAPSLDVLNPVYGQPVTMPTLRLQSYKQNLNQAGVYLQDQIKLQNWILTLGGRYDAAQQTILNRLTGVPQPNDDTAFTKRAGLTYLFDNGLAPYVSYSESFLPTGGVDFNSNAFKPTKGKQYEGGIKFQPNRDLLFTAAVFDLTQDNVLTADPNHLNYNIQTGQVNSRGLELEMLAKPMPGLNLLASYTLQNLKNTQSNNGDVGKMPVLIPRHMASAFADYTLQSGPLAGWGFGAGFRYIGESYMDILNTLTNDAYTVFDAGLHYRQPKGINLALNVKNIANKDNAMCTATGGCQYISPRVITATASYRW

SEQ ID NO: 15467 - protein, 726 aa, Rhizobium leguminosarum bv. viciae
MARVFLNVSNNVSRIYRDSLFVTTAIVLIGIAASPAASQSATDASATALEPIVIQGGAASDSKADRTSVAAKNSSAATKINTPLVETPRSVSVTTEKEIEQRGAQSIIEAVRYSAGVTTGPNGFDPRFDQIFIRGFNITTVGDYRDSLRQPYINYGMFRTDPYQLQRVEVIKGPVSVLYGSGSPGGLVNKISKLPTEEPIHEVGISYSTKDRAQAMFDFGGPISEGNDDFLYRIVGLARHGDNNFDIADDRYFLAPSFTWKPDEGTSFTLYGLAQSDETDANVGAITTVDGKILDIRQSDPDYDYQKVKQQQIGYQFEHEFDNGLTFRQNLRYSHLDLRARYLGVSSWTGTVAHRNASSIRDEMNVFQVDNQLEAKFDTGPLAHTMLFGLDYTNLQSNWGYGIGAVNSAFDFDIANPTYGVSGATPAYDFIVADADMRQVGVYALDQIEAGNWRFNLGGRQTWVNQTRDTTYPSFGLNDSEDVNKNAFSWQAGALYLFDNGIAPFVSYATSFDPVTNRSASGKILEPTEGEQYELGVKYQPPGTDILLSAVAYHIVEKNKPVLVNPLTLAYDSLGEVTGKGIELEARAAIADGLDIIAAYTYNHSEVTGGDNEGNTPAFTPAHVASLWANYTFQETNPFNGLSVGAGVRYVSENWTDTANTSKNPSSFYVDASAAYDFGAIDKNYEGLTAAFNIRNIADQRDTVCNEGFCYLGQGRNMTATLKYRW

SEQ ID NO: 15468 - protein, 236 aa, Rhizobium leguminosarum bv. viciae
MTVGIDSRNDIPEGIATLGAFMGYSHSHIGFDRGGHGSVDSYSLGGYASWEHESGFYLDGVVKLNRFESNVAGKMSSGGAANGSYHSNGLGGHIETGMRFTDGNWNLTPYASLTGFTADNPEYHLSNGMESKSVDTRSIYRELGATLSYNMRLGNGMEVEPWLKAAVRKEFVDDNRVKVNSDGNFVNDLSGRRGIYQAGIKASFSSTLSGHLGVGYSNGAGMESPWNAVAGVNWSF

SEQ ID NO: 15469 - protein, 802 aa, Rhizobium leguminosarum bv. viciae
MLVRPSLLALSLTGSLLVVTPAWAIAYDIPAGSLAASLSQFAAASGVMITFSSQDTAGLRSPGLQGDYELEQGFARLLQGSGLRVVQAGEKRYVLARADSSGAMELGATNIDAAGLGAVTEGTGSYTTGSSNSSTKLALSLRETPQTVSVMTRQRIEDQQLNTLSDVLKQTPGLNVQNIDSERVNIYSRGYSIDNYQFDGIPTTLIVQTSASPQSMIDTSIYDRVEIVRGATGLMTGAGDPSGSVNLIRKRPTANFQGAVSAGAGSWDTYRSEVDLSGPLTADARLRGRAVVAYQQGNSYIDHYQQEKQTYYGILEADLSDSTLLTVGFDYQKNDPRGVSFASFPLFYDDGEQTDFSRSTNAASRWSYRQQNTLNTFATLEQDLVNDWKLKVSVNNMYSTRDYSLASASGGFPNKQTGEGAYLYGGDGYGSQRQLGIDAIVQGPFQLLGRQHELLAGVSGSAFHDYSNPDDDDLEMKPVNIYDWDNNTDRPVSVGKLMNDDTTIRQDAAYMVARFKPTDDLSLILGARVGDYSYKKKAIYNAPYTRSTNHQATRESGFVTPYAGVVYDLNAQHSVYASYTKIYKPQSLRDSSGATLEPREGDNYEIGLKSELLDGRVNTAIALYQIKQDNLGVLSGGFVEGTDRERAYKAVSGATTRGIDLEVFGEITPGWNVTASYSHSLTKDADHERINTIAPANMVKLWTTYRLPGELNRLTVGGGMNWQSGLSLTDAPWQIGHTVKATQGQYAVFNLMARYDVTQHLTATVNVNNLFDKKYLSALDPTFYTGFYGEPRNVMLSTKYSF

SEQ ID NO: 15470 - protein, 1777 aa, Rhizobium leguminosarum bv. viciae
MSITGKLKSVLLTYSFIISISINLFTTGSEAAGNPPPPPPPPPLPPPGWTYQAASSNNTGSGGQTTQPESSKSTGSSKKSSSSTKIPEVHPPTTELGKRYAKLIDIHDRKQNLIIQFPKVIAYLIRQELTLQNLDTSVHNIITLFNKREDSILDNAKKIYQEFINDPYIAQFTNKNKQTGDFLDNKLFEESHEEAILRLLSLEQLDAQRKQDILSQQGNILEQLKFIKENSEILGSYGKTESTNISKKLPEELPKILSQQGDILGQLRFIKENSEILGAYGKTVSTDISKKLPKELPKILSQQGDILGQLKFINDNSEILLCGHSKAILKDKLKELSKQLDTISSNQLVGFILDENKINTNLKNVPFSAKKVREQVNNLNNEILEKIFLHDDGTITEQDLTRILQKYKETDLIKNLTKAIIYIDGNESNETVSKTLAKGLENTTPEQRGLIVDVLTHNTRIRKALITKIDRERRQERNQKLNKNTEGDPFVDALKKALVQRKSDPETIQKELERRKHETPRDLNAWDRVRQNMHNPNNQNDNPNTHDENNKGWKEDNQNAQDANNNDVDRITKAKNELEQAVNAATRKFSEMSSLLKDNTIKNATACQGYLKGAEDQLALAKEKGQELIENSVQAFKIIPKKSQDNMDDNWQNYLSPKEIIALNALSDETNTLKSKKNKAGKFTSTADASQFKAKQQKYHTLLSELQKIGIAKQQEKLVKDYVDEMLTNAKKAVGKIETTLEYLNKKKENKNDNAESSPLISKEIFEAREQLKKAEQKLERIKFKNTIAKQRKADSSDEDSDDEWDDDYDKKATKQKEELANKQKQELEDAQEEIKQAKKNLENAEVRDAERKQQEAAAKRQEELKRKQDEVNHKIVEDEVERKAENAQAERLEDMDAMFKNAKDEAEHKEKANRQRQEELKRKQDEVNRKIVEDEVKRKAENVQAERLEDMDAVFKNAKDEAEHKEKANRQRQEELKRKQDEVNRKIVEDEVERKAENAQAERLEDMDAMFKNAKDEAEYKEKANRQRQDEVNRKIVEDEVERKAENAQAERLEDMDAMFKNAKDEAEHKEKANRQRQEELKRKQDEVNHKIVEDEVERKAENAQAERLEDMDAMFKNAKDEAEHKEKANRQRQEELKRKQDEVNRKIVEDEVKRKAENVQAERLEDMDAVFKNAKDEAEHKEKANRQRQEELKRKQDEVNRKIVEDEVERKAENAQAERLEDMAAMFKNAKDEAEYKEKANRQRQDEVNRKIVEDEVERKAENAQAERLEDMDAMFKNAKDEAEHKEKANRQRQEELKRKQDEVNCKMVEDEVERKAENAEDEYLEDMAAMFKNAEDEAEYKEKANRQRQDEVNRKMVEDEVERKAENAEDEAEHKENENRQRQEEQNCQEQERKRLAAEEDEQTEKTTRKQEETEEEKLKNDIALEGEDEDIGVSFKTEAIVEQDEAAQRQQVSDDTSRKVAILVKATSTLHKPVHHNILSDRLKVSAIATGDEEPTIARGVWISGLYGMNKQGTWKNIPKYQGRTTGITIGADIEFINSHDVIGIAYSRLESKIKYNEKLGKTAVNVHLFSIYGLKELNKGFSLQAITSYGHNYIKNKSKSINNIVGKYQNNNFSFQTLLNYKYRTKDDLHFIPNIGFKYDYSRASSYKEYNVDIENLVIQKKSNQLFESSIGGKIVFKPIATISNVVLTPSLYGNIERHFNHKNTKVNAKATFKGQILQETIIIPKQPKLGYNIGSNMLMSRKNINVLLEYNYYTHRKYQSHQGLVKLKVNL

SEQ ID NO: 15471 - protein, 402 aa, Rhizobium leguminosarum bv. viciae
MGSMASMARAATVEELQQQVDELRNQVKAIKAPAPSAESGGDGYAKKVWDNTRFGGYGELDYIVTRENGNGKGSNAFDPHRFVLYVNSDLSDWITLNTELEWEHGGVGGDVKDGKKLSGEVLVEQAFLQFKLSRPLNLKAGIMLVPLGATNLYHEPTNFNSSERPQLDRYLIPSTWSEMGAGIYGSLGTKVDYELLVMNGLDGAGFSAKDGVRGGRQNLNADVNRNKAVAGRLEVRPFTNLYTNFSFYTANSAKVGTAYTTIAAFDGKYSIGDLDLAGEYVHVYQDDPRALGVTDIGHNMSGYWVEGAYHVLPKSLKKGKLSEADALIFARYSEFDTQQGSIGDPSKASGKYDRNYTNFGIVFKPTTTLSVKADYQVYDDHRKAGEKALDNDKFQVTLGFVF

SEQ ID NO: 15472 - protein, 923 aa, Rhizobium leguminosarum bv. viciae
MIVRCSLLRPSRLSQALCLSLCALCGHAAAQETQSTTPAQGDMATLDKVTVAATRYNATDMQMAATNTVNVLSADDLKTTAVHNVAEALGLMPGVNVINTGQSYFGGIDGAARGEGMFSSVRGLNAEYNVNLINGINVAQGMPYSRGVQLSLLPPSGLQTIVLNKTSTADMDGDAIGGTIDYRTPSAFDSPDRQGGSVTLSGRLESRARDYGDSGLGSGAAGDWHARFGGAGQFGVSVSAYYDERHFVNSEVASASAARNDGAWKFARADASGNLAAGADPQEVLQSTGINIGYSQGQTRRYGGNAAFDWRVDPSLHLYARMTYAFAKTEQNTGYTQFVPANVSFTQIGSSGVYQPQINRVAVRYWYETNPEEADLATVQFGAEKQLGHWTFAPNIFYGTGNNDRPDHVEISARNDQYSSTNFAYGANRFISYDGDGFPVPLLTPAMQAQASDVGSLYARRTGQISKQYSGQDKGGGKFDVAYDFDAGLLSRIAFGVKYVDSSRSFTDRDWTNAKYTDGTLLRDTGLIAQRYDAVYPGQYAFPTVRLSNAALNDLIARTLTPASFDSCGQLAINNLNCNTMRATEAVSAAYAMATLRAGNWEILPGVRFEHTAITNTFWAQPAAINGAEQVGAFANNHTRYNVALPSVFVNYRPDGDGAVYRGSVWTSYTRPAFVQLGGGRSTDISSDGQTTITEGNPDLKPIKSLNVDLSGEWQNDSGGHAMLAGYYKRLTDYIYESGSNAANAGESESGNIRFVRPQNGGDGRVLGMEAAVRQTFQGLPAPLDGFGIGANITRQTTRVDLGEEGFAHERIQNAPNLLANAELFYEKGPWSVNLSYHYSGEYVSVYDYLNQGANWDNLWIKPITRVDLHLGYAPNDHLRVDLSVANLTKQHSYWAHVGHDTDAISDIVDSGMTSLLTAKYVF

SEQ ID NO: 15473 - protein, 746 aa, Rhizobium leguminosarum bv. viciae
MLGQYFCRIRKIILISIVLFPLLVRLIDKHNKNDDGEGMTTLRVFRKTTPLVYTIRLSLLPLAGLSLSAFATQVDIAPGSLDKEDVLTVVGDWLGDARENDVFEHAGARDVIRREDSAKTGATTIRDVLNRIPGVTAPENNGTGSHDLAMNFGIRGLTPRLASRSTVLMDGIPVPFAPYGQPQLSLAPVSLGNMDAIDVVRGGGAVRYGPQSVGGVVNFVTRTIPQDFGIEAGVEGQLSPTSSQNNPKETHNLMVGGTADNGFGTALLYSGTRGSDWREHSATRIDDLMLKSKYAPNEVHTFNSLLQYYDGEADMPGGLSRADYNADRWLSTRHYDRFWGRRKLASLGYQFQPDSQHKFNIQGFYTETLRSGYLEQGKHITLSPRNYWVRGIEPRYSQSFMVGPSAHEVGVGYRYVNESTHEMRYYTATSSGQLPSSSSPYNRDTRSGTEAHAWYLDDEIDIGNWSITLGMRFEHIESYQNNAIKGTHKEVSYNAPLPALNVLYHLTDSWNLYANTEGSFGTVQYSQIGKAVQSGNVEPEKARTWELGTRYDDGALTAEMGLFLINFNNQYHSNQTNDTVTARGKTRHTGLETLVRYDLGTLTPTLDNVSVYASYAYVNAEIREKGDTYGNQVPFSPKHKGTLGVDYKLGSWTFNLNSDFQSSQFADNANTVKESADGSTGRIPGFMLWGASVAYDFGPQMADLNLAFGVKNIFDQDYFIRSYDDNNKGIYAGQPRTLYMQGALKF

SEQ ID NO: 15474 - protein, 421 aa, Rhizobium leguminosarum bv. viciae
MASRRFSKGVTSLVLLSSLASPAFAGGLERGGYNIDQLFDTSPFSFQSGVTYVTPQRKLKDVSDTNTSVLTGGGNLNTRPNSADESSNYTIPYIGFKAGFADAVDCLVDYSEPFGGHTDPGSNWAGANNNIETEIKTRNYGGTCSYRFDMGPGQLRFIGGAFYQEVEGFKERLVSTLPLLLGTGTGVGRLDLEDSGWGWRAGVAYEIPEYAMRASLVYNSRVKYDNLTGTVDLRQVPIVPIYGGKITNVFGSAEAPDSLEMKLQSGIAPDWLAFGSVKWTNWSVLQSVPFCPTSTKGVAACTAGGATELTSLDLLYRDGWTISGGVGHKFNDQWAGAVSVTWDRGTSQGYGAQTDSWTLGLGAAYTPTEHIEWRFAGAVGVLTSGSSGTFEYNGQTYGDDVSYSFGNDLVAALSTSLKIKF

SEQ ID NO: 15475 - protein, 609 aa, Rhizobium leguminosarum bv. viciae
MRIYMQNIRLMASVIGLSSALLVTGVASASTSSSETSENLEASAVDVPASSLVSQQQPLLVADNTPAVSDLMAETEADSVGQVTSVSQLSDVQPDDWAFQAIQSLVERYGCVAGYPNGTFRPSRAMSRREAAALVNACLDNLSNRFATKEDLDALKALQDEFAAELATLRGRVDGLEARVATVEAQQFSTTTKLQAQVVMAAQFGDFVDNPGDNIPTPNAAATGVAAVDTGVPGIANVDPGDSRVSAISRVRMSFLTSFNGDDVLDLTLETGNGGSDFFSSAGVAGPANFFPVPPVVGAGTATTLGDPGVVDYTGSGPGVTLYNLGYTFKPVENLAVTVGPLIYPSAFIDGNSYANDEAADFSSGFFINNPLIISEAIDGPGGAGAAFDWNVNGGPLSVRGLFIAADAGIAAGNGVNACADPLNTCEGGLFGDPFQASAEIEYSSDFGEDDQNNFAIRAQFTHAETYNVNQNIIGANVELTLGQFGIFGRYGISIDPQLTFGGVNNDLFQNVLPVGNNSSIQTWMAGVGVNDLLVPGSLLAVAAGQPFIVSTTDPNYSAQTNFEAFYRFPVNENITITPTVMLITNPFNVSNGNPNDIIQGLVRATFSF

SEQ ID NO: 15476 - protein, 211 aa, Rhizobium leguminosarum bv. viciae
MRVLIAGLMASVFAIAGLSAAQAADAVDQIPEAPVAQDAPVKPAGNWEGFYLGGAGTYNMGDFGSDRHTYGFGGQVFTGYNWQQGQIVYGVESDLGYSGDDVSSGGVKNKYGWNGSVRGRVGYDMNPFLLYGTAGLAIGDVKVSDDTSDESKTNFGYTVGAGVEAFVTNNITTRLEYRYTDYQSKDYDLDSGSFSRGYDENSVKLGIGVKF

SEQ ID NO: 15477 - protein, 806 aa, Rhizobium leguminosarum bv. viciae
MHIRLTPLAATLRPVIIGLSVASTSLPLLAAETGAAVTDHQQRDYAIAPGNLDQVLGIFGQQSASMIAIDANLSAGKRSTGLNGRFSVAEGLQRLLKPLGLQAVAEGAGYRVIQASGGERVELGATTVTTNQLGTVTEGSSSYTPGTIATATRLVLTPRETPQSISVVTRQAMDDFGLNSIDEVMRHTPGITVATYDSDRTSYYSRGFAIQNFQYDGIPILQDAQYSSGHTLTDTVIYDRVEILKGATGLLTGAGGPGGTINMVRKKPTAEFAGHIDLGAGSWDNYRSQVDVSGPLTDSGNVRGRMVAAYQDKKSFLDHYQRQTSVYYGILEFDLSPDTLLTVGADYQDNDPKGSSWSGSSSLYDSKGNAISTSRSYNNGASWSRWSQYTRTAFTTLEHSFANGWVAKAQYNHQINGYNAPLGSLMSPNAETGIASLLTRKYTGETVSDSGDLYATGPFDLLGREHQLVVGASISNSHWKGRDFTSATNHNNFYDYFNWDGHSPKPDWGRITKKNDETTRQSAGYMTARFSLNDDLSLLLGSRVNNYEVSGTSRTKDTGKVIPYAGVVYDLGQNFSVYASYTEIYLPQDDYRDRNDKVLKPDEGTNYEVGLKGEFFDGRLNSSLAYFEVHEENRPVDDLAYNANPTTPGLDYASKGIKSKAKGYEAEVSGELAPGWQLQAGYTHKIIRDQSGAKVSTWEPEDQVNLYTSYKLTGSLDKLTLGSGVRWQGTGWKILSNYGKGTEEKFAQAPYWLVDLMARYQITENVSATLNVNNLFDKKYFTNIGFYNSSYYGDPRNVMLSTRWNF

SEQ ID NO: 15478 - protein, 861 aa, Rhizobium leguminosarum bv. viciae
MSPDKAIAQTNPETNQLAQAQPATITGIRLDTRPNRVNIILETAAGQPLTLPGQPFIQRGTDLVATIEPAILTLPDGQTWQFTAPTADIAAITVEQQGGDRLEIIVQGQGELPTTAVSLETMATIATKDDMADLTEMPLDLDAMPVEELEITVLGTRSPRLVSRTPGSISVIDAEEIDDNLVQDLRDLVRYEPNVSVGNDRRYGLQDVNIRGLGGNRVLILNDGIRIPTQFTFGTPALGRDYVDLDSLQRVEIIRGPASALYGSDALGGVVSFQTIDPSDLLALTDKNNFTRISTGFETTDKSLNYGAVTAFRADSLEALIGYTGRSGFEARLPEGNEFVDDRYGDRDNFLGKLNFKLSENSTLGFTTEIFRSTNEFQVAPITAALLQGPRGFQGQNETLEADSYRERYSLAYLYDNPDGEGFIDNAKLQVYYQNAGVDELRTQDFLNFAGTERRFRNLSNTFTDELFGGEVQLQSNFRWGKIDNRLTYGFDLSKTNNERTRDGLETRFDSTGNVTSTTNQVGSDNFPVKDFPDSETTRFGVYLQNEMALSDTFTLLPGLRYDTYRLDTTIDELYQRNSPDAEAADFSDSALSPNLGFVWQTSPEIALVGRYARGFRSPLYSEINAGFTNLTSPFFRYKTLSNPNLKPETSDTFELGIRGDFPRGNFSVTGFYSYYENFIETFANAGTTLINGNLVNLFQSQNVGAARTYGVELAGEYRFSEQPHGFSLIGSLGLTVGDDLEDDEPLESVEPLKAVLGLRYRAKEDRWGTDLIATLVGEPRLRGDRPAGSYSPEGYAVVDLLGYYNINPNLKLNAGIFNLFNNQYFLYSDVRPLLNSPEPVDIARYAQPGISLRAGLTWQF

SEQ ID NO: 15479 - protein, 812 aa, Rhizobium leguminosarum bv. viciae
MRLIAFPASRAWLGSTAPTSRLSPHAHLRRLALALSRSKPLPTAMTHITSRKHAPRVSLLATATLAAGFAPLAAQAADGADAGSRNATELDKVQVRGSWFNPSSPKFTAELLDTPKSVSIVSEKLIAETGATNLQDALRMVPGITFGAGEGGNPTGDRPFIRGFDSQSNVFVDGLRDVGSQTREIFDLEQVEVVKGPSSAYGGRDSGGGSLNLVSKTPKLKNETSASMGIGTDSYARGTVDANYVLGDGIAARLNLMKHESDIAGRDAANVSRWGIAPSIAFGLNGPAQLIASHYHMQSDDLPDAGGFPYSNPFSSGPNVAKNGDGRPMVPDRNNYYGLVDRDFQRTRADISTLDASYDFGGHKLRNIARLGNTSNDYLWTQPDDSKGNPNLYGTLWRRTNTRAVDVKSFADQLGLTGAFQTGALKHSYSAGVEYSDEKMTRGSYLMSPGTANPLENSANSTRCQVSGAATGYNCTDFNNPNPNDPWAAGQIVYRSDKALDVEQRTKTTSAYVFDTIELNEQWMINLGLRYDDFRTTLTTPVAGKAPTRVRNSNDFLNYQAGVVFKPAANGSIYLSWGTSSTPPGMDGGDGSDGLSAAVADLKPQDTRNLELGTKWDLFDKRLNLTAAIFHTVMNNARVTIDNGTSQNAGKKEINGFELGFTGQLTDAWSLYGGYTYLDSELKDNGFVCGAPVGRTCPSNVYVPSPNNGNVFPNTAKHSANLWTTYRFPIGLTIGAGAFYSDKQYGDVANTKWIASYTRFDAMASYAIQDNISLQLNVQNLTDKTYFTKAYASHYASIAPGRSATLALNVKF

SEQ ID NO: 15480 - protein, 505 aa, Lawsonia intracellularis
MSIWQIPTNPAQTKPYTSKGGLQLGDKGTLYTRLGKLLKVDGTAITDGKLYMSARGKGAGYLNSTGRHVPFLSAAKIGQDYSFFKNIETDGGLLASLDSVEKTAGSEGDTPSYYVRRGNAARTASAAAHSAPAGLKHAVEQGGSNLENLMVELDASESSATPETVETAVADRTDMPGIRLRRTTFRTAAAVQHANTADGVRIFNSLAATVYADSAAAHADMQGRRLKAVSDGLDHNGTGLRVIAQTQQDGGTWKQGGVEGKMRGSTQTIGIAAKTGENTTAAATLGIGRSTWSENSANAKTDSISLFAGIRHDVGDIGYLKGLFSYGRYKNSISRSTGADEYAEGSVNGTLMQLGALGGVNVPFAATGDLTVEGGLRHDLLKQDAFAEKGSALGWSGNSLTEGTLVGLAGLKLSQPLSDKAVLSATAGVERDLNGRDYAVTGGFTGAAAATGKTGARNMPHTRRVAGLGVDVEFGNGWNGLARYSYTGSKQYGNHSGQIGVGYRF

SEQ ID NO: 15481 - protein, 381 aa, Lawsonia intracellularis
MKNLISLGVFLLILLSVQVNAQEQSVLKIRPTGRILMDGGLFHSDNKNFVDGVAIPDARIGVKATYGKYKAKVDIGYAYGKVSLKDIFVERQFSSHALLRVGNFVHQFGLQSSTSSSMKVTMEEPASNEAFFNSRLMGAMFVYDKNDFFGTASVHVESEALKKKSNELGKMGYGAMSRLVYRPLHDTGRLFQLGISGAYETPRYNSEPTLNHTSFDLGANFPTRIAKVRAVNALIPDAKNLIKFTPEMIAGYGPVALEAQYYYLQVNRKKDFKNYKASGMYGILRGLLIGGNYRYSHTDCGIATPDSGSLECVFGYNYTDMSDTRSHIYGGRLNDVSFTVNYYINKYMIWRFRYSYTKITDRVGFENQSLSAFQTRFQVIF

SEQ ID NO: 15482 - protein, 210 aa, Lawsonia intracellularis
MKNYRAGVAAIALVAGFSVTPAHAEFTGKSAGDFMVRARAIAVIPDEDASTTIGGNVSIDNDVVPEVDFTYFVTDSIALELIAATTKHDVSHNAGIDLGEVSLLPPTLTLQYHFMPKERFSPYVGAGLNYTIFYNEDVAAGSPVTSIDYDNAFGYALQVGADYALNDNWYANVDVKKLFLSTDVSMNGGAITADVDIDPWIVGVGVGYRF

SEQ ID NO: 15483 - protein, 985 aa, Lawsonia intracellularis
MLFKKKILSSSVALALVGAAIPAYAQDGVLIEEVIVQGGIRGSLTRSMDVKRDSAGVVDAISAEDMGKFPDANLAESLQRITGVSINRQRGEGSQVTVRGFGPEYNLVTLNGRQMPTHSNTSRSFDFGDLASEGIAGVQVYKTGRADVPTGGIGSLINISTTRPLESPGQTASFSAKLVNDTSTREGDEITPEFSGIYSNTFANDTIGIAITATSQTRNNGVNAAETTGWFTNPGDYSGARGVPNDANQVNRSTSDAEFYSIPQQLAYSISEYESKRINGQLVLQWAPTDTITGTLDYIHSELDLDHTMSDMSAWFSNANASSQTSLWNDGEQRSPLMYSETHDNADFAMGVHEMGRKNENSSVGLNLEWQASDRLNIALDYHDSSAETGANTPYGTSSLVTMASFNKVGSTVFYDTELPILSQNLNSGADGADRPLYKNDMIITGSVFSNEAAKMDIEQAKLSGVFELSESTSIDFGVQLTEVSNRFVSSNVQLDNWGGFTQPGELTDILTRSSIAGQFDQVDGGNDPRLHTEYFTTSLEEIISVGEASYTARGADYAAVGDCGTGYCASTDWTVDKRTTEETSSAYIQLNSALEYYDMPVNLQVGLRYEETDVTSAALAPTYDEVFWLGGNEFTMVAAVDENGDPIQAFDDYVGDYSLLLPSIDMDIEVAENVIVRASYSQTATRPSFTDVQGGITVGGTSFKNDGGFANGGNPGLIPIESDNYDVSVEWYYDEGSYLSVGYFEKSVANFIGSSVRKGETLFNLNFPLEGALFNQAVADSGIDPLKYSEVGAYILANYPDNAAIDGDRIYGVDGDPLVTFQITSPANQENASVDGVEINLQHNFGETGFGMIANATFVNADVAYNNMQIDSQFVLNGLSDSANLVAFYDKDGLQARLAYNWRDEFLAGVGQGAGTTTNPTNVEAYGQLDISASYDYSDNLTIFFAGLNVLEETYNVYGRDELQVLQAGQTGARYDIGVRYSFK

SEQ ID NO: 15484 - protein, 902 aa, Lawsonia intracellularis
MLTGKRLAGLLLLTTSLTFPTVLHAQSTDTNETDELAQDVQQDPQDEQVEEPDISVPGGSGIIVTGRRNRNPERSSTQVLNVLSEADIARTGEGDIAGALGRVTGLSLVGDGRVFVRGLGDRYSLALLNGLPLPSPEPLSRVVPLDIFPTNVIASSLVQKTYSANYPGEFGGGVINLTTKAVPVEDFLSVSFGISGDSETTFENGLTYFGSDLDSFGFDNGNRDIPSNLQAFFDSGERIGTVDLATSEGIAGQLFPLNLVTLQRDNSQRPNFSGSITGGLSFELGDDTFLGVIATASIKNSLRNRQVLSQRGNNDLSEVFETSETFITDENILVNGLLGFGLDFGPHTVRWTNLYIRDTLKTARLEEAFDPFPGETGFDFINQQTAWFERQLMDTQLVAELDFDRLSVDLRGGYARTDREAPFNTTFSYTRTNFTGNQFGDLFVAYFNQLSDAGITTVAFDDLQEELWYGGIDLGYEITDNFEATVGYAYSDTDRRSESREFRPFISPDPANVDLGLNETAAVALGLRRPGDIINGATLSGFNVNLTEATPFPVFDAALETQAGYGLVRWLPTDTLTLEAGLRYEDASQVVALDQSVFNTPIAGATPTDIFNDYFLPSGTITWEPIPDFQLRASASQTIARPQFRELVEQRYFDPESNRLFQGNPLLQDSELINAEVRAEYYMGGPNRVSLAGFYKEIDNPIESTFNVASGQVFTSFANAPSAELYGLELDAVYGIDLYGMGGSFWETKQLLFIANYTYTQSELSVSDTDIAPVPGNANQLASLIFDDGAPLVGQSDHLANISIGIEDTEKTQQLSVLFNYASERVTQRAGAQPDFVEDPGLTIDIVARTELQLGVPMELSFEVRNITGRDNFEFQELGANRVEFNTFDVGTSFSLGIKADF

SEQ ID NO: 15485 - protein, 1080 aa, Lawsonia intracellularis
MKKLMQILFALMFLCAQTYAQDRNIKGTVRSKTDGKPIPGVTVRIKGTQQGSMTNSAGQYALIVPSQAKTLEATYIGFQPQSVTIGSSEVIDIVLSEDAQQLEQVVVTALGISRKKNELPFAAQEVKSEEITRTRNNNLVNSLGGKVAGLDIKRSNAMGGSTNVVIRGSKSIGGNNQALFVVDGVPVSNASPNTLNQSTGRAGYDFGNAAADINPDDVASMTVLKGAAATALYGSRAANGVIIITTKKGRKNSTNITINSGVTFGKIDKSTFVEYQKEYGQGYNSPAEDGEGNPVPTPGFWYRDVFGTGKVMTPQFSSDASYGPRFDPNLMIYQWSSLDPFSPNYGKATPWVAAGTDPSSFYKGSVSSNQSVSLDGGGDKSTYKIGYTRNDETGVLPNSKITKNLFNVGGSYEITKDLTIASAVNYSRIDGLGRFGTGYAGINPNQGFRQWWNVGADINELKEAYERNGQNISWNWSDATGTKPIYADNPYFNRYENFENDTRDHYFGNASLSYKANDWFDVVGRVSYDGTFDIQEERIAVGSTDVAAYSRTNGTFAETNYDLLMNFNKNISEDFSFKGLLGANLRRSKLTNINAKTNGGLVVPNLYALSNSVSPIEAPVELYERRAVDGYFASTTFGYKDLVFLDATIRRDQSTTLPTNKNVFWYPSVAGSFVFSNLLKDLSWLSYGKLRLNYAEVGNDAPPLSVFDTYLKPTAFGSIPMFSIADTKNNANLRPERTKNIEAGLETSFLNNRLGLDLTLYKTNTIDQITAVPVTTATGYLKLFVNAGEVQNKGIELSAYLVPIKTRDFSWTMNLNWSLNRSKVLSLYENVTNIELNALSLSGGVTYNAAIGQPYGVIRGTDYVYRDGQPVINADGYYEATESSAMIIGDPNADWMGGIGNTFTYKNMSLNFLIDIRKGGDLWSLDQWYGLGTGLYPETAGLNDLGNPVRNSLANGGGIILPGVLADGTPNTQRIDVSNSGVAAYGYPNNPPRASTIYDAGYIKLRELALTYSLPEKLVSKIRPFKGIDVSLIGRNLWIIHKNVPYADPEDGLGSGNVQGYQSGSYPAVRNYGFNVKFKL

SEQ ID NO: 15486 - protein, 1028 aa, Lawsonia intracellularis
MIKDVLKLLLVICLFGFQSMQAQTTVKGTITDAQSGIPIPGANVVVKGTKTSTSSDFDGKYTITVPNQSAVLVFSYVGSASKEVAVGTQTTINAALGAATQQLGEVVVTALGIKREKKAITYSAQNVAVGELSEARSLNVANSLSGKVAGLNFSTTSNGVGSSSRITLRGNRSLNGNNQPLYVVDGVPISNGTTTTNPDIDTGGTTQPDGISNINPEDIASMTVLKGPSAAALYGSRASNGVIVITTKSGKAGKTSVSLSSNFMASSAYNLMNLQNEYGQGTNGNYVSNSSSSWGAPLDGRQVSAWQLVRNPNYTGPATQSYSPQPNNVIDFYKTGYNLANTLTVTAGNEKAQGYFSYTNTRAEGIVGGNAMDRHNLNLRLTSKISDKLSLDVKTNYIVQDIDNLLRTGEESIGTSAYLLPRSIAYNDYKNFEYIDAAGQRQVNYFLDETGAPGGNPFWSALRDDARTDKRNRFIGLASLKYEFTKTLSLQGRAGLDQMTNKNVRNRYATNAFNSNMGSYSESYETVSELNVDALLSYNQKFGDFSIGLNAGANSLQQNSSALNSGGVLSKRNFFALSNVQTIQSTSTASEKRINSVYGFGQIGFRNYLFLDVTARNDWSSTLPNDYFYPSFGLSAVISDMAKLPEVISFAKVRASYAQVGNDTDPYQTQQRFSYIGGNGGMLYGQSTQANPNLKPEISSSTEFGADVRFFNNRLGLDFTYFNTLTNNQIFYINTPESSSFSRAIVNGGDIENKGIEVTLTATPVQTENFTWDITANYASYKSKVKSIYEGRDELVLGEGRLVRSKVVVGGEYGDLYIKGFQRDPNGNIIVNSAGIPLATNGFDVRAGNFNPDWTGGLKNNFKYKDFSLSFLVDFRIGGEVISYTQARQAGLGVSDITLAGRQGGIVVDGVVAAGNGTYTPNTTSITAEQYWTAIGQRTPVAEPFIYDATNIRLRELVFGYSLPKRLLGDSGFSSIDFSLVGRNLFFFVNKAKYFDPEAGAGTGNLQGIESFNIPSTRDYGVNVKFGF

SEQ ID NO: 15487 - protein, 831 aa, Lawsonia intracellularis
MNNHLCHWSALTILGVTGIAILNAAPVIAETQDFEVLPPTIEISSENADVLTDVQVQATESGLVITFETTAEALPAVTTTTVGDRLIIEIPDVILSLPGENIVEVLQPTAEIESVQISPGENGGGQLIITGLTAPPMVAPRLEGKQLILEVTPDESIAENLELVVTADRTANSYTVSEATTATRTDTPLAEIPQSIQVIPKAILADQGVSSLDDALRNASGVLQNSADARGQRFVVRGFDSASVLWDGFRPTFGFSGNIGYPELANIEQVEVLKGPAAILYGVSEPGGVINLVSEKPLSEPVYEATLELGNRNQVAVGVDLSGPLNEDGNLLYRLNALYRNSDYYRNFNVDLERTFIAPTLTWQIGDRTDLDLFVEYSADQRPYDTGLVAIGDSVADIPFDRNLSQLDDINEATYWRTGYEFEHRFSDNWKVRNGFNYIAYNTIFESSFTLGFDPTTGDLDRSYIQLDQPSSTYAVQTNVVGEFSTGAVDHTVLMGVDYIHRNQLGNKLRGFGPDSYFTQNIFNPVYGVVPQPDFETQPIIRFGDTYINAVGIYLQDQMDIGDRLHILAGLRYDTVSQRVVNPTSLTETTQNDDAFVPRLGVVYRPIEPISLYTSYSQSFAPNSGTNVDGDTLPPEVGEQFEVGVRAEALEGALVANLAYFDIRKNNVATSDPDNIGFSINAGQQRSQGIELDVMGEILPGWKIVANYAYTDARVTANNDGQAGNRLINSPYHSANLWTTYELQTGSLKGLSFGVGVNYVGDRFGDLNNSFSLGDYFLTNAAIAYRQDNWRAALNFRNLFDVEHITGTRNNRFEVYPGEGFTVLGTLAVEF

SEQ ID NO: 15488 - protein, 1035 aa, Lawsonia intracellularis
MLLKTRIIISCCFISLLSFFEEDCYASRPGSKECVKVSSASFTVRGRVIDTYGEPLIGATIREKGGANGTVTDVEGNFFLFVPDSAVLQISFVGYESQEVSVKGRSMLEVCLKENILLLDHVIVTALGLEKKESSLAYAVQKVRGEELNRVKEVNMITALAGKAAGVQVSKNSSGMGGSAKVSIRGVRSVAGDNQPLYVIDGVPMLNSTSEQAYSAIGGTANAGNRDGGDGISNLNPEDVESISILKGAPAAALYGSQAANGVILITTKKGNTVGRRDIHFSTGLTFEKAFSLPEMQNSYGVSDVTDSWGEKENLTVYDNLGDFFRTGLTSITSVSVNSGNDKLQTYFSYANTTGRGILNENKLSKHNINLRETAVLFNSRLKLDGNVNVMKQTVKNKPVSGGFYMNPLVGLYRFPRGEGLSYYKENYERYDEDRKLNTQNWHTFTEDFEQNPYWIQNRIQSKDARIRLLLSLSANLKVTDWLTLQARGNLDHSADKLRQKFYASTATALCGMNGRYIEMDYQETQMYGDVMAMVKKQLNDFTLDVAIGGSINDRITNSTRIDSKNASLKYANVFNLANIVMSSSASIDQKIDAHYQLQSVFATAQIGYKEGVFLDLTARNDWSSTLAYTKYEKKGFFYPSVGVSFLPDKWVKMPEWVSFSKLRGAYSIVGNGVPPFITYPVSYVTAGGEILASDAAPFAEMKPEMTHSVELGMEWKFLQHRLGLNLTYYRTDTYEQFFKLPALAGDKYAYRYVNAGDIRNQGWEITLDATPVLTPDFTWKTSLNFSANKNKIVELHEELKEFVYGPTSFSSSYAMKLVKGGSIGDIYGKAFIRDEAGSIVYGTDGDYKGLPLVEGDGNTVKVGNANPDFMLGWNHSFSYKGFSLYFLLDWRYGGEVLSQTQAEMDLYGVSKATAQARDKGYVSLEGQQISDVKGFYKNVVGGRAGVTEYYMYDATNLRLREISLSYSFPRKWVQKTNCLKDLQLSFVARNLCFLYKKAPFDPDLVLSTGNDNQGIEVFGMPTTRSLGFTLTCEF

SEQ ID NO: 15489 - protein, 285 aa, Lawsonia intracellularis
MIVDAGLARLATPTPSAAAARPPANPAIDASAIQLARRVFYQMNAAAFAAKGITANQLWQQIKLETSAALDAGLRWTHEVSGLGVFSIEPTGYVSRNDDKGVTYDPGIGIQYAQNVGQSLAYGAQLLGRWKPIDTLDIFASMSYDRNVFVSNPPVLAGASAATVAGANVTGTQLPNVPEWTAALGGTWRYGDFAFTPVANFTGSRWRDTTRTQYLSGYATVDLNFTYQFKLPAAKLEASLTISNLFNAQYIGFMNNSYFQQSTLTNAFYYPGAPRAVVGKIAMKF

SEQ ID NO: 15490 - protein, 757 aa, Lawsonia intracellularis
MYCSGLFGLSFRKYNLTMKTLFFTFMLCVSASLFAHDLNGTVVNQDNERLEDVYVFNQRTSTAVYTDHNGNFKLEDVEVGDIIMLSYIGFKNYTLTITEKDLNRIITISLEQANISLTQVQITPEVNTLNKFVDVDIKTNPVKSSQELMRKVPGVIIGQHAGGGKAEQIFLRGFDVDHGTDVAIGVDGMPVNMVSHAHGQGYADLHFLIPETVDNINFGKGPYTASVGNFNTAGYLNFKTKKRIEESSVSLEYGQFETLRTVGVFNVLDDDNHSAYVAGSLNLTDGPFESSQNFNRYNVMAKYNYRLPQDQELTLTMSHFTSKWDASGQIPQRAVDQGLIGRFGAIDDTEGGQTSRTNINIEHTKYLTDTKTLSTNAFYSKYDFELFSNFTFFLEDPENGDQIRQFEDRNLYGFKTVLSDKFYDTATNFEYQAGFGLRYDNADDVQLSRTKNRKELLERLAFGDVDETNIYGFLNTEFEFGDFKLNPGLRLDYFKFDYVNNLTESYDNASETKLTASPKLNLIYTPTNTVQLFAKTGIGFHSNDTRVVTANNGEDILPLAYGADLGGIFKITDNLVFNTALWYLFLEQEFVYVGDAAIVEPSGKTRRLGIDAGLRYEPLSWLYLYSDINYTYARSINEPEGQDYIPLAPDFTSTGGITIQNLNGFSGGLNYRYLDDRAANEDDSIVAEGYFVTDANINYTYKNYTFGIAIENLLDTEWNETQFATESRLQNEVEPVEEIHFTPGTPFFLRGKVTVTF

SEQ ID NO: 15491 - protein, 718 aa, Lawsonia intracellularis
MIYIHKDIDVEQKRSSRGASKRRSSTPRIGDMTKSMTFAGLLLTGSPLSAEEAGVFTLGEINISSAKNSKDQTSGYGGSVISNEDAWKFARDTLDQAVTLAPGVTASNSGGPRNERLIYVRGFDRFQTPLSIDGIRVYLPADNRLDFGRFLTADVSEIQIAKGYDSVLDGPGGMGGAINLVTRKAQKEVDGEIRAGMLWGQDGTFEGGSTYMFLGTKQPTYYAQGSFSFLGTKGWMLSHEFTPTTIQSSGFRDHSDTTDGRGMVKIGLTPNATDEYSINYIKQFGRKGAPLHVSDPIVASSRYWDWPYWNIQNIYFLSNTALGDNAYLKSRIFYNTFDNSLYSYDDKNLSTQSLPKSFQSAYHDFALGGSFEAGINFGTVDTLKGTFQYRRDNHVEWQGTFSTKAPCVANIICFREPNQTTTEDTYTVAIENTWHVTNEFDFVQGFAYNWRHMLRAQDFNTTDGFINYPLKDIGAPDAQGALIWRYREDAKLFANISSRVRFPTIFDRFSSRFGGAVSNPGLQPERATNYQIGWATTFDGKAEFSTAAFVSDVKNLIQSVPFIYNNTALSQSQNIGNGYFVGIEAAGTYSILENLMIGGNLTFIRRSITSPTSPYVQPTGVPFAQGFLYATYRPEAVPGLSFTPNLELADSRWTSNSAGTYYYKTGSYQLLNFQTTYQVGPNFEVQAGLRNILDQNYQLWDGFPEPGRSIFANMRVTF

SEQ ID NO: 15492 - protein, 731 aa, Lawsonia intracellularis
MYKFGGVLVILVSSITTIYAQSPSNEDNDTASGKTFLPGITVSTSADASAEGLSPPYAGGQVARGGRAGILGTNDNMDTPFSITSYTNELIQDRQARSVGDVLQNDPSVRVARGFGNFQESYFIRGFILGSDDVAFNGLFSLLPRQYIATELFERVEVMRGASAFLTGANPGGGGIGGAINLLPKRAPNEPLTRLTTHVGSGWHHNVGVDVARRFGPDQKIGIRFNGAYRGGGTAVDKEGVQTGLAAVGLDWRGDKLRLSADIGWQDNRLKRTRTNVTLGSGITGSPRLPDPTTNFAQPWSYSNESDIFGTLRGEYDINAYLTAWAAYGLRRTDEKNSLANFTLADRDTGDGYATRFDNTRKDNVDTGEIGIRGKFSTGPIDHRVVIAGSYFENERKNAYAWDFFNQLNTNIFSPVSWEKPDFSSSAFRGNNLSSPGLTGRTRLLSFAIGDTVSILEDRILLTAGFRHQNLRTESYAYDTEAKSPAYDRNRISPSVSAVYKINKQFSIYGNYIEGLTQGDTAPGTAINSGQVLAPYVSKQKEIGAKYDGGHIGATIALFTTTKPRSIIDADNVFTSSGRDRHRGVELGIYGEVIRGLRLLGGATWLDAKQRSTGDVTTDGQRVIGVPSFQASMGADWDIPGLQGVTFDSRVVHTGSSYANDVNTVKVAGWTRLDLGLRYLTEFRGHLVTLRGRVDNVTNRKHWASVGGYPGQGYLVAGMPRTFVVSASIDY

SEQ ID NO: 15493 - protein, 1060 aa, Lawsonia intracellularis
MLSLCAMGGMMVYSTPVMATVAQSPTIKVRGQVIDEQGEPLTGATVRIKDGQGGTITDVDGNFQLEVAGNAILSISYVGYKDREVAVRNRAIIESIQLQPDNQMLEQVVVIGYGTQKKSDLTGSVAVVDAEALKQTSHSNISTMLEGKVSGVQVTSDGQPGADPTVRIRGVGSFGDTSPLYVIDGVPMGTSIRDFSSNDIETIQILKDASAAAIYGSRAANGVVIITTKRGQKDQPLKVDYNGYVGMDYIPSNIYDVMDADQYSQYIGQACTNSNTPLPGGYKLDSTTGKYHFQDNTNTNWFKEVFKTGIRQNHNVNLSGGGAHNTYNVSLDYYNQKGTLEGAGPNYERYTARVNNTMDTKFIKFHTSLVYSHSDQDNMGLSNASEYVQGLYGDVTNVLRGTLLMQPTIKAYDNSTWVLDNLVGIANNFNYDSYGYGVYYDTVHGDISASNPLLVNNLLKRNTRVDRFVGTASADVDLLKMIGVDSKNHKLNYKVNLSYSKTHCKDFTWIPAWVQSNRVYLAKSNERLTKASRSYADALIENVLTYDATVGKHHFNLVAGQTYEEENTDLLTGWGVNFTEPYFLQLQNAANTYAESFEYKHTILSYIGRINYNYDDRYLFSATVRRDGSSRLSKNIRWGTFPSVSLGWRFDKETFFPFNRNIVNMFKVRASYGELGNENIGEYMYQAVMARNNMTYSFGNTPITGSAISTFVDNNLSWEKKKSYNVGIDLAFFNNRLEFTAEWYKNTSEDLLYAVPVPEQAGVSNTTVTMNAASMNNSGFEFTTTYRNRDHDFKYEVSANLSTIRNRVTSLGFGTDSYISGAYITNVGEEIGKFYGWVYDGIARTQADLDNHATQEGAQIGDCLYKDVSGPDGKPDGKVDAYDQVVLGSGMPKINFGLNARFEYKRFDLSIATFGALNYHVSDDIHNSLNSCYGWGNKDVAMLDANRFSEDGSTYLSNVPRTYVTNSASLAWNDLFSDRKIQNAAYWKIANIELGYNFPNEWFGKYISDVRLYVSAQNLHTFTGYKGYNVDYAGGTFTPGYNFCSYPTARTFMCGVHFTF

SEQ ID NO: 15494 - protein, 797 aa, Lawsonia intracellularis
MYTSSRIRSGIFGILLFVFFSISTGYSQQNKARITGSIQEKSTENPLGFATVAVYTSLDSLVAGGISDEEGKFSVDLPYGNFYVLVEFMGFEPHQTEVIDFSRANNQIDLGIISLESTAGDLDEVVVQGEKTTMELSLDKRIFNVGKDLANAGGNASDILMNLPSIAVDPEGNVRLRGSQNVRILIDGKPSGLVSFKGSAGLRQLPANMIERVEVITNPSARYEAEGMAGVINIILKKDNNQGFNGSFELVGGTPTNLGFTANLNYRHKRINWFINYGLTYRHSPNVGELYQETYGEDTTFILNQTNEGLVKSMNNNIRGGLDYYFSENSILTLSYLWRRSDAHRNTDIRYEDSWNTLENLQGYTLRNQDETEQEPNSEISMNYKKSFEREGHELTGTLTYLNYWENSDQTFTQSSYLPDGTSLAGSSLVQTSLNDEYENQYLAMLDYVQPFAKEGKFETGFRTSFREMKNDYLVEEENESGEFEPVPGLDNIFLYDENILAAYGIVGNTSGKWSYQGGLRVEHTDVKTTLEETNEVNPRKYTNLFPSAHLTYNITPENAFQVSYSRRVRRPVYNDLSPYVTLSDARNFFSGNPDLNPEYTNAFELGHIKYFDKGTLFTTVYYRSTDDKIERLRTVDENGNSRTLPYNLNGENSFGVELTSDYQIRDWWKIDFNLNFFHAKIDGTNFQNGYETKTTSWLFRQTSRFTVAEGFDIQVRANYDARQKTVQGVRKGIFFMDLSASKSIFQDRGNLVFNATDIFNSRRNRYISEGENFFTEGNSQYQRRQIILTVSYRLKQ

SEQ ID NO: 15495 - protein, 906 aa, Lawsonia intracellularis
  misc_feature (14)..(20): Xaa can be any naturally occurring amino acid
MDLRPDLRLDLLTXXXXXXXQTMNRLTLTLSGVLLATSALIAPGLAFAQTAPTTSPTAQTPAEQVEEQATEVGEIVVLGRYIPEPNRESSEVAAFLTSEDLERTGDSNAAAALTRVTGLSIVEGRFIYVRGLGERYSSALLNGSPLPSPEPLQRVVPLDLFPSSILDGVTVQKTYSPNFPGEFGGGVIDLHTIDAPNEPFFNMKLSLGGNTESTGKENLIYYGSRTDFTGFDDDTREVPGAIAIAFDQGKQINSANFTADQLQTMGQSLVNAPLRLLQREKTPIDGGVELAGGFSQDTGFGTLGLIAVAGYDNSWRARGGVQEEGQFQGEVLVPVSTYDVDSNQNDIRLNFLGGLSLSNADHEVKWTNLYVRNTTKEARSVAGPDFDAGGSVIRNDYTEWFVRQLWSSQLAGEHQFMDGALEIDWRAAYAKTSRDAPYESRFQYGVNANGDYIHNVQGNLISFSELDNDIVSGGVDVAYTLPLSSAREAVISAGVATLDNNREASRHDLQFEAVNGLTDSQRLSRIDYLFSDYNINPTTLQLREIAGSNGASAYDAELKVNAAYAMVDAEIIPLVRTTVGVRFEDGQQSVTPRDVFGGTSTYEATEIEEQYWLPSLTATWNFAEDQQLRFGVSQTIGRPQFRELAPQAYTDPESDRIFIGNPYLVDTELLNLDARYEWYFARQQFITAGVFYKDMDKPVESVIVEVGNQRQQSYLNAPKATIMGAEVEVKKYFEFPDQTMSFIANKRWLVQANYTYSDSEVKVGEGDTVLTLGGAGAPEQASFFIQDGSRLQGQSDHVANLQLGWEDDTARSQATIIVNYVSDRITARGAGTGASREPDFIQEPGVFLDFVYRKDFTVMARDMGFALELRNLLGTEFDEYQERGNKIRVNNYDLGQSASVSLTARF

SEQ ID NO: 15496 - protein, 831 aa, Lawsonia intracellularis
MEQIEAVSHTDTVDILQTLVPSFNVSRQPISDGASFIRPVQLRGLDSHHALVLVNGKRRHRASLVQIGGSGTQGPDVATIPAAAIQSIEVLRDGASSQYGSDAIAGVMNFNLKENSEGFDLTIDTGEYFEGDGAAYTVQGNIGLPLGDKGFLSISAEINDSEFTERSEQYCESWFCLDQGNPRFTEQSELRQGFVSGTPTPGASARIQALQSAFPGGVDAASVEGENAMPWGIPNREHQMFFFNAGYDLDNGMELYAFGNYGSVQSDGSFFYRYPGNGTIEDLREEDGSIYNPLDKFAGGFTPRFEGEVEDVSLAGGLRGNLSDATTFDLSARFGSNEIDYRLFNTINPSLGSASPTDFRPGTLTNEEFQLQLDLATEFDVGLASPLVFAYGASYLDETYDVGESSDEASYIAGPHAVADPYGLCNDDGTPTAAGLAATNAPADEALNCADPDDPVFTVVGVGSNGFPGYSPAFSEEYTRDSYAFYGDLSADVTDQLLLQGALRYEDYSDFGSEVVGKVAARYRINDAFALRGSFGTGFRAPTPGQQGTTNVSTRLPNGFPVATGLFPAGGTVAQALGAQELAPETSTSFTVGFTLELENLSLTFDAYSIDIDDRFRAISTLDVSSDPNGDPDAYERFLALQAAGVAGAESIGGVNYFQNAINTETRGFDIVANYPMSWSNGQSTDFSLAMNYNEQEITDDPLDVLNPEGEFDLENQLPNVRWNATAFHSFGDFSLMGRARYFGEWEDSDNTSPLSIQTYDPVVFFDLEGSWQINANLRASIGGRNIFDEYPDQVDRVASDNDYCCGRLYPSTSVADWQGGYYYARLRVDF

SEQ ID NO: 15497 - protein, 330 aa, Lawsonia intracellularis
MKIKNILLTLCTSLLLTNVAAHAKEVKIGMAIDDLRLERWQKDRDIFVKKAESLGAKVFVQSANGNEETQMSQIENMINRGVDVLVIIPYNGQVLSNVVKEAKQEGIKVLAYDRMINDADIDFYISFDNEKVGELQAKALVDIVPQGNYFLMGGSPVDNNAKLFRAGQMKVLKPYVDSGKIKVVGDQWVDGWLPENALKIMENALTANNNKIDAVVASNDATAGGAIQALSAQGLSGKVAISGQDADLAGIKRIAAGTQTMTVYKPITLLANTAAEIAVELGNGQEPKADTTLNNGLKDVPSRLLTPIDVNKNNIKDTVIKDGFHKESEL

SEQ ID NO: 15498 - protein, 910 aa, Lawsonia intracellularis
MIVNHNTTQVANITITGNESIIAPTTKKNINKLDYSKEIAYNGWFGETDKNKHNGRLNLIYKPTTEDRTLLLSGGTNLKGDITQEGGTLVFSGRPTPHAYNHLRKDLSKLEGIPQGEIVWDHDWINRTFKAENFQIKGGSAVVSRNVSSIEGNWTVSNNANATFGVVPNQQNTICTRSDWTGLTTCKTVNLTDKKVIDSIPTTQINGSINLTDNATVNIHGLAKLNGNVTLINHSQFTLSNNATQTGNIKLSNHANATVDNANLNGNVNLTDSARFSLKNSHFSHQIQGDKDTTVTLENATWTMPSDATLQNLTLNNSTVTLNSAYSAISNNAPRRRSLETETTPTSAEHRFNTLTVNGKLRGKGTFQFTSSLFGYKSDKLKLSNDAEGDYTLSVRNTGKEPVTLGQLTLVESKDNKPLSDKLKFTLENDHVDAGALRYKLVKNKGEFRLHNPIKEQELLNDLVRAEQAERTLEAKQVEPTAETQTGEPKVRSKRAAFSDPPSAQSLLNALEAKQVEQTAETQTSNARVRLRRAVFSDPPLAQSLLNALEAKQVEQTTETQTSKPKTKKARSRRAVREAFSDPPLDLSLLKVLQVKLEAINAQQQVGKEPQAQEEEEKRQRKQKELISRYSNSALSELSATVNSMLSVQDELDRLFVDQAQSAVWTNIAQDKRRYDSDAFRAYQQKTNLRQIGVQKALDNGRIGAVFSHSRSDNTFDEQVKNHATLTMMSGFAQYQWGDLQFGVNVGAGISASKMAEEQSRKIHRKAINYGVNASYQFRLGQLGIQPYLGVNRYFIERENYQSEDVKVQTPSLAFNRYNAGIRVDYTFTPTDNISVKPYFFVNYVDVSNANVQTTVNSTMLQQSFGRYWQKEVGLKAEILHFQLSAFISKSQGSQLGKQQNVGVKLGYRW

SEQ ID NO: 15499 - protein, 868 aa, Lawsonia intracellularis
MYNHTIKLAFCISSVLYFSTSATAAPNTDTVTKLDTVTVTGYRASLEKTQSIKRAANSIVDAISAEDIGKFPDSNAAESLSHLPGISVDRQFGEGEKISINGTDPALNRVLLNGQTIASGDWGGNPTDTSGRTFNYSLLSPEIIGLMEVYKTPEARIDEGSIGGTVIVHTRQPLDLPKNTIRGSIGYSYNDRSQKSNPRGSILWSWKNDSENFGALISATHDKQDIARAGIEFFGYTTGANIPPEATITGDGSTLTTAKVPAGINSAFFQQTRERNGLQGALQWKPNEQNEFNLTGIYIKGKYNNFSESRYICPSCNNDLNKVSAANVQNGYITTATVSDGTAGQPYAELDANYRVSTVTTNSLNLRHQWSGDKWVLTTQTGTTKATGGKDPEYLMKFLLQEGGYRFNYDGTHTGVTYDNNNASNWALKSGEQAGGLEYTRTNDQENYFQFDATRDLNWGPFNKLQFGYKYIGHKNGQTSRGNALFANQDVLLTTFNPGMTPRGLYNGLGASGDLINWPTADLRSVLSYLNALPEAAFETKYNQQFSVTETTNNLYTQLDFDSGKWRGNVGIRYVDTKDNILYWQSTTVNDTVNYQPVKDSKRYDKPLPSLNIAYDLTDNSVLRFSAARVIARPRYGDLAGSFSLNSTSGDLTASGGNPNLKPYQSSNYDLAAEWYFAPSSMLSAEVFYRDISSYIVTTTTTETLSDPSNNIYNKPYTVTRPMNATGAKVTGLSLNYQHAFAYGFGLATNYTYAQSSSNDGLNLPYLSKNTYNVIPYWEQGPWAVRLNYSYRSKYFTQIGRLDSQVFTDAYKELDLTTSYKFNDWVTLNISATNLLNSTYYWYNEVKYAPIGMYKNGRGYQAQLNFKF

SEQ ID NO: 15500 - protein, 1125 aa, Lawsonia intracellularis
MNNSKIINVRLMKKVLVLVLSFLSVTAFAQNITVKGIVKDGTGEPIIGGSVLVKGSSIGTVTDVDGNYTLSNVPADGVLEFSYIGMKKQDVKVSGKTVINVVLQEDTQILDEVVVTALGLKREQKALGYAVTEVKGDDLKAANTISPVAALQGKVAGVEIRQSDGGMFGATKIQIRGASTLKGNNQPIYVIDGVILDNSTSGNTTMDWDAGNNNANDYGNELKNLNPDDFETVSVLKGAAATALYGSRGLNGAVVITTKSGKGFKGFGVSVSQTFGIDHAYRTPDIQTEYGVGLMPGWKDTDNNGSVWDPFQFKLDDKGDRTLIGAGSYGWGPKYDGQPIRNYDGTWTNYSPHKNNMLDLYQLGLNSNTNVAIRGGNDKTSYYTSLSYKKARSTSEKNTFERYSFLLKGSHKISDRVEVSAAMSFTNSNPKNSPRTVGERFVNPNGTIMTPMLDVNYFRDKYLGEHGGLASTSYGDKYGSVPGRDLFFMIDKYDYSQKETVVRPQMEVNVQILDWLRFKADANMNYYYTKFEEKQLGSGYANEGGKYTMGQTTKEQATFGGTFTVNKQIQDFSVGGFARYEYYTSRSEAYKVYTDGGMVVPGQWFVDNSKNPKKSEASISNTKRMMSAVFALNLGWKNQVYLDVTGRNDWSSSLVYQNGMGTYSYFYPSVSGSWLLNETFDLPHWITFAKVRGSWAQVGNDTDPYYVNSVYGFETKEMYDGNIYVNTLDKTMKSLKLKPERKNAWEVGLDLRLFDSRLNFDFTYYKENTRDQIMSIEVPAISGVNTQLINAGNIQNKGIEIAVNATPYKNKDWQWDVAMTYTKNKNTIISLHENVADYIALSGYANDYDYHIGSVAKVGGDYGLLMSDILPAKNEKGETLLEWDDSWRGAYEARSGKVQEVGKMTPDFLGSLSTTLSWKNLSLHIATDMRFGGLVASYSNLYGTQAGWIKSSLKWRDPEHGGLSWTSQYGDSKGISYGDGVIPDGVFKNGTFATLVDGTKMDVSGMSYKQLVAEGKLEPTHAGTYHVNRAAWGQNTIFDTWVHELNYIALREITLSYRFPKSVASKFGAQGLGLSFSARNLGYLYNSLPNHLNPESVRGNTASEFRIRGYEPYTANYMMTINVDF

SEQ ID NO: 15501 - protein, 357 aa, Lawsonia intracellularis
MRKLVLGVALASSALASPALARNDSWYVEADAGAMILEDSEFKVDGVDAAAILDSHTGYDFGGIVGYDFGGFRLETEVGYRRAYNQEVDIAGTVYTKPQGHADALSFMVNGMLDFGPDDGMQGFVGGGVGVARAKYWINTPGGELNDSDTGFAWQAIAGIRVPVSDSVDVGLKYRFFNADKVDLVTDGGDSARTRFRSHSLLGTLTFNFGGAAPVEETPPPPPPPPPPPPPPPPPPPPAPVCNKGPYIVFFDWDKSDITPEAATILDNAITAYGNCASVPIMLAGYADRSGTVKYNQGLSERRNASVRSYLTTHGVPDGSITSQAFGESNPRVPTADGVRELQNRRVEITYGPGSGM

SEQ ID NO: 15502 - protein, 245 aa, Lawsonia intracellularis
MAPAGLFGVDWTAGDLVFGGFAGFGRMDADFGNRNSSFKQDDTTLGGFFGWYTGPVWVNAQVSYSWLSYDVDREVQLGPATRVHSGSPDGSNLTAALNAGYSLGEGNLKYGPVAGLTWQKIKLDGYTESNDSATALGYANQDIDSLVGRVGFQVHLDGAMVKPYLQATYDHEFKDGGEASAWLQSMPEVGMYTVPGQNFDRNYATVVLGARTGLWGLQSNIGLSTTTAQRSARDATLFVNFSGNF

SEQ ID NO: 15503 - protein, 195 aa, Lawsonia intracellularis
MSYAQNNLGWMYRNGNGAAQDYTLAFFWYKQAALQGHSDAQNNLADLYEDGKGVAQNETLAAFWYLKSAQQGNRHAQFQIAWDYNAGEGVDQDYKQAMYWYLKAAAQGSVGAYVNIGYMYKHGQGVEKDYQAAFEWFTKAAECNDATAWYNLAIMYHYGEGRPVDLRQALDLYRKVQSSGTRDVSQEIRETEDLL

SEQ ID NO: 15504 - protein, 1532 aa, Lawsonia intracellularis
MAYKRTRSTDIQVLLAGGSRVGARSIAALSAALLRAITVMTTLTVPAMADGGAGGQGGDSSAAGGIGGSGYVGASGGSSGPSTTAGSGGGGGGAAGGGSGGSSGNTDSVGGAAGGTTPGQDGSNGTTAASPSGGGGGAGGNNGNVATAPFSNAANSTGQNGGKGGNGGAGTDSGSTGGGGGGGGAGGVGFVFSDSSSFTNFNVTIQGGAGGNGGAGGSAAAANGNGGAGGDGGTGLLLTSPGATVTNSGTIKGGNGGAAGAAGAGTGTAGAAGAAGAGGTGIVGSGLTIINSGSIQGGLSGDGTRANSITFTGGNNTLTFMNAGAGLTGAIGLATSSTTLTFAQSTNSTLDQMITGAGSVTKAGPGVLTLTGLNTYAGGTIIAAGTLQIGDGGTTGSITGRVANGSALSFNRSDTYTLDGVISGSGRVNQLGPGTTVLTGNNNYSGGTTISAGTLQVGNGGTTGTIGSGNVNNAGILAFNRSNALNFVPVISGAGAVTQLGSGNLTLSGTNTYTGGTTISSGTVTATTNRALGTGDVRMMQGATLVLPFNSTLANNFIISGTSILKVESGTTRITGVLSDGPIAGSIEKTGGGVISLTGNNTYTGGITISAGALDIGANGSTGSITGDVINNGSLRFKRSDAYTFGGAISGRGAILQDGDGVTILTGTNTYTGTTAISRGKLQIGDGGTTGSITGGVTNNSELWFNRSDTYTFGGVISGSGRVSQLGPGTTVLTGKSTYTGGTTISAGTLQIGNGGTTGSIANNVNNAGTLAFNRSDAYTFGGAISGTGSVSQLGSGNLTLSGANTYIGGTTISGGTVTVGNNSAFGTGDVKTTQGATVAFGAADYTLANNFVVSGTSIFDIQTGTTQTITGAVSDGDTAGIIQKNGDGKLILSGPTSYSGGTIINAGTLQLANSNMLSATTAATVASGTTLDLGGFNQTIGSLAGAGSVALGAALLTTGADNSSTNYSGTMSGTGGLTKQGTGNLILSGTNDYTGPTTVNAGTLSVNGSIASAVTAASGGRLGGSGSVGSTTIASGGTLAPGNSIGTLTVNGDLTLAAGSSYAVEVSPTASDRTNLTGRATLAGTVQASYATGSYISKRYTIVNASGGVAGTFGALVDTNLPANFRSALAYDANNAYLDLMLAFVPPTAPDYGNGLSRNQQQVAGALVNSFNVAGGIPTTLGTLRPDGLSQASGEAVAALQQSLFGSADLFMRSVFSNALDPTDGSAGRECAAPGSQAGPRDACAALPPAAASASRWSVWGAGYGGTLRVGGDASTGSHDTTSRVAGAAAGASYQVSPQARVGFALGGSGSSFSLAQGLGSGSSDSFNAALYGRYQLGPSYLAAALGYVWQDATVDRTVTVAGGEALRARMHPQALTARVEGGQRRQVSGIGVTPYAALQTTTMFLPTFGETGTSVFALDYAGRQSTVTRSELGARFDDEVFIDGRPLALRARAAWAHGWNTDWQAAATLRQIPAAQFNVYGAALPGDSVQVSLGASLGLGRGWTVSAAFDGEFWKHAESYAGRALVSYQW

SEQ ID NO: 15505 - protein, 297 aa, Lawsonia intracellularis
MVKLEQDLYSNINIMGKFMNYKNTLLGIMLALSLLPTKSFSESISNNDNSQNFKLYISGQYKPGVPRFNNFSAKETNVKTQKLLGLLSGTSRKIDKYKDFSNTYIPDFQDSSTGFGAAVGYISYKGIRFEIESSYEEFQVNIHDNCEGTIEPCRYFALARSVGRRGWPDQNNYTVMKNTGLSMTSVMFNGCYNIMSNKLEISPYICIGIGGDFIDFFDATHIKLAYQGKLGISYSLLPDVTLFVDGYYHRIANNQFNNLNVLQPVELKYEPKITSATATMNVTYFGGEVGIRFIFNS

SEQ ID NO: 15506 - protein, 335 aa, Sphingomonas sp. A4
MLMLSRILLCLAALASSTSALADTVWMKNGDRLTGKITLFDGGKLLLKTDYGGDITLKWDKISTFESEQNLLVKQDAETGEHSKGIKAAGPGQVTLVNGEPKTVELASIQQMMPPKPILQDWVWNGNVDFSLDRKQAENDVSDYDIDFKTNARHGLWRHNVQGEYNREKKNGQVSTDNYSGQYALDRFIDDHWFWQGQVAYKRDMIEDLAKKRTVGTGPGYQFWDNELGAFSIATLVNRNDYEFADGEKEHFYSSSFKWDYNRYLLAKQFELFTNGEVSKPLQSGLDYELQTEAGIRYKLTSWASLSMKAEWDKFSGNDGNVNQRRYTFGLGVGW

SEQ ID NO: 15507 - protein, 706 aa, Bermanella marisrubri
MSISSQRPRRPGPFLLSALSLAMFSSGPVHAAETATLPATQVSAAASEASEGYNAKSTSTASKSDVPIKEEAQSVNVVTPQTIADYNVRSLDDAMKFVSGVSQGNTLGNTKDSVIKRGFGTNDDGSILRDGVRSVVSKNFGATTERVEVLKGPASLLYGAMEPGGVINVISKQPQYVQSTTLSGSAYSEGGGSFSVDTTGPLGDSGLAYRLVAERQSEDYWRNYGVDQHTLIAPSLSWTGERASLTLAYEYNDYISPFDRGTVFTGGHPADISYDKRLDEKWSNTVGISETATARFEYQLSDDWKTRLTYGWNNDRYSLSIAQPSTLSSSGVLRRQANGGHYDYETRYASWDFIGKQDILGQQHDLLIGAEQEDSDKYRGKTYRNTAQNGFNIFSPAYGSLAEPSVVSAANSNLSNQLTSSSLYLKDNWHLNDRWILVLGGRYQHYDQYIKQGLGASRVTNLDKNDDVFLPMAGLVFKVNEDLSLYGNYSRSFVPNDDVNDDGTTFDPEEGRSYEVGAKYALAPELNFNLAVFDIEKKNVVTPTGVTGVSEAAGKVGSQGVELDVTGRIAERWDMIGTYAYTHTEVLDDPSNKGNRLSQAPKHTASLYLTHHLQIPSDLGEWHAGGGARYVGERAGDDANTFYMSSYTVADAFLRWDVPMAGYKTRLQLNVDNLFDKQYYPSSTGSQLQVNVGEPRTARLSASVTF

SEQ ID NO: 15508 - protein, 1286 aa, Bermanella marisrubri
MKIQIPITTIVGAKITLSTLLLCIPISSVAELNVNNNGNAISKGQGNTYKPTDQSNNNVTISGNEPQGAEIYGGYSDSEETKSNTINVDPGTFIGNLYPNNQKNGGKVIGGKGTSSSNNKVEIKSSNTNSVTKIAGGMKNAELIGGYATTSESKNNTVLIDNKTVFYGGYEQGYIAQHLKSNIYGGQSKSTATSNKVEIKKDIELTATSDNQHQFKIAGGFVEAPNKNNGKAISSNNSVIITDAKLTAGLRFGNKLQHHTHIIGGEASVFWNFDYGSAEAIGNMVNLTNVTIATHSSLKNPIIDIFGGLSKDATTDNVVTIKGNTKINWDGSGSASSTKIYIKGGNGYHQSNRNKVYIQDNSKIKAVEIIGGGRSQVASENLVIISGGTINVPTIGGGSATNATNNQVTISGGKVTSSTIYGGNANKSANENKVTITEGTANVADIYGGKSISNNSIANKNSITISGGTLQVTNIYGGHSAKDANENSIQISNGGNINNIVGGHAQDHTNLNTINITGGTIQSVTGGNSGVVASQNYVNVSGGVVENYIIGGKSYSGSATRNSVIVSTDTSAIIIGGQGTNANAIENSVTISGGKVTNSIYGGKSTNGNANKNSVTISGDNTSITDKIYGGEGISASENRIEISNGKISGEIYGGYGTTVSKNSVTISGGTVTSNIYGGKSLNGNSTENSVNISNGTITGNIYGGYAKVAFKNVVAISGGTIVGNIYGGYSSGGGSSTGNKIIISGSPDLSNATLYGADGKIAAPPPIEQNLAPKRVRRALADPADIQPLNDPPSDYKSGNTLATQDSLNLKIKSIKNFSNLNLNIPRDMTTNDYILILGEDMDLSDLIITPQFNANNLNLNEGDTITLIGGFDDAKITGGDDANSIIPIPIPAPQPAPVVPAPVIPAPIPVIPAPVPVIPAPVVPIVTPIIDPVIPAPIIPAPVVLVSEPKKTLFGVSQIITYTSVGNSKFVLGKKEPNPGMKSFLESGVASIVSTNQAGDLASNEGIKNMVSQASSSNSFAALSNGRFRYKTGSHIDINGFSLIVGVSKEIESFTYGIFMEAGNANYNSYNDFAPNSIPNTNSIKGSGDTNYFGIGVLLNTKLANNFYLDGSLRGGKVKSNYVSNDFNGVASFDMGRNYFGGHIGLGRIFNINDINIIDLYSKILYSEQGSKAVYIRDEGFEFDTAKSIRLSLGARYNYELNDSTNLYGGAAYEREFDGKQKTYSIVANANIDAPGASGDSAMLEIGASITPTNYKAFNANFNLQLFTGVKSGISGGLKARYKF

SEQ ID NO: 15509 - protein, 748 aa, Bermanella marisrubri
MRFKTACLVSALVSATAVSAAAQEVEEVIVTAQKREQNLQEVPITVSAATAEMLQQAGATGTRDLTLVTPGLNFSNQTATGSPNIRGVGTRGIGPGDEPSVPIYIDGVYQSTTHAGFFEFNNIERVEVLKGPQGTLFGRNALGGAINIITLQPSREPRFKADASYGSDNEIHLNAYVSGPLGEKLAGNIAFHHDQRDGYIENIVTGEDKGDAGSTGARAKLLWTPTDRMDLTVGVNFLRSHDDTAFSGYPLGGNTVARRVNPNVPIAPPGKTGIGDTYFNYQQVGAFANLNWDFDGFQLTALQSWLRTRSIQRTDSDATILDYQYAKIPYLDESQTTEVRLASTGVRKVDWLVGANYYRNRPGYVLTDAGDVFLSRASPTGATLALISELGVDAYAVFGEATYHVNDALSVTGGIRYSHEKRTKDYRRSTTPFASLPTTALDYNYTIGDVVFPVPTTPSYAKKDYEDVSFRASVQYDFAPRIRGFVTFSQGFKSGFFNASSGPPFLALKPETVDNWEVGLKTDPTSRLRLNITAFHMTYKNLQVSARSPTGAATTDVFNAAEASNYGGEVQFDWIPVDGLTLRGGLAYQHARYDDFPAALVYFPATSTDASLTNPCQPGTGVLIGGNRSATCDASGKPLARSPDWTANLAANYEFDAFGGKVELGALAYWSDNFIWDFIGQLDNDGDYTTVNAHASWATMDERVKVTLFARNLFDSDHPMNRYQGAAATYAIDVRPRTIGVRLAYQMP

SEQ ID NO: 15510 - protein, 943 aa, Bermanella marisrubri
MKHPIYWFLVSSGLLASTSLSLATPVEVTLPSTDSYNGNNSASTPFTPKDTSDSTGTQYNCTGDVCIANADTNSKSCFSQSVGDLSFMGNGYSLCFESITATGKPGAIETTASDKNVSISNFSMFNCSFCPPGVTGSGAIKSKGMTTFDKDVNILFQKNSSSTAGGAVSCKGIVLKGTSGIANFIENKSSENGGAIESSGESFIENNTGVISFLGNSSAKQGGAIHSSNNITVSNNNSVVFSKNTTTGNTDSSGGAIYCKESSGNTAELKFEGNKQLTFSENASSTSGGAIYANKLTINSGGTTVFSNNSTNSTTNATPNGGAICLDTSGECSLTADLGDIIFDGNKIITSGGASTTRNAIDLNTSGKFAKLSAKEGFGIYFYDPIANNGDTSTDLHINQQENAATYTGKIVFSGETLSTQEKTQEENLTSTFKQPVTLSAGSLILKDGVTVEAKSFTQTPGSSVIMDVGTTLRTPSNDGEAITLPDLSINIASLGGGGVLSPAKIQSQTNDKLINVTAISYVNEGGNAYEYPVFSITRDFASAITLVAANGTQAAPTIPATPYTPAQHYGYQGNWSIAWKQGTGANQQNATLTWTQTGYLPNPEREAPLVPNTLWGTFTDIRALHQLMEISAKGIEHERGLWGSAITDFLHRKKTNTSRKYRHIGVGYAVGASAQTPTEDLFSLAFCQLFDRDKDYMISKNRTHVYAGSLFFEHFHMLHPQTYLTQARAKIPSSFLSKLPENVPVIFNILFSYSHAENDMKTRYTQRYAPKNIIYPEVKGSWATNCFAGEISGSLPIELSDSYVLDKFVPFLKAQMIYGEQESFQEPTSEGRAFESSHLLNLSLPIGVKFESVFGNDQDTFDLMLAYSPDVFRVNPHCTTSLVVTGAAWETKAAPLARHALVVRASNNFTYSDYVELFGHGGFELRGSAYGYNFDLGGKIRF

SEQ ID NO: 15511 - protein, 892 aa, Bermanella marisrubri
MFKKTQQQDSRLLQLNPLSLAVSIALSLSGSLHYAQAETQATNVQEATRQSVAFSISAQPLSSALLRFAEQAGLQVFFADVKLEDMQAAGLQGRFTPEQGLRQMIGANPVDFQIGSNGVITLRPRSTHVDTAKIDDVMTVRAFTVANPGDWIYEQPRAISVISREQMDNRPARHAADMLEQSAGVYSSVSQQDPALSVNIRGIQDFGRVNMNIDGVRQNFQKTGYGQRNGQMYIDSELLSGATIEKGATNVMGSAGTLGGVATFNTASARDFLAPGKELGGKLHASTGDNGTHFIGSGILALGNESGDILLGASERHLGDYWPGNDGNLGSIRIPGSSSNYETWANNLKHQKVSNAAYTMRSRLAKVGWNLPANQRVQLSYMQTQTSSENAGTLSNLSNTELGWRASGHSDIMARSTALDYSLKPDNQRWLDFKAKIYYADTNNDTDNYALSNTSAYHESTRLRTYGAQAQNTSTLWQQGAHDLKADYGLDFYYDKITTDSTNSTASNATPEGNRAMASLFANLNYAYDEWVTLQGGLRYDRYQLRGTTSISYREIPYTIADPCKEGSIARCPSFVTTTQDWNVDDEHGKLSPTLFAGVRPGIEWLQLFTSYGLSWRPPSVSETFANGTYSAGNYYLYPNPNLKPERSRAWEVGFNIQKPELFIDGDRLVTKVSYFDTRINNYISLNGARNKPGYNGYSLSNSVFQNNLAKSRFRGMEYQLNYDAGFLYVDATYTHMIGNNDFCAPVAWMGGVTNVGGSRGNYYSTPVDTTASDSSCQKTLLFSNAAYLPGDRGSVTLGTRVFDRKLDMGVTMRFAPGYQDTAAPSNSAYLADWPKYEVYDLYASYRLTDSLTLRGSVENIANRTYIVSYGESLGYTPSRGRTVQAGVEYRF

SEQ ID NO: 15512 - protein, 1057 aa, Bermanella marisrubri
MLKRIKPVSMVLLASTLCFSGNIYSASSAGNPDTDISQQNAKVTGTVEDALGPVAGASVVIKGTTNGTMTDMDGNFTLDGVKNGDIIQISFIGYATQEIPYAGQASLSVHLEEDTQKLDEVVVTALGMKRDKKALGYAMQELKGDELLSAREPNLANSLSGKVSGLQIVRSSNGVGGSSKIVLRGNSSLTGSNQPLIVVDGTPMDNFTGGVDDVWGNSGADMGNGLSDINPEDIESMTVLKGASAAALYGSRAGNGVILITTKSGRKNEGLGITVNAGITAESIFLKPDMQNSFGQGSVGVYDNQSRLSWGPKAEGQTVTDWLGRQVPLQTYDNIDAFFHTGTSFNEGVSFQQNINGTSVFASINRSDDAGITPESKLNKTNVTLRATTFLDKAEKWKVDTKVNYVNMNAHNRPIQGVNPSNAFNTIYGLPRSLNVKEFKSSVDEEGNMIWWDASKNPQENPYWVTKYRQNNDTRNRLLGNVSLKYAPTNWFDIELRGGTDYYTTTKNEKVYAGGNTSPRGLYNEGSETFYENNYSFLATARKDNLLDRLGGFVTFGGNLMMQQRTKMNASAGELLVPDLFSLNNGINKPTVTSELIRRKMNSLYGSLQLNWDGYLFLDVTARNDWSSTMSKDNRSYFYPSVSLSGVISDMLPKIGGNMPEWFTFAKVRASYAEVGNDLDPYQLYNNYTVGKDENGNTTAAPGQILFDSSVRSELIKSWEAGFDVRFLQNRLGLDFAWYKTNATRQLLNLPLDPFAGYSSRKVNAGNIQNEGLEISLNGAIFQSPDMQGFNWNATAQFSLNRNKIIDLYPGVTLYDIKTLDAIQIVAAQGSYYGDIYGQTFLRVTDKDSPHYGKVIVGDDGLPLISAEKSKVGNQSPDWMLGLTNSFSYKGFNLSFLVDFRIGGDIYSATASNLFVRGNAAGTVVNGERQDFVVPNTVVRKDGGYVENNVPVTHQNYWERIGSTGNYGLPEVFTYDATNIRLRNITLGYTFNRAMLKKTPFQRLNLSATCNNVWMIHYNLPGIDPESVSATNTNATGFENGAAPTSRSFTFNVTVGF

SEQ ID NO: 15513 - protein, 738 aa, Bermanella marisrubri
MLQKFVKYFALSCALSASVMAEEAKATQAAPEANTDKKAPETKATETTEENTAVEKERVIVTGQIIPEGGHLLTGSSKRIDTEDIRKHSYSDINRVLYQVPGVNVREEDGYGLFPNISMRGINSHRSAKLTLMEDGILAAPAPYSAPDAYYSPNTGRMSAVEVIKGAASVQHGPHTTGGVVNYVSTPVPTDGETFYWKQLFGSNNDIKTHMYYGDVYDLDAGKLSLLFEGYYRENDGFNDIQHSDRNTGINHQIEPMLKLRFEPKTSKYQYLEMKVGYTDMEANLSYNGLKKEDFNSNPHDRYWGTQWDHMDTEAVRTYLKHYIELTNDISLTNTLYYNRFKRNWHKIKGDPGTDVLRGTAPGTIRLKNNNRDYYQVGLQSEVDWAFETGSIDHNLKVGTRIHRDKYDDYSWYDYYDVGGNYDVTGYREDVKGSAGNKDYNTESIAFFLHDEMSLTDKLTVTPGVRFEHISYDYNSKGETSDVDIWAPGIGFAYDFTNEYQLFGGVHKGFSVLAPPDAVEGGKYETSLSYELGLRYNNESGHYGAEAVVFYNDISDLYDPESQASGTEFSRTLGDAESYGLELYTYADAGKINNWGFSNPWTFAFTWTQSEITDIADDIDTSDPANDGSFYFGAKDGSETPYIPEFQYSIGTGAHFGKWGTDVNATYVDEMFTTAENNTKTDAHIIVDWSAYYSIDKNARVLFNVYNIFDEEYEAAHHPTDIRAGAPRLFYAGFEYKF

SEQ ID NO: 15514 - protein, 726 aa, Bermanella marisrubri
MRKSSLMAGAAIATLLPALPVLAQQADTLQLDEIVVTAQRRAENLQETPLAVSAITGEGLASQGIKSVVDLSAQVPSLQITSSGSGASQVFMRGIGSSNVTEVGDPAIAYHIDGIYIARATSTGALFYDIDRVEVLRWSAGTLYGRNATAGAINVITKKPTQELGGSAAIEYGNYNALTTSGVLNVPIKEDLAIRGAFQTTRHDGYQKVITTGPLAGNDKYDQDDKSGRLQALWTPTERLSVNLRGDYLHRGGAGGGEVGYPARTSSPWTSLSTVNTSRDNTYWSTGAEVNLDLDWAELTYIFSYNYANEDRNAENVVTGAPNYFYGVDKTTSNELRLGGDTESLKWVIGAYHFKEDNDVDFRIFLADNNYLSFIQPEVTSETTAVFGQATWSVTEALRLTGGLRYTEDKKGRTGGTFFTNNSGAITGTVTLNVSDNKWNKVNWRAGVDYDLAEGSMAYANVATGYKAGGYYDGLPPNDYKPESITSYEVGVKNRFMDNRLQLNLAGFYYDYRDFQISAIGTIAGQDATVTLNADKAEIYGLELEGDFLLTEQDRFDASVSWLHARYKDFLLPRGDAFANNNANANIARCYTADYSSAPPRAADFSGCKMARTPEWSINLGYQHKFEFDNGASLTGRVQTHIESAKYLEYHGFEQNKQDAFTKTDLTLTYAPAEGGWTVMAYVRNLEDENVLTNSNPNATTGFATNGSGDFYAPPRTYGARLSIDF

SEQ ID NO: 15515 - protein, 366 aa, Bermanella marisrubri
SAGVSQYAMASAQDDSKGFVEDSTFGINTRMLYFSRDFRNEPAGGYKIINGKAQSRVEKTGLGFNALYQSGFTQGTIGVGVDVIGLLGVKLDSGKGRSGTGLFPTGADGRSQDDYSKGGGAVKFRISDTVLKVGDQYTTAPVFASDDSRLLPELPQGISITSNEIKGLKLEGGHFTSSVAQAQTYRDSLGLTKTDFIGGVYALTPEVSASLYYAKTEDYWKKTYANLNWTHALSNDQSLAVDFNIYSTKSDGAGLQRAEKDNTTKLDNRAYSLQGAYTIQAHTFTLAYQKVSGDGDYGYGVDGGGTIFLANSIARSDFNAEDEKSWQARYDLNMATFGVPGLSFMTRYVSGSGANTGTTSNGKEGN

SEQ ID NO: 15516 - protein, 811 aa, Bermanella marisrubri
MMIGGFGASLAVACMATPGAAQDSDLIILPTVEVETTEKPTPRPAAKPAPRATQPAPRRAAKPRAAEPTVCTPALAGTPICAAEEAAERQAQELAEAQARTAAKAAAGGSSYVNQDAPFKANTLANSRMPGPMKDNPRTVTAITQEVLETTGTTSVRELARSTPGISLGFGEGGNSFGDNIYIRGFKANNDTYTDGIRSPGTGVAETFNTEQVEVTKGPAGTVGGRGTTGGAIDVISKSPQNVDFTKTVTTVTDAATVRQTIDTNKVINDRLQLRFNGMLQDGEVAGRDEITDDRQGAALALKFAATDALTLEGNLSYTKIEQTPDWGVPYVNNEELGLIGPVTEYGIDRDTFYGVPGRDFQTAEETVATAKATYAFDNGMTLTNTFRAARSTNDYVLTAPSSLIDNGSTNPEDWDVGLSFKSWNQQTDVLANVLELSGAAQFAGASHSYVFGLATSREEIEKLSYSNLSSEDYEPPAGQRGCTVSAINPDPIGEGCWTGEEPVLGTNLTETTVKTTSLYALDTVTLSNRLKVNGGLRVDMYDIARTGGTGEDAYSLSRDDVMMNWNLGATYAFDDRLNLYAAAATSTNPAGQELEAGGGFYGGLDDGGAGLAPEENTSLEIGAKYSFTPNFLFTAALYQTTKDQAREDIGPRGATVTSDTLKYRMRGLEFGVAGKVTERLSLFGGANFMDSKVLRSADSDNIGLSVANVAHEQLNLLATYQVTDKLMLGGRVNYQGAIDLGSVAANGRSIPDAWTFDLLGEYKVADNTLLKMGITNVSDETVYDAAYRSGTPFTYVAPGREVSVSLEMKF

SEQ ID NO: 15517 - protein, 1683 aa, Bermanella marisrubri
QHLSRCSSYRYRAATNLDSYDLQIDHNVEHDQKVRRAEKDKKAVIELYISSINRGIKYKHYVDNDIIPEMQEVRTALNMNKDDAQSFVASIRTEIMENAKGQYISDEHIPTEKELKNRFGISRDDNRDAYIKSIRLKVMDKEKPQYIAANSIPTEKELEQKFGCDKGEATNYIASIATQKMLNKKAYYIDNNIIPAVEELKQEFRIGKIKANSYIQQITDGINANQLLNNNNTTKPSTVGSTKKIETKSDNWYMSNQGINTTETSSVVTTGRKEKQSYYFDPISTFKAHFNNKENNGNLTQPQHNIKRIIQQEENIEEFKNLIKTDPIAALTLQVGSSYKQEAVTTILSDFNDDTIQRVLFSNDKGQLDFKTNIDVKNRPILKELLENSSSEEKTKFAERIQDYATRNISHSQFEEKARLDLIKLAASKVELVENFLALQLELKNKMQHILVKSEYILTPKIVAEINIELKNQGLIIDSLTKDNMIKLAKEVNKQALNSAIKVILSDNNTLSNETNKILGLAVGNNANNLAQTQSGMPNPPPLPLSGGIPNPPPLPLSGGIPNPPPLPLSGGIPNPPLPLNGSMPPPPHLNSQGFISNSNNLDLNKLQAEYSHIHSLYTQFILNTTVQPKVLPQPTASSATSTERSEPETAYAKLYVEYRTETGGKKAYDLQDQLIKRQADLTNVIRQILTTSYANQGADEKTLVNVFSISTPEIEAKAKDVFNKLVQDPYIQYITVNGKKKQQANTQLKIFSMSTDDAVKRILLSSCKISEELKKPIKHELNQLKLMREFESKTTLFEQLEFAYANAKNLDQDIFGNKVEELINNPKTLTTAQQATFLITEDTNLRKTIDTDQAQAKLDDLRKAILSTIKLEELIKANLPHNEFIAIVKEKEPELLKEFLKANTIKLEGNNNLDQLRLVLPSFTCMSDEQLRVLASKLNMTIILNALKEYSQVKAKKHINTGNMPPPPPPPPSGLKDAELAYLTTLGITKDWISRIARLNVKTSTSTFKTTPKIYNFSSDIAVRYKEFALSGQKSAGHKAKYSDADLFQKAIVESVAFEHSKNYPKVHQNNTYFAKIQEALDTMHSSFIGPRTEIGQEIHNIYTSKLLALTKDKEFINYVEDDIILSKKLTEAFTSADSDFIGPRTEIGQEVHNIYTQQLAKYPEETVKEAFNTANSDFIGPRTEIGQEVHNIYKSKLLELAKDKELFLCVEQLLAESAELEQKYGTDLQSENNTRKRKWTFRSETLRLFLQANESANDESSTKDNTQPEDSNKKSEEFDSETALSPRLLSSNDSKNDKSSDNIDLRSSDEEDKGYETDEELKESNNTTKEESQKDIALESEDEAIDVSFTTEAIAEQDEATQRQQVSDDTSRKVAILAKATSTLHKPVHYNILSDRLKVSAIGAGDEEPIIARGVWISGLYGMNKQGTWKNIPKYQGRTTGITIGADIEFINSHDVIGIAYSRLESKIKYNKKLGTIAVNGHLFSIYGLKELIKDLSLHAITSYGHNYVKNKSKNINNIIGKYQNNNLSFESLLNYKYHTKYDLHFIPNIGFKYDYSRASNYKEYNVDIENLVIQKKSNQLFESSIGGKIVFKPIATISNVVLTPSLYGNIERHFNHKNTKVNAKATFKGQILQETIIIPKQPKLGYNIGSNMLMSRKNINVLLEYNYYTHRKYQSHQGLY

SEQ ID NO: 15518 - protein, 747 aa, Bermanella marisrubri
MQYEVAGPERSRRVAAPVGRFGGRRWRSSLCLGMLIAAHPGAAALAGTAAKSDTQKNESVQEGTRQRAAGARPAGGELKAISVSASKDAADDPSIATVGKMPLALREIAQSVSVTTRERIEQQNLFSLDDVMQQSAGVTVQPYVLLTTAYFVRGFKVDSFELDGVPVVLGDMASSPQDMSVYERVEILRGANGLLHGSGNPAATVNLVRKRPQYQFAANASASIGSWGRYRAQADIGGPLNPAGTVRGRLVAAYEDRGFFYDRAKQDTRSIYGIAEIDVTRDTLVTVGAQYQSVASVPDMSGVPMARDGSSLGLSRSTFLDVGWGHFDWDTTRAFGSVEQKLGGGWKALVSGEYQAVRSDLKYAGSYGAIDRATGAGGTLMGGAYQFSGYSRSVDANVQGPVRAFGLAHELLFGATYASSSNGQLSAPLLAGAGTPVNVYRWNPDSVPEPGIGPYRQDMQNDISQKGVYGLGRIKLAQPVTLVLGGRVSWWSQDSLGAHYNAGRQFTPYGGLIWDVARDWSWYASYAEVFQPQTKPTWDGSILTPVKGRTYETGIKGELSGGKLNVSLAAFRIDLDNNPQVDAAHPCAGRSCYYVNGGSVRSQGFEFEANGRITPWWSVWASYTFDTIRYAKDVANGGAFAAELTPRHLLRLWTNYDLPWQERRWSIGGGVQVQSDFSAASNGVTMRQGGYALASVRLGYRYDRQWSAALNVNNLFDRTYYQSLSQPGWNNRYGEPRNVMLTVRGQF

SEQ ID NO: 15519 - protein, 810 aa, Bermanella marisrubri
MAMKKLLIASLLFSSATVYGAEGFVVKDIHFEGLQRVAVGAALLSMPVRTGDTVNDEDISNTIRALFATGNFEDVRVLRDGDTLLVQVKERPTIASITFSGNKSVKDDMLKQNLEASGVRVGESLDRTTIADIEKGLEDFYYSVGKYSASVKAVVTPLPRNRVDLKLVFQEGVSAEIQQINIVGNHAFTTDELISHFQLRDEVPWWNVVGDRKYQKQKLAGDLETLRSYYLDRGYARFNIDSTQVSLTPDKKGIYVTVNITEGDQYKLSGVEVSGNLAGHSAEIEQLTKIEPGELYNGTKVTKMEDDIKKLLGRYGYAYPRVQSMPEINDADKTVKLRVNVDAGNRFYVRKIRFEGNDTSKDAVLRREMRQMEGAWLGSDLVDQGKERLNRLGFFETVDTDTQRVPGSPDQVDVVYKVKERNTGSFNFGIGYGTESGVSFQAGVQQDNWLGTGYAVGINGTKNDYQTYAELSVTNPYFTVDGVSLGGRLFYNDFQADDADLSDYTNKSYGTDVTLGFPINEYNSLRAGLGYVHNSLSNMQPQVAMWRYLYSMGEHPSTSDQDNSFKTDDFTFNYGWTYNKLDRGYFPTDGSRVNLTGKVTIPGSDNEYYKVTLDTATYVPIDDDHKWVVLGRTRWGYGDGLGGKEMPFYENFYAGGSSTVRGFQSNTIGPKAVYFPHQASNYDPDYDYECATQDGAKDLCKSDDAVGGNAMAVASLEFITPTPFISDKYANSVRTSFFWDMGTVWDTNWDSSQYSGYPDYSDPSNIRMSAGIALQWMSPLGPLVFSYAQPFKKYDGDKAEQFQFNIGKTW

SEQ ID NO: 15520 - protein, 196 aa, Bermanella marisrubri
MKKPILLLALLSACSYANAAANDVSGVYLGGGFGTTDFDDDGGFGSANINDNDSTFKLIGGYQFNRIVAVEMQYTKYGDLKLTHYNSPINGTVEHSSVSLAANVGYTFGSGWRPFAIAGLGSIEQSGKAYGLSDSDSGTSFHYGAGVEYTPKTLGGLAFRVAYEGDLFVVDSGSNNIDDDYAMTIGTLYAGATYKF

SEQ ID NO: 15521 - protein, 695 aa, Bermanella marisrubri
LSLSLSFLLHAEDDGFYTSVGYQIGEAAQMVTNTKGIQQLSDNYEKLNNLLNNYSTLNTLIKLSADPSAINDARDNLGSSSRNLLDVKTNSPAYQAVLLALNAAVGLWQVTSYAFTACGPGSNESANGGIQTFNNVPGQNTTTITCNSYYQPGHGGPISTENYAKINQAYQIIQKALTANGANGDGVPVLSNTTTKLDFTINGDKRTGGKPNEKLIYPWSHGKAISTSWNRGTSTPTSESINTENNAQELLKQASIIITTLNEACPNFQNGGSGYWRGISGNGTMCGMFKNEISAIQGMIANAQEAVAQSKIVSENAQNQNNLDTGKPFNPYTDASFAQSMLKNAQAQAEILNQAEQVVKNFEKIPKNFVSDSLGVCYEVQGGERRGTNPGQVTSNTWGAGCAYVGQTITNLKNSIAHFGTQAEQIQQAENIADTLVNFKSRYSELGNTYNSITTALSKVPNAQSLQNVVGKKNNPYSPQGIDTNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKDSDHAAQHGIELGLKIPTINTNYYSFMGAELKYRRLYSVYLN

SEQ ID NO: 15522 - protein, 439 aa, Bermanella marisrubri
MISTKKLFWLVLLLVVSLTHAAYADGFKIGEQSVKASGMVNAFTAQADKPSAVYYNPAGITQLNGLQFETGVSAFSSSVTFKSAGTSYWGTNGETTSADDDVILVPHVYATYKLNECWSFGFGEYTNFGLGTTWPDDWEGRYITGGVNAEVKTINLKPVIAYQPLKNLSIAVGADIQNFEVTLEHKILNVDPTNSANVGKDLHAKLNGDSWNTGLNFAVLYWITENLKLGASYQTAIEQEIEGAVDISGTHVYAPLQTSLIGSHDATAKVELPPFFTMGLAWMYEKWTVEFDVEWVGWSTYDKLEVESPTLEAVTQKKISSTKNWEDSWAYKLGAQYGLTETLDLRAGVCYDAATAPLSTLDPLVPSQDRWLMSLGAGIELSNFTIDAAYVLVLDNADEFNNNVGNYAESFGKAYLGNVTGSFDSPKVSVFCLGLTYKL

SEQ ID NO: 15523 - protein, 447 aa, Bermanella marisrubri
MQRQFTLSPIYLLIGLASSTAYAGGFQINEHSATGLGRAFAGDAVIGDNASVISRNAAAMTLFKQNALSFGVTYVKPDVTVKNAQYHRANINADVNVGMGGFPPSPQVDITPSFSQTVTDIDDVDGVGQPAVVPNFYFIHPINDDWYLGLSAYSNFGTDMEFKPNYGAPVFGGVTSVASVNLGASLAYKVNDRFSIGGGIDVIYGSGELYRDMDVGVCVGGNILGNELEQRCGSVKGNALDVEAGGIGLGANIGMMYEFNERHRLGLSYKHSPNIDAKGDIHFAGESYDSLAMPLPDIAEFCGYHRVLPKFALHYSVQWIGWSAFDSLKADDQLLKDFQWQDSAHYSIGATWYANERWTLRTGYMFDKTPVDELTSLSIPDSNRHWLSAGASYQWSSDTTVDIGMTYLIGEDVNVEEYAYKGVPAPMVTGVTHSNAFLIGAQLSHRF

SEQ ID NO: 15524 - protein, 424 aa, Bermanella marisrubri
MLTKRMGMLALGIISASQAMAEGQADSKGFVEDSRLTVNLRNAYINRDYKNDREDKSEWGQAFMGTFASGFTQGTVGVGVDAFALYGIRLDGGKGRSGNGGIDFFKQGDSGAAADDLSRAGAAVKARFSKTVIKYGDQMPQLPVLSYDNSRLLPESYTGTMITSKEIDGLEVVAGRFTQEARKSAEGRDSGDLKSINVYGASYKFTDEFSAAFYASDNEDVLKKQYVNLNYVFALPQDQSLTFDFNGYKTKLDKDFTTSDARDNKIWSLAATWAVGIHSFTLAHQRSTGDMGYAYGGYRNDGGFGDGGNTIYLANSYWSDFNGKDERSWQAAYGVDLSSLVMPGLSYKAAYVRGDNIDDGTAGSGDGTEREIFSQLTYVVQSGPAKDLSIRLRNSFLRVSDDAQAYNSEGNETRIFVDYPINVF

SEQ ID NO: 15525 - protein, 426 aa, Bermanella marisrubri
MPKLTLLAAATAVAFTGFAHAQDLTPQELQAQLTQLTQEVNLLKQQQAVNAAATPSEPSAPAFEIGGRIQLDYNLFNGAYNAEHNGSRAQEIFPRRVRTFVEGELSDWDYKLLLEFAENTAEIVMARMRYSGFENGPKLQLGKLREDISLDALTSSNHIALIERSSLADTMSPYFRWGVSAYQYFPTTGLRYALGVYKNDAFGSDGKDDTDDLNFALSSRVTWSQATEPGQVLHAGLWYSARQMDGDNLSASFARGELRETNTRLINYVAGGETAAIDRLNQVGLELAFQHKALLLQGEYAQRNLTTQDPLSVLDGERYEAYYLQASYFLTGEQRSYSKGSAVFSQPKGVTDAWELAARFSSVDASSDFQGTQAQTYTLGVSYYFNPKIKVMANYIHSSVDGAGTIALVGNEDVGDAFAARLQYVF

SEQ ID NO: 15526 - protein, 350 aa, Bermanella marisrubri
MKRNLITVALLGWAACASAQSSVTLYGVADGWVGQTTSKAGTAPTDRTSVVESDGLSASRWGIRGSEDLGGGLRANFVLEQAVSIDNGTIKNVSASNVGFNRAAYVGLSGGFGEVRLGRMLGAFDALRGPFNQLYDASGFASTGTVWGLGTTASSSQAAVTSSDYLARLNNTFMYATPVLGGFSGSMSYSPGEGITTATAAPRSISSHVKYANGPLKIGYGYQAEHYTTGTNKFKLASGAYDWGVARLVASIQRQDDSRIAGGQSANEWQAGVDVPFGAAILAVGYASSKTKNAAGVEVADARGLSLMGIYSLTKRTRLYAALRKVDARRTDGSTSTEASRYGIGVSHTF

SEQ ID NO: 15527 - protein, 670 aa, Bermanella marisrubri
MQIKDMRGVLLCSASAMALALSAPVAKAQDVSEEDGFLGLLVLGNNKREVQTDTAAPETVINAEEIQDRQASSIAELIDSVPGVALVNSGTPTGAGINIRGHGADGTYGANQKVQIQIDGASVGSEELYRIGTQLTTDPELYREVSVIRGTVGSFEYGSGVIGGVVRLDTINASDLTDGQVGLSGRQTLGYHGNSNARISSTILGWQPTENLEFLFNYTRREQDDYTDGNGDVVSDTASEVSSLLLKGKYSFGDNAAQSLTLSFNESTSDEKDVPYDAFAGNAAFGNVDRLTETKSAVLEYAYNPLGNDLVDLTATLSYADQYIEQEQVSGTPFGIQDADHRYETTKLTVKNSALFQAFGAKHTLRAGAEILRKERLNAASAPGGTDQRLALFAIDELDFDNGLTVTPALRYERQEIEASTDGNNIRAGETFNNSALMGGVSARYAFQNGFAVFGSVAYTAGFPIIDDVDYADYPTLMTQTEKAVTHEIGASFDRVGVFASDDVVMAKVNLWQTRLWDYTSSGSSFAEFDRQDTKGVEIEASYSHMSGFYVDMNANISSGHWTKFQSGTNERYRERYDGMPPTNLALTLGKKFNEQLDVSWEGAFFKRFEDTPGFAVHNLRASYDIDTGFLKEAKLRVGVDNLFDKQYQTHLATRPAPGRNIKVSLTAAF

SEQ ID NO: 15528 - protein, 652 aa, Bermanella marisrubri
MKKTILLSLSLSLYSSLLHAEDNGFFVSAAGYQIGEAVQMVKNTGELKNLNDKYEQLNQYLNQVASLKQSIQNANNISLVNSSLNDLKSLTENNYNSTTQSPIFNAVQAVITSVLGFWSLYAGNYLTFFVGNKDTKQPADVSGNPPFRTVIKNCSGIENCAMDQTTYDKMKNLAEKLQAAQTNSTTKANNLCALSGCNATQDQTPNSTVSNALNLVQELMDLIANTKTAMMWKNIVISGVSNASGAINSTGYPTQYAVFNNIKAMIPILQQAVTLSQSNNTLSSKLQAQATGSQTNPEFAKDIYNLALNQKQVISYAKDIFNLFNSIPADQYKYLEKAYLKIPNAGQTPTSPYRQEVNLNKEVQTIQNNVSYYGNRLDSALSVAKDVYNLKSNQTQIVAAYNGAKNLSQEISQLPYNQVNTKDIVTLPYDKNAPAAGQYNYQINQEQASNLSQALAAMSNNPFKKIGMISSQNNNGALNGLGVQVGYKQFFGESKRWGLRYYGFFDYNHGYIKSSFFNSSSDIWTYGGGSDLLVNFINDSVTRKNNKLSVGLFGGIQLAGTTWLNSQYVNLTALNNPYSAKVNTSNFQFSFNLGLRTNLATAKKEDSEHSAQHGIELGIKIPTINTNYYSFLGAKLEYRRLYSVHLNYVFAY

SEQ ID NO: 15529 - protein, 994 aa, Bermanella marisrubri
MKNKLLKKLILPFLFLVGGIMYGQTITGVVSDATGGLPGVSVNIKGTSTGTQTDFDGKYSIKANQGDVLVFRSLGFKTEERTVGTSSTINLTMVEESNQLDEIIVVGYGSTTKKEITSSVTKVDEESFNKGTVNSASELLQGKVSGLSIYNKGGDPNTDAVIRLRGISTVGSNSQPLIVIDGVIGASLNNIDPSDIASMTVLKDGSAAAIYGSRGSSGVIIVTTKRGRAGETQVSYNGSVAMSSIQNQVQNMTGDEFVAAGGTDLGSRTDWLDLVTRNAVTTVNNVAITGGYDDTSFRVSANFRNAEGILKNSGFDQFNTRFQASTKLLNDKLKVDFNASYTQRESDFGFNEALRYAVLYNPTAPVLGADSPYPYNGDPYGGYFETLGLFDSFNPVSIQDQNQNYGERSEFTYSANFKYTVTDDISLNALYSQQSTNLTNGEYYKTTSLFRGGADNPFRKGLARLYTEDRDFKLFEVYGDYNFKPTDKLDFKLTAGYSWQQENFFNYFLAAGDFPNDDLAYINALEWSQDQLNGGFIEVNSNKSPDQKIIAFFTRLNVTFDDAIYFNASIRREGSSKLGENNKWGLFPALGIGADLNKYLQLDNVDLFKVRLGYGVTGSLPSDYGLAYSKFEPTSDLLSNQRLTDANPDLKWEEKAETNLGFEFTSGRLNATLDLYTRKVSDFILERAVDIAVYPSGRRVENGGDLSTNGFELAVNYDIIKNNDLTYNSGIILSSYKTTLDSYNLPGLRGNLGAPGQNDTNVILVAEGQEIGQIYGALWDGTVTNGSQNFVDVNGDGSIDVNQEFGNAVDSDGDGVIDGDLTKLGKGIPDFELGWTHTVRYKNWDLNAFFRGAFGHSLVNNFRVFYEPRVGSQGSYNFINTEYADPNITNAKFSSLYVEKADFLKLDNISLGYSFDISEDSKYFKDIRVSLTGQNLFTITNYSGADPEPAFTDRGSVDNGGFLTAGADPLTPGIDRRYNYFASRTVTLGININF

SEQ ID NO: 15530 - protein, 288 aa, Bermanella marisrubri
MKILLLASSALVAATVAASAADLPRRAAPPPVFQPVPVFTWTGFYAGFNAGYGFGTQDDRVPTVIGVGPASLLVPPGTTAVVAFSNRESNEGFVGGGQIGYNYQFTPGSGVVIGVEADAQYADFGRDRNRFLSTSPLAAQQVFNPGGLSGLDFFGTVRGRLGYAFDRTLVYGTGGFAYGSGGGREFGTGVSSNDFQTGWAAGGGIEYALPTDSFLNFFKSSAVTLKVEGLYVNLDRGTGGRGAFATDNQGRTVSIGSPGTVLVSGGQQVRDTEFAVVRAGLNYKFGSY

SEQ ID NO: 15531 - protein, 1056 aa, Bermanella marisrubri
MNLKDLNNLRADTEGRIKTVFLICMFVLVSAGGFAQNTKSISGTVREKGSNETVIGATVQVKGTHNGVITNENGEYTIKNVSPGQVLVFSMIGMNTVEKTVGSQNRIDVLMDAGVLIDEVVVTGYQTQRKVDLTGSVSSLSSDQFMQTNPLSLEQALKGKISGVQVMNNDGAPGGGITIKIRGASSITAGSSPLYVIDGFPLPISDDPLESPLATISPDAIESISILKDVSSTAIYGAQGANGVVLITTKKGSAGMSEISVKATYGISKLANSIPMLGAEDYMRAYMRDMIMSGRWQNADFYQEYKDQIWNTNPSRFQFYPDLCLQNGTKQNYEVSYRGGTDRIQNSTIFSLMNEDGIAINTGFKRFYFQTNNSIKLLPQLTLNTNLSYEHNIRSGAFWTEGNIFNEIQTFSPLVPKEWTFQEIDDNLYYTGKMDNPYRKLKDIDYSNKNNTFFGQAELVYNINDNWFVKGGIGVRIPKGEVKEFIPKTIQRGYDNNGLATYATQSGLNMRGVVQAGFNKVFNKVHSLSVNAVYEANTNKYETFNQEYSQFNTDLGWEGIYDAKSGNHVKSPGVSYEKIAMLSGVLMANYSYKGRYLLKASMRADGSSKFSPDNRWGFFPSGALGWRVSEEEFFKNVSWLEKNVNNLKLRFSYGQVGNDQIAPYAYAQTLSSSQRQAIFGDGAIPALYTSRMANPEISWEVTEEFNGGLDLDMFNNRLNISLDLYTKTTRDMLLEQNLPRTSGFGKVTRNIGSVRNRGFEISVGGVLIDKKDFTWNATVNFSSNQSKVMSLGAETQMLEGRPVGSASGSENVLIKKGYPLGLFYGLQMEGIRSNWHSDYNGIGSADSPWWYATEREMPYGFPSFADTNGDGKVDMSDRVVIGDVNPVFIGGLNTRLRWKFIELAMDFSWSYGNDIINGNVYNLMNNGDIRNKSAVYYKDAWFANNPTGTFTGPGAIDWSGYMWAASNSEMVEDGSFLKMNNLAVTFRMPKNILKAWKIKDLALTYTINNVFCLTNYSGYDPEVRSGSSVNNRILPGVDISAYPYARSHIFSLNFKY

SEQ ID NO: 15532 - protein, 1093 aa, Bermanella marisrubri
MLKKTKLVSLMLLAGTLAVPESAFAEITPERPSVSLSQQNGKVVCVVEDSFGPVIGASVVVKGTTNGNVTDMDGKVVLENLKKGDIIQISYIGYATQEITYTGQPSIPVTLKEDTQALQEVVVVGYGTQKKENLTGAVAAVAGDVLENRPITNVGQGLQGVVPNLNVTMSKGGAPGSSSDFNIRGNNSINGGSPLVLVDNVQMDANLVNPEDIASISVLKDAASAAIYGARAAYGVILITTKKGKSEQKPQISVSASGYWQSPALRMHNINSLEYLEMRDIAAANSGMSSLITPGQLDYVKKYMDGSYKYSEYFDQSQDQSRWIYCGNTDWFNELYKTSFSQQYNVNISGGDSKTTYYGSVGFADQNGILKTADDNYKKFNATLNLSSQLTKWLQVSAKIADNYSTEDHPITNSTAGIDAYGGMLKNDLSPLMPVRFGHTGRLVYSPGAAAINDSNLGIQTSGDYIYKEEGINNYSGQNGNTNPAAVGDLGGYTKYKINDLWLTGAVKITPLEGLVINADYTYNIYSKNASEVQRTFTDYTAVAGTEALYGWTKPSYANYTTNEDYYYAFNAFAEYSKSFLENTHNFKIMAGYNQEKKSNKKYNAKRTNLIVEDIPDLDLATGEQSMSSEDTYWAINGFFFRFNYNYKQRYLLEVNGRYDGSSKFAKDHRYAFFPSVSAAWRISEENFWQPLKGWWNDMKIRGSYGSLGNQVMDDLGNFPYLATYGTNSSYNYLINGSKPVIVKAPGLVAPDFTWETVTQMDFGFDASFLNNRLTGTFDWYRRNTKDMLVAGATLPATLGASVPKSNSADMKTIGWELSLGWNDRLENGFSYWVKGVLSDYQATITKYAGNDAGFYSQSDDDGKYYVGQKIGEIWGYHSNGLFQSDDEAATIDQSELYAGKWGAGDVKYEDLDNDGKITKGEETIYNPGDKSIIGNKTPRYQFGITVGFDYKNFDFEMFWQGTGKRDYMLSGAQFWGFTSQWDVPYTPALDYWTETNTDAYFPRPGWQNGGNRVTSDRYLQSAAYGRLKNLTVGYTIPKNLTTKWGISRLRLYVTGENLLTITPLNDAFDPETLGGMTYPINRKVAIGLNLTL

SEQ ID NO: 15533 - protein, 649 aa, Bermanella marisrubri
MASAHAETTPSNRNDVMTVYATGTERDSFDAPMMVTVIKNDSPETKTASTVNDILRKIPGIGVTGTSRTNGQDIYMRGFDRRGILTLVDNVRQGTDTGHVNGTFIDPALIKQVEIVRGPSALLYGSGAMGGVIAWETVDAKDLLREGQNSGFRVFSQAATGDHSFGFGGTSFGRTEQFDGLFSFVTKQVGDVRLSNGDDMENKETISNLLAKGTWQFDDKQKLSGQLRYYNNNAYEPKDPQQIDITKDNLKVNRTTRQRDAQATYQLNPESNDWLNLKATTYYSDVNITAKGKNTHYEGRTQKTYGLKVDNKTHLYDLPIAAHNFTYGGETYKQNQTPYASTTQFPDADITFASGFLQDEIALKDLPVSFIVGTRYDHYKATAKDNEDVKEGKWSSKGAVSITPTDWSMLFASYSEAFRAPSMMEMYNDEIHFQMGPIVNKWRPNPNLKPESTRTAEYGVGLRFDDLFTERDNLQFKASYFDTKAKDYINTYVNVDFRNPQNNYTTSINTKRAKIWGWDASMDYKNDYLGWNLAYNHTEGKDESNGKSITSIKPDSLTSNLNVPISDSGFSVGWLGEFTRHTDFNDASKAPRQAGYAVHDFYVSYQGEGQLKGLGTSVVLGNAFDKEYYSSQGVPQDGRNAKLLVSFQW

SEQ ID NO: 15534 - protein, 960 aa, Bermanella marisrubri
MKHSKLSLALAGLLGIGAIMAADDVMAMSYHVQGDRIFLSGGVTYADVVSLPALLAKAQAEGRPIREVVLRTSNGGALIAGEWLQGVIRTSGLNTIVSGHCISSCSIMQSGGVERYLAGDLPIIDSVQIHAASSGGKVIYTPSPRMTQIYTGNYGGGMDAGLLHKAMYEVVQPNGLLVFRDPARGTGPSVTFDPDGSGTKQESFPGQDIYSNRIITANGYRDPGDTLNVTVNVSGDINPGYLRTGRQLQTFVDDDFARWNTNISSAYISLAQGIYNASGNGPQGIGSRSVQSYQNDPLYKAALLSRLRLADLDVSTLDNSMGVIRVSNGATWRTSATTGADFMLVDNGTIALEGGALRAPEVRVLGAGMLVGHGDVAGTATEFSALISGTRPSWREDGFNRLRVFGTLMPRGGDLVTHGYVNIMPGGKVLFDVTENGGTGSGRIRVGSFFDQSSGKVNDGALVISKGAFLELNVAQGYYGQDFRRDLVQGPIYQGGFEEAVRLGDTGYSASITGGDVFRPRHNSLLSFNVKQTADGLWLTANPGFDQVGLFANGTSGDGLGRALATASDRQDNGLKSLLGALQFADRDVIAQQAGALRGDAHASLRLADTALVGSIGNVVQQHQSAMRSGGDADGLASQVAQSVSSQPGMRHGSLFNQLAMHLVEPASGSVAGSGDAGRSHGIWARGFASHGRIDADGGVAGLSHTIGGIVIGADTRVADDRVTLGASVAAADMSTKASDGSGFTGDVRALDVGGYLDATYSRGYLSAAVRYTDLRHDTRRSIGGIDGLQQPLRARYSNDAISARVEHAFSFTTGKGLVIQPLLPVVDYARTSATRFNEGQGAGALVGRSGSLESIRVGAGLQLFKTFEGNNGERITPRARVVWQKELGDSRARYSTGFAAAPDLVFGASSQRVGEQVLAWNLGVTSRASERLSIMADYVGERRDGQIQNGVMLGLGYRF

SEQ ID NO: 15535 - protein, 690 aa, Sphingomonas sp. SKA58
MSLKTTAAPCALLLAALAGPAFAQQPATPPSEPTVLDSVIVTARRNADDPAVVAEARARLSRTPGAVAVVSAESYADRYAPNLADVLRDAPGVYAQKKWGGDIRLSIRGSGIGNSSHNRGTLLAQDGVPFNEADGFGDFQLIDPLIARYTEVYKGGNALRFGGALLGGAINLVTPTGRTAASNLNLRLDGGSYGTVRAHAEVAGVRGDWDGFAAVTGQSVDGWRQQSEGKSLHLSANIGRSFGQDREVRLLVSGGDIHQEIPGSVSLNDALTQPEKANLGNLSLNYQRNMQSIRTTVQTHWRLDQSTVFEGAVYGTWKDLDHPIFQVIDQESRNYGAFGRFDWQGQVAGLRADAFYGAWYRQGDLDAKQWANLAGQQNGLRARSFQNGKGLDVFGEGRLFVTDRLALVAGGTWGRAERDYQSYVVPGVAGTIDLSVDKTFDWFAPRAGLLWESEEGDQVFANVTRSVEPPNFSALSPTADGYQPLVPQEAVTWEIGTRGRRGPVTWDVTAYRAELDHELLNFLPNVTGLPATFNAGPTVHQGIEAGLDWRIAPQWRLRQTYAFSDFYFDGDKVYGDNDLPVVPPHLYRAELRYDHPAGWFVAPSVEWSMADSWVDYANTLKSPAYTVANLNMGWTVRDGLTVFADVRNLFDEAYVSNFSAVTDARLAGVSTAVFFPGEGRSAYVGVRMSY

SEQ ID NO: 15536 - protein, 365 aa, Sphingomonas sp. SKA58
MSKMRGQMKKILAVVAASVAANAVSAQSGVTLFGIADAGIEFNNNAGRNGDSVVRLVSGNQSGSRWGLRGVEDLGSGLKAVFYLESGFDIDTGNSAQGGRLFGRGAYVGLDSHYGSLLFGRQQTAMREFGNIYDPNAIADRYGILSIAPEFGARADNAVKYVGKFGRLTAQAFYSFQANGSEVAGSNVFGRNFGAFVNYASGPFALGVAYDDAHVGTPSNQAPVLRRVSVAGTYAVSDAKVYVGYRLAKAYDGAMLPGAQEANAGSNLYWLGLAYKLTQAFSLTGTAYYQDFRQTGSDPWQFVLTGDYLLSKRTDLYASVSYALNKDNSALGVNGFNSGSGTSAVFNVQPGKNQAGAVMGVRHRF

SEQ ID NO: 15537 - protein, 394 aa, Sphingomonas sp. SKA58
MSMQFGSQGCARALAAGVVIALYAGKALAVDGIALSGTGVKAAGMAGTSIAFPQESSSAADNPAGMGLIGSRTDFGIQVLEPLTDFEYGSPSNTLHTGKVYPVPDGGANWQINPRLTFGVSLFGTGVGTSYGRPALTVPGAGVAKSSLQTMIAAPTVTWRLTEHNIIGIGLSLAYQRFSANGAIVPADDGTLQPLPSHGTANAFGYGIRVGYIWQPASTFTLGASYASRIRMSKLSGYENDLLAAGGGRIDIGAQYGIGVAYKVIPSVTLAADWLHMEFSNTIIGSAQGFGWQDQDFFRIGVSWDVNQRWTLRTGFSHGNHPIGPSVVAQNLLAAMPVSTSVAVGATYRIGERDGVSGIFEYGFPVTVKGEGASLGFNEQTKTEVFGVSYGHKF

SEQ ID NO: 15538 - protein, 763 aa, Sphingomonas sp. SKA58
MSNHYLTPTDSNGLRCELKQIVIAAGLCLIGASAMAQQETTLSTVNVEAAADASFKTEASPQGKFTAPLLDTPKTVQVINEEIIKQTGATSLQDALRSTPGITFGNGEGGNPTGDQPFIRGMDAQSSTFVDGMRDIASGTRELFNVESVEVIKGADSAYAGRGGAGGSINITTKKAKNENFISGDVGLGTDNYLRGTLDINRKINETTGIRLNAMGHSADVPGRNGPDNKRWGIAPTVTFGMGTPTEVTLSWQHLQTDSMPDGGVPYLYSNAAMAKLAGGSTVRPSYGSNSANWYGMNNRDYQKEKSDLFTASVEHKFTDTNKIRNSLRYSKSKQDYVWTQPDDSKGNVLNGYVWRRGNFRFSDVETLQNVTEFTGKEQTGSIGHSYAFGLELSKEKSDAQSGAIQDGTTSTCTSLNMWCTSLNNPDASTPWNYAWDKGRTTRNKIDTIAIYGFDTLKFNEQWLLNAGLRVDHYKTSTAAPDYTNPITNAKSAAFDYSRSDTLFNYQLGLVYKPAANGSIYANIGTSSRPGGSTLGNGSEDLAITSDALANLKPEKTRSMELGTKWDLLDKNLGLTAAIFRNNVTNVRITDGTGAVFMGGDKVVNGLELGFTGRILSNLSVFGGYTYMDSEQKNAGQTCSGTPLKCVTSAANGQAFINTPKHSFSLWTSYKPMPKLTLGLGVYAQSSVNAAYAYSNSGGIVTKGVGGYTRFDAMMAYQIDKNLAFQLNVFNLGDKVYYSGVRSPHYATMAAGRSAVASLKFTY

SEQ ID NO: 15539 - protein, 938 aa, Sphingomonas sp. SKA58
MKQFKPNLIKAALISGGMAFGSAPAFAQDANTDAVDEANLEVIQVSGIRGSLQRAQAIKMDNTSIVEALSAEDIGKLPDTSIAESIARLPGVTGERRNGRTSGISVRGFNENYVGTSLNGRELLGMGDNRGVEFDLYPTEIISNILVYKTPEAGMTTQNIGGSIDLQTVKPLTAESTFTVNGTFEKNAEDSPNPDFDNDGHRISVNFVDQFANDTIGLALTVASMESPRQEQHFRGWGYAGVNFDNERRDLDPVEVPEGTVVLGGHDSFQRSAMLERDSIAAVVEWAPTDKLNIQLDALYIDFVEDDVRRGLEEGGAEWGTSAYTITGVENGLVTSGYSDGFYSVVRNDARRQEADLTTVGINAEYQINDSWTLELDYSTGKVEKEIVDVESYSGVGRAGTEGRPITARSWEMTSSGVMFSDHPTIAPVDLTDPTLISLAGPQAWGARPLLESDAQDGFVNQPLFEEELDTLRFDVKGYVDWGVVTGLSAGVVYSDRSKSKDNNGAYLTAPSYPGNAAIPEVLGVTNLNFIGIDGVLAYDSLGLFESGYYIESDASRVQNDRLGDTYTVDEELLTLYTKLDLEMEVGDIWVRGNVGLQVVSADQESTGFSATSDRDGYTIASPVTGGADYTDVLPTLNLSAEVAEGQFVRLGLSKVISRPRMDDMRPNTQVTFSFNDNQITSPDIENGPWGGSAGNPELRPLEANQFDLAYENYFADTGYVAVSFFYKDIKNWHRSTSIVADFTEFYIPELHQGSEGQTPVLFTGQVSSVLDGFEGFVRGYELQGSLPFDMIHDSLEGFGLFASATFMDGEVDAAPGQTETRIPGLSEESYSMTFFYENAGFEFRLAATKRDQYLTEERGTSLALVDATKQGGTLVDAQIGYDFSESGIEYLEGLRVTLQAQNLTDEDDIQASAADGRQITQFQTYGTNYLLGFNYKF

SEQ ID NO: 15540 - protein, 977 aa, Sphingomonas sp. SKA58
MTAFRHCRHTRLSQALLLASLSPLAGLDQQTPAPQQLDAVTVTGSRIKRVHAEGPAPVQIIGADEIRAQGFTTVYDMLGTLNQAIGTVEADVSWGSHTPNASPLNLRNLGPNRSLLLVNGRRVADYPLPYDGQSNVSNYSNIPAAAVDRVEVLTGGASAIYGSDAIAGVVNVILKQNYSGDQFRMRGGTSTEGGRDTADVSWAGGRTGDHWSVTYALQYTSRDPLFGRDRPQMDDASDAPYSAWTTEQRRVGFRPSSGIALIDNATGTRQAPPPGACDQFGGEYYLADRLLYNRNTGVTTNTGQLCGLSADYGQWLLRSGSKDLSGYLYGTWEFGNGVQAWTNLAVFDSEAQWGTSPPYVQLPAGLDYPAFYDTASGQQLIGVRQFTASEVGSQAGLRNRNRERSWDISAGLRGTLADGRFDWEASLGRSYYRVQERISTVDWQRANDYFLGPQQGTVDGLPAYTLDRARWWTPLTPGQYAQIGAHSVNRAASWVNQGALSLSGRLFEGWAGPVEFAAVLEAAQQGYRLNPDPRANVDYEVQNVDRGGGERTRYSGGLEFGVPLTATLTATLAGRFDRYGDYTAFNDAADQLDIGTQKESTWSVGLQWRPINSLLLRGSYATSFRAPDMHYLLGQPSSAQVRTLDQYRCIASGAYQINNCTGDNTEVTYPFAINRRGTPDLESELGNSWTVGFVWDAFENLSLTADFWRIHLEEEIRDIDETTILRDEAGCRTGLTITPGQAWSNPGGADYCASILARVQRNAAGAITAIERGPINLAQRDVSGIDLSARYQLKTGIGDFQMGLDYTNLRSMREQTYRTDPNPERRDRDIRSKLRGSVSWLYGNWNATVYGDRVGAVPGVRSHWGLDRLDNPGGCVPFADGGVPDDRANCTDTDPASPTFGQSTRKYYGRIGPAITWNVNVGYRITPAMKLNLYVNNVFNSTGYNHKDPYKLDYEFYNSRLFSPAGREIAAEYVFDF

SEQ ID NO: 15541 - protein, 331 aa, Sphingomonas sp. SKA58
MADVTLYGTIKAGVQTYRSVEHTKGKVSKVETGSEIADFGSKIGFKGQEDLGNGLKAVWQLEQGASVVGTNTGWGNKQSFVGLKGGFGTIRAGSLNSPLKNTGANVNAWESGKFTGNVLEISGMAQREHRYLSVRYDSPEFAGFSGSVQYTPKDNSGSNGESYHVGLNYQNSGFFAQYAGLFQRYGEGTKKIEYDDQAYSIPSLFVEKLQVHRLVGGYDNNALYVSVAAQQQDAKLYGAMRDNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 15542 - protein, 233 aa, Sphingomonas sp. SKA58
MKTCITKGIVTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKRKEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 15543 - protein, 171 aa, Sphingomonas sp. SKA58
MMQTTLLQLLLFGRTNYKERLQQNFLASGRKQQVEGVVSTLGYRFSDLGLLVSLDSGYAKTKNHKEPPARSSSSSSKPRYDEKRYFVSPGFQYELMEDTNVYGNFKYERTSSDEGKKTHEQAVLFGVDHKLHKQVLTYIEGAYARTKTNDKNKTEKTGKEKSVGVGLRVYF

SEQ ID NO: 15544 - protein, 808 aa, Sphingomonas sp. SKA58
MTRLLTIVLLFTVYLNCFSQENSTIQGHITDADQKPLSGVNVLIAQLNTGTQSNEQGDFSIENLSAGNYTLTISYLGFKTQSKQVSVQNDGVLTLGNIVLYEGNEILNEVVINGERQNKFSRKKTAYVAKLPLKDIENTQVYSTVTNELLESQVVTNFEDALNNAVGIEKLWTSTGRGGDGAGYYSLRGFSVQPQLVNGLPGLTNGTINSANIERIEVIKGPSATLFGNAVSSYGGLINVVTKKPYAGTGGELSYTAGSYGFNQVTGDFNTALDKEENLYFRLNTSYASQQSFQDAGFRKSFFVAPSLSYKVNNKLSFSFYGEITQAEQTNPMFLFLNRSAPTEASNLDELGYNNKLSFTSNDLTLENPSQNYRLEMDYKLSDTWQSQTLLSKSSTSTKGYYSYLFDFGILGDDTFTRYISKQNANTETSDIQQNFIGDFKVANLRNRVVIGADYFTATQTSNNTGYAFYGNITPEGGSNGDNPFTPEVEEDAYPLSSSGVDAALESQAIGNNKSKYHIYSLYASDVLDITNNFSAMVGLRLDHFDNEGDISSAEDDYNQTTLSPKFGLLYQPIKDRLSVFTNYQNGFTNVAPQLVGNPEDGPQTLQTFDPEQANQFEVGLKTNLFNNRLDATISYYNIQVTDRVITDPSSPFNKIQGGEVESKGFEIEINANPVNGLNIRAGFSNNESTTTKSDNPEILNRRPLEAGPETLYNFWANYEVQQGSLEGFGLGLGFNGASERFAINYESTGEFILPSYTIANASVFYQANKYRITLKLNNAFNKEYYKGWTTISPQTPRAVLANVSYKF

SEQ ID NO: 15545 - protein, 808 aa, Sphingomonas sp. SKA58
MKARMFIGASLVALTVSSPVFAQAGAKTEVSEPSQNEGIQDIVVTAQRREESTQKAALSIVAFGGDQLRSAGVTDAGSLAKLAPGLQISGGTSSMIYIRGVGDYGVTATSNSAIATSLDGVVISRPQDISGNFFDLQRVEVLKGPQGTLYGRNASGGAVNLITVAPVLGEFSGYAEVNLGDYDQYGIEGAFNVPASDDGAFRLSYSLNRRNGYLSNGGDDDDREAVRFQARFKSGRLSLRAQLNYLHRGGVGTGFSVLGRLPGMSPWTGNTDPAAGAAYIAAATAQFNGALAAGCNPAPNGNCPPPPSLIANPSDSRLFQDIETFGGHMQLDYDLDWATLTVIPGYRRSTLAFSSQPSFMYNVGGVYDSAGNRSKGELSDQYTLEARLGGESGVLKWVAGGYYLKEKQTNDFTIQAGPILNQRTTGALTTQAFAAFGQLTFNVSDRFRVTGGIRYTSDKRVSDRLAQAAISPSVIIPDPVISGLPPIPCLPDVPVPGANPPGTNCRLLAADPTIYRSAITFNKVTWKAGIEFDVATASMFYADVSTGFKAGGFSQALSLTDPTKLQSYAPETITAYTVGLKNRFLNNRLQINLEAFYWDYKNLQLSAQGLDGAGLVTILTQNAGKSTIKGASVSLEARPWHGMTLHGAVDYVDSKYDSFVITQPTQFVPPGRTGCIQTYSGGFATVDCSGFPLVRSPKWSGSAGFTQSFDMANGGTVALGGDLSFASSAYLFTEFLPIQKQGSYANLSASLTYTAAGDRWFISGYVRNITDEVIYTGGSGQSSAFVQGWVSSSIAPPRTWGVRAGLKF

SEQ ID NO: 15546 - protein, 379 aa, Sphingomonas sp. SKA58
MGDMMNAKSIAAAALAVAQAGLAHAQSSVTLYGALDAGVLWQNTSAASFSPTAPNTGAVVRFKDGGVYSSLWGIKGTEDLGGGYRVNFRLQGAFDGGTGKFGLSDAPGAVAAFNQIATLGVSGPFGTFNAGRQIVPMIYAMADTDVRAARFFGSVLTAWLGLNTAAGWPGNSTNAPIGALYDSDALVYQSPAFGGASLALEYAPGGVPGGVQRGARASIVLKYASNALNLAAVYYNGHDTNPAPGASATGLDNNRFVYVGAQYKLKDVAVSASYGNGRNPARGDRVNLDMFAFGLGYRVSPFFRVSSGVYYLKDRNRSANRSTSIVLGADYELSKHTTLYAQGGRVDNRGTMAQMLAYGQPVAPGLATTAAMLGMRHSF

SEQ ID NO: 15547 - protein, 207 aa, Sphingomonas sp. SKA58
MSKIAIATAAVLAAGLSSAQAADLPYGGSRAPYTVYQPLNAHSWAGPYLGGNLGYAWGDVHNSATEPSGVAGGVQAGYNWQSGQFVYGLEGDIAITGADDTFASWKFSNPWFGTVRGRAGYSFDNLLVYATGGLAFGELKGERFGQSNSSTNAGWTIGAGAEFGLNQNWSAKVEYLYVDLGGSNFSITGVQNSYQFGILRVGVNYHF

SEQ ID NO: 15548 - protein, 3225 aa, Sphingomonas sp. SKA58
MALGLTSASNGTVQINNAGVIDSRPLAGLSILGSDTPVIAVTGGGIVNAVNTGTINGRVGFQSSATGNTFVNSGTINGSVSMGAGSTNSFTAVTGGSVNSAGGLALELLGPGGLLSFAQTGVVDGGLGGNNTLILQNSAVGTGSGSTGTGTLSTAQYINFGNLRVNSGTWSVGGASNFANSALNGGVLQFANAAQLGSTITANGGTLEATAAGLTLAPSNGVALGAGGLTVQGTNNLTVGSAITGTGALTKTGTGGLALTGTGTFSGGVNLVSGALTVGTNSALGTGTVTASGGSVLAGTAVNLANAFSLSNTVGIGGANALRIGGTVSGTGTLNKVGAGTLTLGGSNTYSGGTTLGAGSVLLETSGALGTGTVTAAGGLLDNTAPLTLTNNFALTNTLGLGTSGNALTLSGTLAGVGGVNKTGTGTLSLSGTNTYSGGTTLAAGTLQLGTASALGTGALNVTGASSLSTTAPLTVTNGISLAAPLNWTGTQALTLSGAINGAGSLIKSGTGDLTLTNANTYTGGTTLSTGRLVVGSNAALGTGTLTASGGELDATAASTLGNAIALAGTLGVGGSGNGLSLTGTISGAGALNKLGGGTLTLAGLNTYTGGTSLNAGTLQVASGTALGTGALNVTGSATLQNTAAAALSNAVTLSTGALTLNGAQALTLGGAISGAGSLVKACGDLTLSGNNTYTGGTALNTGRLTVGSNTALGSGTLTAAAGTTLDSAAVSTLANAIALAGQLTVGGSNALTLTGGIGGAGSLDKLGPASLTLSGNNSYLGGTRLTAGSLILGSDSALGAGSLNVSGGLLDSTAARVVANNVVLDADLQLGGSQDLTLTGGISGIGGLIKDGAAALTLTGANTFAGGMDLNAGRLSIGSGAALGSGALTAAGGTQLQATAATTLGNDVVLNGALSLIGNNTLGLTGTVSGTGSLVKQGTGALTLNGNNSYAGGTVLNDGALVVGSNTALGSGALTAANGTLLTAAAAVTLQNALTTNGALTIDGQNLTLDGAIDGAGSLIKTGAQALTLNGNNTWSGGLQLQSGSLLVGSNTALGAGTLTAAGGTALDASTAVALGNAVALNGTLTLPGTQDIALNGVVSGIGGIDKQGNATLTLSNANTFTGGVALDAGRLVLGNNAALGAGDVLVNGPAELDATAALTVGNNVVLNDQLTLVGSNDLALNGSIGGTGSLIKNGATTLSLTANNSYSGGTSLTAGTIAVGADNALGTGGLSVLGNSVLSNAVAVALGNDIALGAALTVDNAADMLASGAISGSGSLIKTGLGTLTLSGNNSYTGPLAIQAGTVVASTSASLGNASTVDVAAGALLNLANGGLINALSGAGDVDTATGATLQLGGGDFAGSLGGGGNLDKVGTGTVRLLGSSAIGGSTQVSAGTLDVVGSLGTSVLNVASGGTLTGTGAAGNVGAAVTVSDGGRLALTSGSSLSVGALTLAPGAFVDVALAAPSATRLLAVNGDLTLDGTLNITDLGGFGTGVYRLIDYTGALTNNGMLIGLFPGSVDISQLALQTAIGQQLNLVVTAPGSIVQFWDGVQTTANGTVDGGAGTWGAATNWTGQDGSANSTWQGDFAVFSGTAGTVGVQGTQNIGGLQFVTDGYQLTDAGAGALAVIDPLTAIRVDPGATASIDVAITGTGGVQKLDTGTLVLSGPNTYTGGTALGGGSLVLGNAQALGTGTLTAAAGTTLDTNQALAIGNAVVLDGALTVPGSNNLALTGAISGAGSLIKNGTSTLTLDGSNSYLGGSVLNAGTLAVGNNAALGTGSLSVLGDATLINAIALALGNNVNLGANLTIASADDLALTGVLSGAGALTKTGLGTLTLSGSNLFSGPVSVQGGVLATTATGTLGTTASVDVAAGAGLSLGSNTALSSLTGLGNVAIQGGSTLQLGVGNVSSTFAGGLNDAGNLEKVGTGNVQLTGTSAIGGTTQITAGTLDVDGTLGSAGGVTVGTGGTLSGSGVVNAAVTVNDGGRLVVTSGALLTTGSLSMASNATLDAFLGIPSQTGVLAVNGDLTLGGTLNITDIGGFGTGVYRLIDYTGTLTNNGMGFGTLPGTVDPTQLTLQTSLAQQVNVVLLASGSNVQFWDGAQTVANGSADGGTGVWTAGATNWTSVDGLTNSDWQNSFAVFAGAAGNVGVQGTQGITGMQFITDGYVLSDAGGGALSANAANTIIRVDPGVTGTIDVAIGGTGTLQKLDTGTLVLSGANTYTGGTALGGGSLVLGNAQALGAGTLTAAAGTTLDTNQALALGNAVVLDGALTLPGSNDLALTGAISGAGSLIKNGTSTLTLSGNNSYAGGTVLSDGSLAVSGNSALGSGTLSVTGDSVLSNAVAAALGNAVTLGAALTVDNPADLTLAGNISGSGTLIKTNTGVLTLDGNNIYSGGTTIAAGTLVGDSASLQGAIVDNATLAFNQVADGVFTGSITGTGTVIKQGAGALLLNGANGYTGGTTIAAGTLVGDTASLQGDITNNAALVFNQAAGGVYAGAVSGSGSLEKTGSGVLQLLGANTYTGGTVISAGSLVGNTTSLQGDVVDNATLIFDQASDGAFAGVVSGTGSVIKQGAGALTLVAPNTYSGGTTIASGSLIGTTDSLQGNIVDNAVLVFDQATDGTYAGNVTGSGVLVKNGTGALTLDGVNGYLGGTTVNAGTLVGNTASLQGDITNNSTLTFLQNSAGSYAGRLFGVGRFIKLGTGTLLLTANSSTFTGPTEVNAGTLSVGNPANPGAALGGPVTVGPGGTLTGSGSVGSLVSSGTVAIGGAGGTISVGGNATFAPGSTLQVTPGDGGVVTPVTVGGAATVATGTTLALVRATDLPLFTEIPVISAGGGLTGQFTNVVSDYAFIEPNVSTTATALSVTFGRNTVGMVDAVTTPNQQSAAAAVDGLPNTSPIYQAVVRLPDDPEAVRTAFASLSGESHASTATALLDSRFLNSGIGNHLRGDSQDTLVGDTTVWITGRSLPNRVDGDANAVSVRREDNGVMAGAERRFGERSVVGIAVGNQDIESWSREWGDRADVDGTHAGVYGWADWSAFSLRGAVDYASYRVDSTRRVMLPGVLEERLDSSYDATAVTVSVEAAWNLLTNGAVYSPFIAADYTRLKTDGFTERGGISGLSVDSASDTFSTATLGMRGHWDLGQKAALYASAGWRHAFGDRSVQRSAGFVGTASEFSVQSVTLAKNAAIGELGVSLITSPRSRLALSLQGLSGDGQTAYGGQVTWGVSF

SEQ ID NO: 15549 - protein, 349 aa, Sphingomonas sp. SKA58
MMTQPMPGKPAEDAENELDIRGLFRTLWAGKLWIIGMGLAFALIALAYTFFARQEWSSTAITDRPTVNMLGGYYSQQQFLRNLDVRSNMASADQPSVMDEAYKEFVMQLASWDTRREFWLQTDYYKQRMVGNSKADAALLDEMINNIQFIPGDFTRAVNDSVKLIAETAPDANNLLRQYVAFASQRAASHLNDELKGAWAARTIQMKAQVKRQEEVAKAIYDRRMNSIEQALKIAEQHNISRSATDVPAEELPDSEMFLLGRPMLQARLENLQAVGPAFDLDYDQNRAMLNTLNVGPTLDPRFQTYRYLRTPEEPVKRDSPRRAFLMIMWGIVGGLIGAGVALTRRCSK

SEQ ID NO: 15550 - protein, 185 aa, Sphingomonas sp. SKA58
MRLVLLSLAASLVAATPALAAGDAGAYVGVGVTHDNLASSGDDEGVGINGVGGTVFAGYNFDLTSSVYAGVEANFDLATAKIGDDTDSLEADYAFGGSALLGFRPSDSTALYGRVGYQRGRGTLTVDGTEYSDSADGLRLGLGLQADLTEKLGVRVEYNHTHYYGENGSTGLNNNQAAVSLVYGF

SEQ ID NO: 15551 - protein, 190 aa, Sphingomonas sp. SKA58
MRKLLVSAALASAMAMSAPATAGFFDFTLAPYVGASAGESTTDSCITGTCDDADTAWKIYGGLEVNEFISMEVGYVELGEVEYSAPTGTRGTHGMILQLVGSYALGPKFTLLGRGGMNILNTEVEGAVAGARGNEGDTDVSWSLGLGAQYNLTKSVGLRVEWERYFEVGDPDSTGEADIDLLTAGVVFKF

SEQ ID NO: 15552 - protein, 719 aa, Sphingomonas sp. SKA58
MPIQRLSRTAVAHAALLALCGAAHAQAQPENVPEATLAPVTVNAGAEKENPTGAVVGFTAKRAISATKTDTPLIETPQAISVVTRDQFEAQGVQTLRQTTAYSAGVVSNYFDSRVDSFSARGGSVSQYQDGLLRTYGTYNTSRPDPYTLERVEFLRGPSSVLYGQGSVGGVLNLTSKRPQAEALREVQVQMGSYGRKQIATDLTGAVTEDGQWLYRLVAVGRESGTQVDHVNDDRLVIAPSLTWRPSADTSLTLQALYQKDKSGSLIGFFPWQGTRLPSPYGQIPTSTFIGEPGWDSFDTENKSWGYLFSHRLNADWTVRQNLRRTISDVDYRSIYTSFTAIPGQGRPARPVFNPDNRSVYRDASWQVNGGRMLVIDTQLEGRLRWGTAEHTVLAGMDAQRNSTSQSTWRGLTAPFDVYNPVYGNFTPPTASQLVRQPGVSQKQLGFYAQDQIKWGRWTATLGLRHDSAQTDTEGRPASAVDEKAWTKRAGATYQMDGGWAPYLGYSESFQPLGGVDVYGTPYKAQRGEQWEAGVKWQPPGQGLSAFAAVYTLREKNRKTTDPANPLNSLQIGEVKVNGFEAELTASLARHWDATLAYAYTDAVISRSNGGDQGQRVTSVPRHTASAWLTHRFASEGRGGWSLGAGVRYTGSQWTGTSLVDTPSATLLDAMVSYDAGPWRLAFNVVNLTDKVQITQCLARGDCFYGQRRTFAVTGTHRF

SEQ ID NO: 15553 - protein, 288 aa, Sphingomonas sp. SKA58
MRRRSRIPALARSLTLLAGVGIPCLAQAADLLPPPPPMPAPLPEPEVFAGGWYLRVDGGYGSLDLRKSIAEDVSHPPKPYDYAVVQDKVSNQYFIGGGVGYQINPWLRVDATGEYRFRSKWSFVAEDKTFGDTGGYNVTSGKFDSIVGLANGYVDLGTWYGVTPFVGAGVGVAHHSFGGVTDSGFGAYEGGYGIGRRNERTNFAWALHAGLGYAVTENVRFEAAYRYLNMGEATTGVVTCAPDCPKTVYRVKDLEAHDVKVGLRYLFGAPVAVAAVDYAPPPPLVRKY

SEQ ID NO: 15554 - protein, 447 aa, Sphingomonas sp. SKA58
MRHLARVAGGAAVLLAAATPRAQEPEPAAEEPAAAVASPGDAQAEAVEAAAEPEGAAAPAARASAQAREPRPREAPAPAPASPAPASGDRGDLLSPGFRERVRIALGPLEIAPIALLALQAAPYVGDDALGQAGDSAERPGFRLRRVRAGLRGDVAGLVRFAISTELAGDDEGTARIHEAWAGITAARAIEVIAGARTVPFSRSAMTGAGDGALAERPLAVRAIAPFTQVGIQAEGHFQDRAFSCHAGVYNAFQRSDQFYAGPSESLAPLGNRFEGIAVAGRVATEPRGPLGRALQDVARSPFRLGVGADGFFSDGGARTLYGASADVLVHAAGLHALGEVLWTGASPKAVPTQPIAQITSISSLALVFEAGYMLIARKLGVSGRVEWIDPNLDIDDEGDNLVLTGGASYHAYDDLVKAQLEVTHREELGGLSLSNDVLLLQLQLSL

SEQ ID NO: 15555 - protein, 372 aa, Sphingomonas sp. SKA58
MRKLAKKIIRIIKMKLKLVAVAVTSLLAAGVVNAAEVYNKDGNKLDLYGKVHAQHYFSDDNGSDGDKTYARLGFKGETQINDQLTGFGQWEYEFKGNRTESQGADKDKTRLAFAGLKFADYGSFDYGRNYGVAYDIGAWTDVLPEFGGDTWTQTDVFMTGRTTGVATYRNTDFFGLVEGLNFAAQYQGKNERSNVQEANGDGFGLSTTYEYEGFGVGATYAKSDRTDAQNNHNSIFKADGKNAEVWAAGLKYDANNIYLATTYSETRNMTTYGSNVAGIAEKAQNFEIVAQYQFDFGLRPSVAYLKSKGKDIAVFGDQDLVEYVDLGATYYFNKNMSTFVDYKINLLDDNNFTRIAGVSTDNIVAVGLNYQF

SEQ ID NO: 15556 - protein, 771 aa, Sphingomonas sp. SKA58
MTDRTTTVSLLLGISAIALGAAAPAAAQGTPEETVATTGGGLEEIIVTARRREEAMQDTPISVSALSSASLERSNVQALDDITRLMPNVAIQAQSGFLAGNTAFIRGIGSQEPLLSVDSPVGIYIDGVYIGRNNASNLELVDLERIEVLRGPQGTLFGRNTTGGAISMVTKKPASEFGVEQKVTVAQYDEYAARTRIDTGLLGETGLSATLSYMHRQRDGWLNNKYAKGSHTQGALNTDAVWAKVHGEWGAFQADYTFDWTDMRGVPGGFQTRFLSPLLRAYYGNTTGNSLLDEVQQDYNKNFSVRSKALQRVKIIGHALTLQYDVSDDITLKSITGRRTYKAALGTAYAPPGIFGNTTAGIQEVQIYSADAKDEDVKQFSQEFQLLGKLGDFSYVGGLYYFEEDSKYFNPTSYSFVVSPTLASNLSSSTIFDYQAKSYAAFGQASWKPQSLDEKLELTFGVRYTKDKKAVQQTASTVRNGKASFDDTSINAIVSYKPVDDVMVYARYGTGYRSGGFNTRASATQSFVFEPEKAKTYEAGIKSEFLDRHVRLNAAVFHTDYKDLQVTQYLATAAGGGGFTNNASARFRGFEVELQAVPVDGLTLDGSVGYVDPKYNEIFFIVPAAPVPGHTPGAGEVAGGLGNYADISKFPYVPKWTVHLGGQYLSEDIGFGKLLLKLDYSYSSKRYFMTNVLNGLNFADAIADPGQHQFDARIGLVEVPVAGKSMDISLFVENLTNEHNISSGIDFGALGFAGNIYSPPRRIGVDAKISF

SEQ ID NO: 15557 - protein, 170 aa, Sphingomonas sp. SKA58
MVLATTAAADLNVHGALKGGWTDLDYGDGDFPAGTDVDSTDHTFSLLAGLTFPVARDRIHLGGEIAQTYLGEYTAEFGGADEDVKLYGSEVVFAGFFDVATGTRLFVRAGGWAWESDVDHGDDDSGFDPVWGAGFTYGLDNLLLRGEANRYDADDVKVDAYTIGLQYQFM

SEQ ID NO: 15558 - protein, 444 aa, Sphingomonas sp. SKA58
MAFSRFYLLTALYTGGILASSAYGIPSNYPEHHHRLIERLKKNSTQDSDSSPSESSPHPRQEPRRHVLTPVHNVLKDRPCDEGLSISKLLHSIEKETNSQISVDFTILPQWFYPKKAALATVDEKQPTWQFYISPNVSWQLYNSPTAGVGSIDFSYTLIRYWRNSAQNANNAAGIAGGINDYSSRTNTLSQLTFSQTFPGDILTVAMGQYSLYSIDGTLYDNDQQSGFISYALSQNASATYSLGSVGAYVQFTPTPSINIQAGFQDAYNIVGTSFDVYNLTKNKYNFYGYFSWAPQCKLGNGQYSALIYSTRKVPQQPTQTTGWSLNFGQHLGEKLYVFGRWNGATGTAINLNRSYVLGLASANPINRNSQDLLGAACSISKVNPKVVTEKRIRKYETVIETFATIGFGPHISLTPDLQIYIHPALRPDKRSAKVYGVRANFSA

SEQ ID NO: 15559 - protein, 217 aa, Sphingomonas sp. SKA58
MLPILLIKLILTQLITTVFYKGYRQVMKNAILLLSALTISVPTFAAQEQTHQSYFYLGTGNVGFDTPYFGSDRDNEWSTPHITVGWGYHVNQYLAFEGVLRYSQNELKNDKLKTDLDLHYYQAGMSAVLTSDNLGDTPLSLFGRVTALGTQAEMYVPNQQKVTDDSGALFNIGAGVHWDMSKDIWLRAEYIYNVADMGFEDFYDSYEGVQVSLGKRF

SEQ ID NO: 15560 - protein, 738 aa, Sphingomonas sp. SKA58
MPAKTLPLATLSAALLCALTMTPAAARAADLADADANAKTLDAVSVNGTVSRAQPATTTRLPLTLQETPQSVSVIGLQRLEDESLFSIDDVMRNVTGVNVSFYDTQRPLYFARGFQITDFQVDGLPTYSGATNQEYDTVFYDRIEVIRGANGLLTGAGIPSATVNLLRKRPGKEFDASFAVSAGTWDFRRMQADVNAPLTSDGRWRSRVVAAWQDRDYYYDRYHDTKMSGMAVLEGDLTESTTLTVGYQRQDNTPVGSTWGTVPFFAADGTLANLSRSTNLAPEWTRWQRETSTAFANLEQRIGEDWLLRVNAAHTKGNVQSLRVYGTGYPAADGSGMFLRTGVGETEDTRDSVDVYLSGGFSLFGRQHDVVVGGSWQDLQSTSYGLAQTYPDDWATCPNAFGPPERCYFIPNIRNWDGNASEVTYARNGRRSEGRTTQRGVYASTRFRLADPLSLIAGARLSSWETRTQAFDASGAYTGTSGRYEVSDEVTPYVGLVYDIVPDVSVYASYTEIFNPQNYRDKDNNLLAPVEGSNLEAGIKAQLLDGHAMATAAVFEAKQDNFAVRDMTQPESSLPDGNSAYIGINGTKSRGWEMDINGEILPGWTVNAGFTHVKVTRPPTDAIYANLPEDYLQLSTQLRLPGAWERLSIGGGVSWQSAVRGFNIARPTGDGSGATTPVTVVQNPYALVHFNANYRISEQWTATLAVRNAFDKTYWANLDYQNYGEPRFVSVSLRWRY

SEQ ID NO: 15561 - protein, 819 aa, Sphingomonas sp. SKA58
MSKPLPSALNPLAKALLIRHSLRPRHALSRIGMGLALSSALVFQVQAQEWTLDIPAQSMNSALQALAKQTDTQLLYSPEDIGGLRSSALKGRHDLQSSLRILLQGTGLRYQIDGNTVTVTASAAAKDGQIELSATNVNSAGLGETTEGTGSYTTRVTSTATKMNLSIRETPQTITVVTRQRMDDQHLGSMNEVLTQTPGITMSQDGGERFNIYSRGSAINIYQFDGVTTYQDNQTRNMPSTLMDVGLYDRIEIVRGATGLMTGAGDPSAVVNVIRKRPTREFKSHIQAGVGSWDYYRAEADVSGPLTDDGRVRGRFFAAKQDNHTFMDWYTQDRDVLYGVVEADVTDTTVARFGIDRQTYKVNGAPGVPIIYTNGQPTNFSRSTSSDARWGYDDYTTTNYTFGLEQQLAHDWQFKLAAAYMDVDRDSFSSYYSTTTNRSYLELDGSTEISAGIVTAKQHQKGVDATLQGPFQLLGQTHELIVGYNYLEYENKHRGDSGPDVNINFYDWDNQTPKPGDDEIIPGIQYNISNRQSGYFVASRFNLTDDLHLILGARASNYRFDYALWRIGNEPAPYKMVERGVVTPYAGIVYDLTNEQSVYASYTDIFKPQNNVDITGKPLDPEVGKNYELGWKGEFLEGRLNANIALYMVKRDNLAESTNEVVPDSGGLIASRAVDGAETKGVDVELSGEVLPGWNVFTGYSHTRTEDADGKRLTPQLPMDTFRFWNTYRLPGEWEKLTLGGGVNWNSKSTLNFARYNSHVTQDDYFVTSLMARYRINESLAATLNVNNIFDKKYYAGMAGSYGHYGAPRNATVTLRYDF

SEQ ID NO: 15562 - protein, 140 aa, Sphingomonas sp. SKA58
MSKGGGTVVANLGYRLSEYYAVEFVYQNFLVSQYNTTQVNNYFAGAAKYYYKINNYITAYAAAGLGIGYTNINGIANQRNAPASYLATNNTWGGFAVFPVGVMFPIKYVDNLSLKVTYTYSISFSGNSQNFVTSGLQYSF

SEQ ID NO: 15563 - protein, 792 aa, Sphingomonas sp. SKA58
MVARCINLQCIAFLFSFFPTLAFPVTEEGEVVFDIETLERLGYSAELAKFFSGQDRFLPGQHDVTIIINASKTYRIAATFDSEGKLCMDKALLMALKLRNTESDGSCENMEARWPGMVVKLFPGQFRVEITLPQEAFDPEMEGSEYQQGGHALLLNYNIFGQRVESNNSRFNLVQGQFEPGINFKNWVLRNRGSYSYNQGVSQYYNQETSALRAVESLKSVVQLGEFGLVGNTFSGLPVTGIQLYSDNAQRDDTQLIVPIEGIANTNATIEIRQRGRVIYRTIVAPGPFSLSNISNFSSGVNTDVSIIEEDGTQQNFTVTSALDINAEQQASIYQLAVGRYRDMFTGEDRPSPLLLSGEMSFNPAATFYMTSAGLLSSGYQNIRVQNLYSGWDQAWFSAAASYANTKDAGQGYQFSVQNQMTINGNFGVSWSSVYGSANYWLPDDALSSSNNLNDLMFGKLKNATSVAVSWVHPRWGAFSYALSNNMYYQASGRTYHIFSISEQFGRATTILSSQLSSQGQNSLYVGINMPLGNGTLSGRVQRNNGNVALGSTYQGRWGDNKDYSVGISGDNRQRRINGSMNIRTAYSQLTGGVSQATNNSRSAYLSSRGSVAYVNNTFATSSSSVGDTFAVVNIPNQPGLRVSSPSSGIAITDYAGIALLPLVRPYTASKVQISTQTLPLNIRLNNTSADLLMTRGSVATHHFETTETRQLLLTIRGSDGEMLPIGANVLDEKGNFLGTIIGDGNFMLENKAIGVTLRVKANNRDECRVNYREPEKFDPDVLYEVADAVCQ

SEQ ID NO: 15564 - protein, 212 aa, Sphingomonas sp. SKA58
MRIRKLALLAAALSVPLATPVLAADAILEQPPVPPVAETLPQSFIWTGGYVGGYGEYKWGEFDALAGDDADGFGGGVYGGYNWQSDNIVYGVEGDLGYSGADASLGGVTGEQGFNGSLRARLGYDINPFLLYATGGLAATRAEVTSAAGSDTNTHLGWTAGAGAEAFVTENITTRLEYRYTDYGSETYNLGGTNVSSGFDDHSVRLGIGMKF

SEQ ID NO: 15565 - protein, 902 aa, Sphingomonas sp. SKA58
MSITLNNRSRLALSGASFLALALLASGPAWAQTSDTAGSSEAPRQRSDADRAASSVPEQVSEVVVTGSSIRGVPPTGSNLISVSREDIRTIGANTTPDLLASVPQLNSFNTAPRAANGGAGAFAPGLRSLPASATLPLMNGHRLVAGGTNQTNPDFPFLPELAIERVEIVADGASAIYGSDAVAGVVNFITRQRYSGVDTSIRYGTADDYHTFSASGLVGRSWDRGSVVAAYQYAENGDILGGDRDYRIVDLRPYGGVDTRTTVCPSPNVLVNTTAYAVNYAAPALAPNTTNSCDNGAVTSLVPKSRLHSGYLTARQDLSDRVTLWGELLYSDRKDTVQAPPPPGAGASGGVILYNLPGFANPFFKTPPGSGATTEFVQFRTDNLYGADHINNVFRVRAGNSSAGLDAKLPRDLKLTVSGTYDWATNDTYLPAINPAALDAAALGTTTATALDPFGNGTSPAVAAKITDYAGDLVIHQRTYLGAAKIDGPLADLPGGQLKVAVGAEYRHETFQQRGIYGGSQVPEDLTRNIGSIYGELFVPIVGDGNPAPLIRSLALSLSGRYDHYSDFGSTTNPKVGVNWDPVRGLTLRGTYGRSFRAPGLRDVGATVGAYYYNAAAIAGSTFRDPTRGAAQVDTIFLLGGNRNLQPEEARTYSIGADLHPDFLPNFHGSVTFYDIRYTNVIGTPGGAIAFTDPTFSSVIYRNPTAAQLNSLLGIAVPVNFVPGALPTIGNLLDFRQGNFGVRKTNGLDFDLGYRQPTSFGALYAGLAGNYIFKFETQLSPTAPVSDSLKLGIPTTTLRGTLGAQAGLFNAVAFVNYRGGVTGLYATPTSAAEYSAKAYTTVDLRFSVKLPYGGLAKRTELGLQVNDLFDKDPPFFPQAEGIGGAYNPIGRYLALNLRKSF

SEQ ID NO: 15566 - protein, 739 aa, Sphingomonas sp. SKA58
MPTYKCYVITNLGYQTHSSQVILHSMISPLFQSRRLVTTLCLLASSAGYVNASEQVELAPSTIRAAAQPQAEEHLDSVTNAGSRLPLTALQTPASTSSLDGYEVRRRGDANVQQAVARSPGITAIGTPGDGGTALSARGFTGQGSVMQLYDGSRMYSAMGTVTLPVDTWAIERMDVLRGPASVLYGEGATGAVVNVIPKKPFEGEIENHLRLGYGSYDSQQTALDSGGSLTDQLSYRLNLNQLRSNGWIGDGDSQSTFFSGALRWQANEDLSFALAHDGGNQRPMNYFGVPLINGRYHEVLRDKNYNIENDKQHYDDQWTRLTTDWQVSDNVTSSNELYYLTSHRRWQNAENYNWDAATQQLSRSGYFSIKHNQEQVGDRQTFTFKHSLGGLDSQSVLGMDVNRIRFKLTNNSPYNDVNPAGDPIDIEHPVPGLFQSASPYSELFKSTTRQLSVFGENRTQLSDQLSVITGVRRDYADIERNNLRDDSRTEKDLIGNNWKIGLVYALTPDSSAYAQYSTSTDGVGSLVSLNPTQQQFDLATARQSEVGFKQALWDQRLEWTLAAYHIVKKKLLTTDAGNPDLTQQVGQQSADGLEASMKLQLPQDWALTANAAIVRARYDQFDQGVSGVSVSRDGNTPVDVPRRTANLWLDKQLGSSVQIGGGLRYVDSRYADIANSEKLPAYTVADASLSWKALRNTTLGLQARNLFDRQYAASQYNEGQQWILGEPRSLFVTADLSF

SEQ ID NO: 15567 - protein, 708 aa, Sphingomonas sp. SKA58
MFARLKHSTALVALMAGAGLAAPALAQQAEVDGDVIVVTSAPLGVTADEIVGAVEVVDRRHLEDNLSGSLADTIAHEPGVSTTYFGPAASRPVIRGLGADRVRVLVNGVGLIDASTNSPDHAVASEALEAQRVEILRGPAAIAYGGAAIGGVVNVIDGRIPEERAEDGLEGRFYGSVTSVDDGETAAGRVRFNAGQFVINLEGLMRTAQPYDIPGYAESETFRLFEEAEEHEDEHDDDDEEEHEDEHPYGTVENSGLDFNSASAGISWVGENGFIGVAFKQTNALYGVPGGHAHGEEEHEDEHDDGHDEDHEVEHGEGESVRIDLEQTRFDLRGEWRDLGEHVDRVKFSFGTGSYEHVELEGDEIGTLFTNEGWEGRLEARHVAIDLWGGSWEGAAGVQAFSRDFAAIGEEAYVPPSETSDWGVFLVERWDAESWGLEGGLRLERRELDTASDSRTFETSSLSGSIFFRPVRDTFLAVTLSSSERAPTDVELFADGPHVASSTFELGDPDLDIERAVSAELTARTRLGDWSLEASVFRADYDGFIAAYATGAEEDGIPVFAYSQDDVVLSGFEGRLEGPLGAWGGWDFDGELTGEYVEASLDAGGDLPRLPPLSLTAGISASRAGHDLHLEAEWADVQDNTAPFEFKSQSYVIVNARWSFEPLPERDMRVILEARNLTDAEARLHTSFLKDQVPLPGRNFRAALVLDF

SEQ ID NO: 15568 - protein, 738 aa, Sphingomonas sp. SKA58
MKTFSIIQKHSVLNKTKVSFVNQRAYWAAIWLASLSCGSIAQAQTNEVSASAATASSGSSTNVSKLENVTVFGQLEEARNKIVADLGATTYTITQQQIEAQSQGQNASFNQVLLRAPGVAQDSFGQIHVRGEHANLQYRINDVILPEGISGFGQTLDTRFVNQLELITGTLPAQYGFRTAGVVDIHTKNGAFNSGGDASLYGGSFSTIQPSFEYGGKQGDLNYYYTGSYLHTGQGIENPTGSNDPIHDNSDQFKGFAYLSYVLDDTSRLSLMLSGAHGYFQVPNNPNQPPGTDPNGNPFPLGGVAFNSSSLNENQTEQNYYGVLAYQKILGDLNFQLAGFSSYSSVLFRPDSTGDLFFNGVASRVDRHILTQGVQGDSSYDINEAHTLRGGIQGTASKAVADTSTTVFAIDGAGNAVPPPFAIVDNNSLWGYLFGAYLQDEWKITDKWTVNFGARVDAYHAVITESEFEPRLNAIFKATEKTTLHAGYARYFTPPPLESISRTTVAKFENTSNAAANSQNDPVRAERSHYFDVGATQTLVPGLNLGLDGYYKIAKNQLDEGQFGQALIETPFNYNHGEVYGVELSATYKKDGFSAFGNFAYSVAKAHDINSAQFNFDPADLAYIKNHDIFVDHNQTFTGSVGVSYQWRKTLAYVDMLYGNGLRADGAVPNGRKLNSYSPVNLGIEHSFQVGKNLLKARFDVVNVFDETYELRDGTGIGVGAPQFGSRRGFYGTLSYVF

SEQ ID NO: 15569 - protein, 182 aa, Sphingomonas sp. SKA58
MVRFCGWLMVFCCFALPAYAGNSPYSFSLSTGFSRIDSPSSSDEAWVTQFGYNYQFSPFIGLDLGYSGMIGNGAEMLNTQKQKIDVKVEGFYFGAFFEQPINNLTILYARGGLSQFKVKERYELGAIGDNRQFSGTNPYIGIGTKVQSSIDKSLALTMELSYYPLEQDYSSLSFTVGGQYRF

SEQ ID NO: 15570 - protein, 1413 aa, Sphingomonas sp. SKA58
MGEITQEQAKALTKSITDKAEKVKVQADAQLVLESAQKEAQKAAEDALYLKNENVSYQAFAQTEEKIKKEAADAKNKQDGIKETAIKAVIVNSVALAPDAKDIADQVTKAVIDTTKVQGEKAVELDKKTTEAQKAQNAKEANTAALADIEGRLKPVAEALTQATDTDKVKLDGKLQEAQEAKDTKDGKNDDGGYKKLFDAHEKTKKNLTIAEDDNNSGQQDKLATAKENQAKYNAAAKKELNAIAEAQEAVKAIDAKIRELTKKQGEITLEKTTETNKTDGLDSTLASANSAKVTAQGEFDTAKNAAELAKTAAEAIETAKITDKAVEDATAAHQEAADKAEQTQKDLKQAEAVKIKADQLVVDKDSLLTAAKQDLEKLIADQNSVQPTPDLPAIDVTIEPTKTQDVIDGTSAIATQVAGGTQNVAKGGKAIDSVITKDGIVNLAAGANAKGTEVTKGTLNNNGGVDTDTVVGAEGKLVLTGGSETAIATSTGAKVAAGGVVTAGNHSVIEKMISSGDVAASGNAIVRDTTINDGKLSLAGTATANNTTFNGGIFSVEGDTAATKTTMTGGKFAVTGNAKIDDTVLNASDFSLADNATANNTTLTGGTFTAAGDTAVSATNMTGGKFAVTGNAKIDDTVLSASDFSLADNATANNTTLTGGTFAAAGDTAVSATNMTGGKFAVTGNATIKDTVLSASDFSLADNATANNTTLTGGTFTVAGDTAVSATNLREGNFDVKGNATIKDTVLNASDFSLADKATANNTTLTDGTFTVAGDAAVTATNMSGGKFAVKGKAKIKDTQLSAGNFTLAENATANDTTLNGGKFDVSNEATATNTTINNGLFTLKDGAHADSTTVNSGTFVMADQSTANGIQLVDSAFTLASGAKASGITKLTGGQAQVAGSLESLSLTGGRADFANSAKASGLLDISADSQIIMNRGADTEQANLNLAGRLELLASDVAQAVAQPVARAAMELSNARAVMPAPAMPVPAAAPVAHFALNDVVMTGGTVDMSNAKNAQLTMASLNGTGNFNLGSVMQSDSVAPLNVSGDANGDFIIAMNSSGQAPTNLNVVNTNGGDARFALANGPVALGNYMTNLAKDANGNFVLTADKSAMTPGTAGILAVANTTPVIFNAELSSIQQRLDKQSTETNQSGMWGSYLNNNFAVKGRAANFDQKLNGMTLGGDKATALADGVLSVGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSTMGTLGVNAGYRFVMNNGAELKPYAIFAVDHEFAKNNQVTVNQEVFDNNLSGTRVNTGAGMNVNITPNLSVGSEVKLSSGKDIKTPVTINLNVGYSF

SEQ ID NO: 15571 - protein, 387 aa, Sphingomonas sp. SKA58
MALKRMALMSLLGWPLATVAQSSVTLYGVIDANVEYVNHAGVVPTAANGFNPGPANDAYRLTSGGLSGSRWGLRGNEDLGGGIKALFVLESGFGIDNGLSQQSGRLFGRQAYVGVQSSRLGMVSLGRQYTSMFEALANFSPTAYATQYEPVVMQSGPNYRADNTVKYTGKFGGLTALAHWSFGVGVALPASVGFPIPIGGNGEVPGQFRRDTAYGGALAYTFGPFAATAGYDQWNPTIGTGTGTIKKAAVGASYAFGPAKIMGGYRWGQNRNAADALIQRDDFYWVGANYQVTPALALTLEYNYDDLKNLYGNTSVANPWQISFVADYSLSKRTDVYVTTAYAKNAGLMLDSLATVFANSLSLGNSYVLGNGQSNMFGVALGIRHKF

SEQ ID NO: 15572 - protein, 822 aa, Sphingomonas sp. SKA58
MQPFTFAAVSSREQKNNHKNHQSMFQKIKCNRPLVIGLWLFTFLLTSNALAQTKYTISGTISDQNNGETLFGASVFLKGTAIGVVTNEYGFYSLTAPEGKYSLHISYMGYSEINQEISLTSNQKLDFEIAEFSTQLDEVILTADEPERAILRKPEMSVAKMNIATVKQMPVVLGEVDVLKSLQMLPGVTNNGEGTGGFHVRGGAGDQNLVLLDEAIIYNTSHMFGFFSVFNADAIKDVKLYKGGIPARFGGRVSSVLDVRQKDGNSKRFAATGGIGIISSRLALEGPMFNDKGSFLIAGRRSYADLLLKAAGKDNSVSFYDLNLKASYKLNEANRIFLSGYFGRDAFELGDNFNSSYGNSTGNLRWNHIFNDRLFSNLSVIVSKYDYDLGITAAEFDWVSSINNYNLKYDFKYYFSDKFKLDFGASGIYYDFDPGQIKPTTETSAVNAMSLDRKKAFESGVYVNAEHKLTDKLTAQYGLRYSGFARLGGQAMVDYENDQPVVYNTVLGIYERGTEIGETDYKKDESIATFGNFEPRVSLAYELNEVSSIKAGFSRAAQYIHLLSNTSSATPLDVWTPSGKYVKPQLSNQYALGYFRNFKDKIYSMEVEAYYKNTDNRIDYIDGSNLIGQNTIETEILNGESRAYGLEFLLRKNEGKFTGWIAYTLSKSEQRTPGGTAGGLGIADGEWYNTPYDRTHDISVSGAYKLNDKWSFGTNLVFQTGRPVTYPNGQYEYEGLSIASYAPRNSDRLPAYHRLDLSVNYKPNRKPEKRLKGEWVLGIYNAYNRKNAASISFGQNFETGANEATRTAIFGIVPSLTYNFKF

SEQ ID NO: 15573 - protein, 802 aa, Sphingomonas sp. SKA58
MKARSMSSQRILLSASLLALAAASPALADAQLSDRVDAVVIVARDKAGLLEKQPSQTVFGIDKPLIETPRSASLVSDLTLERYGVLTLDAATKVAPGTHTASFYGVPGSLNIRGTLAENYFRGFKRVENRGTYSTPIGGAARIEILRGPPTPVYGAGKVGGLVNFIPKSARDEGRFLAGPEGEVTATVGSYNKKLLTAQFGAPVSLGGAEGGVYVYGEAEDSHSFYKGIYPRHQTLELSADFDLGEGWSTAFGGMLFGSRGDVQTPGWNRLTQDLIDNRTYITGRDTTLKDTDGNGRLTPNEVGFYPFASALYIPYYGFFSTDAVHTLDAGVGTTKLDRRTVYISPADFSKTDTQTLYFDLAKDLGEDRALKLQLFHDRQDNKRYVSYGYPSAIDAEVSEVRLTYAFPTTLGAASARTLVGGSHRWFEGRRRESYNSGMIALDRRDISFGATPTDIIDSPFDDEPGGVGLKWENDNRSTWKQTGVFVTSDIDIGRLNLILGGRWDRYSVESQDTGFLSYTVTGRKTADRNKATWNASLTYKLPIGLMPYASYAKAAALEMSQGGDIAPGLVADGSWLSSSDLAEAGVKFQLLRGTLIGSLAAYRQNRTQITGAIAPPTVQGTRAKGVELEVRWLASERLSFTFAGNNQRTTIKGPDTSFQYIPAYTAGVPGAQAYGGSYVVWSFAGLPGRSGDYAYTLTPKSVLSLYGTYTSKGYDWGQAGATLGVSHVGRTSGTVQNAVRYPAYEVVNASAFVSRGPYTLSVNVDNLFDTFYFTPDADTYANLGALPGKGREWRATLKRTF

SEQ ID NO: 15574 - protein, 479 aa, Sphingomonas sp. SKA58
MKTVARVSVIALACAAGWSIPAHASTAKPDLAALQAQLQQMQSQMQSQMDAMQAMQAQIATLQNQLAEAKAKGDATATAVAAIPAPTVTGKPPVAITWDGGPRIESPVDPKNPKAGKWSFKPRGRLQIDAASVMAPSSIGSKSLGIGSEFRRAYLGVDGTIPGNFGYRIEADFANSSVELTDVFLTYNGIRNVTVTLGQQKPFESMEDTESDLFTSFMERASFNTAFGFERRLGLSAQYQKGMVLAQVGAFTDNVSDLNADSNNSYSIDGRFALQPKLMGGQLHLGGSAHYHDLNDGYSTVRYRARPFTHTTDVRFVDTKAISALSETNYGLEFAWTGGPLHFAAESQWMKTNRPGALADPTFNGGYAEAGLFLTKGDTLPYRLADGAWGRIKPKNPVDKGGIGAVQVNVRYDWLDLNDNGVIGGRQQLAGASLLWVPTDYVRFILDYGHMWINDAAVAAGTDRSYSADVLGMRAQFDF

SEQ ID NO: 15575 - protein, 918 aa, Sphingomonas sp. SKA58
MIARCSLLAQALCLSLCALCGHAAAQETQATTPAKGEMATLDKVTVAATRYNATDMQMAATNTVNVLSADDLKTTAVHNVAEALGLMPGVNVINTGQSYFGGIDGAARGEGMFSSVRGLNAEYNVNLINGINVAQGMPYSRGVQLSLLPPSGLQTIALSKTSTADMDGDAIGGTIDYRTPSAFDSTDRQGGSVTLSGRLESRARDYGDSGLGSGAAGDWHARFGDAGQFGVAVSAYYDERHFVNSEVAAASAARNDGAWKFGRADASGKLAAGADPQDVLQSTGMNIGYSQGDTRRYGGNAAFDWRVDPSLHLYARMTYAFAKTEQNTGYAQFVPANVSFTQIGTSGVYQPQINRVAVRYWYETNPEKADLATVQFGADKQLGHWTFSPNIFYGTGNNDRPDHVEISARNDQYSSTNFAYGANRFISYDGNGFPTPLLTPAMQAQASDVESLYARRTGQISKQYSGQDKGGGKFDVAYDFDAGLLSRIAFGVKYVDSSRNFTDRDWTNAKYTDRTLLRDTGLIAQRYDSVYPGQYAFPTVRLSNAALNDLIARTLTPASFDSCGKLAINNLNCNTMRATEAVSAAYAMATLRSGNWEILPGVRFEHTAITNTFWAQPAAINGAEQVGAFANNHSRYNVALPSVFVNYRPDGDGAVYRGSVWTSYTRPAFVQLGGGRSTDISSDGQTTITEGNPDLKPIKSLNVDVSGEWQNDSGGHAMLAGYYKRLTDYIYESGSNAANPGESVTASTRFVRPQNGGDGRVLGMEAAVRQTFQGLPAPLDGFGIGANVTRQTTRVDLGTEGFAHERIQNAPNLLANAELFYEKGPWSVNLSYHYSGEYVSVYDYLNQGAQWDNLWIKPITRVDLHLGYAPTDHLRVDLSVANLTNQHSYWAHVGHNTDAISDIVDSGMTSLVTAKYVF

SEQ ID NO: 15576 - protein, 152 aa, Sphingomonas sp. SKA58
MPICFPPKPVGGWKNKTAAKTYRWQPEVQLSYWFTRGYGFPLSNGLSAETDNFRSLMGRFGFRAGVDGLDGGRLNIYGKLMYKREFIGTIRHRFNGSAVEEFKHRGGWLEYGLGVVRRNAGNGRQLYFEAQRSSMHTMRQNWQVNMGVRSMF

SEQ ID NO: 15577 - protein, 255 aa, Sphingomonas sp. SKA58
MCAVLVKASLTAGAVASLALGTALAANAGGYTPPVVDTDVTAPVVESAPVGDWAGAYAGLTLGYAFGGDDRVGFTEVDTGTYLGDAGKLELGGANAGLHVGYRWQRDRWVFGPELGFEAGNIKDTITFDNQLGGSTDVSSKIRNVLALRLKTGYALRPDLLLYGIAGIARADVEYKVAGTDGSGGSMSESRDFKSNGYIVGLGVERKLSDRMSVTGEYEYANFGKTTRTFQVDGGVSTQATPDYHNVKLGLNFKF

SEQ ID NO: 15578 - protein, 1099 aa, Sphingomonas sp. SKA58
MRISLALLFAVVLQLSAENGYAQRTHVAISMNNVSVEQVLNKIEEASDYVFLYNDKTIQKNRIVSVRNKSGKILDILDDIFKGTDITYTVVDKQIILSTNKMQLVQQEGQIQIKGVVKDAGGDPLIGVNVKVKDSTVGTITDINGNFTLQTRKGDILEISYVGYATKTVKVQNAQVLNIVLTEDTEVLNEVVVTALGIKKEAKSLSYNVQQVSNAEITRIADANFVNNLNGKVAGVTINSSSAGVGGSSRVVMRGTKSLNGNNNALYVVDGIPMSDMSAASTQPTDSYEGAGQSGDPISGLNPEDIESISVLSGPSAAALYGSAAANGVVMITTKKGREGRTSVSISNNTTFSAPLVLPEFQNTYGQTEVGSYYSWGSKLNTLSSYDPKDFFQTGVNVTNAASLSTGTDKNQTYLSLGTTNAKGIIHNNDYERYNVTVRNVAKMLKDKLTLDLSFMLSSVKEQNMTSQGLYYNPLVPLYLFPAGDDFSKVQAYQRYDSERNLLTQYWPYSTSLALQNPYWITEHIKIPNHKNRYMATASAKYEFADWINVTARAKMDRNNERRERMYDAGTNTLFASKYGYYSKSNIENQQIYGELLLNINKYFVDNTLNVTANVGGNFENNDYQSDYFGGKLKSVANLFTFGNVDTSEKNLANQYGYHLKKRAIFGSAQIGYKSMAYLDVTARNDWSSTFKGTNTGSFFYPSIGLSGIITDIFRCSTDIMPYMKVRISYSEVGNSPDVFLAIPTYALVDGVPVTQSRRPNPNLKPERTKSWEAGFNFVFFKNRLRLDGSIYQSRTYNQFFERTLSSTTGYKSEVVNGGRVDNKGIELSLRFEDKWGNFGWSSYLTYSLNRNKVVELLRNYEDPYTHELTSLDRIDMGGTSMYKMILTEGGSIGDIYVNTLRTDEHGAIYVHPSDQVVVTQPDEFVKAGNSAPKYNLGWGNTFSYKGLSLGFLFTARVGGVVVSQTQATMDAYGSSKATAIARDNGGAIVNGRPIGAEDYYTKIGGAGAQGGIGSMYTYSATNVRLAELSLGYDIPINKYVDWIKGLNVSFIGKNLFFLYRKAPFDPELTASTGTYFQGIDMFMSPSLRNLGFSVKVNF

SEQ ID NO: 15579 - protein, 686 aa, Sphingomonas sp. SKA58
MRPLARPFFLIATLAPCAAHAQDAVQPEIVVIGTGLQAPPSAPAYNVQQIDRERLLETASGRLEDALSSVAGFQQFRRSDSRSSNPSAQGVTLRSLGGNATSRTLVLLDGVPMADPFFGHIPFSAIAPERLATARVTRGGGAGAFGAGAVAGTVELESANADQLGLVQAGALANDRGETELSGALAPRVGKGFAVISGRWDRGQGFWTTPVGQRVPISARARYDSWSAGLRLVAPLSTDVELQMRGLLFDDRRTLRFRGADTSSSGQDASLRLVGRGAWAFDVLAYVQARDFTNVVISSTSFRKTLDQRATPSTGVGGKAELRPPVGGNHVLRLGADYRLNDGDMAEDAYSAATGLVTARRRAGGKTSDLGLFLEDDWTLGRLVLNAGARADRWTIRDGYFLERSPSGATTIDSALDPAFADRSGWQASFRGGAVFRATDMLSLRAAGYTGLRLPTLNELYRSFSVVAPRSEGGIAITATQRNPLLHNEKLEGFEAGLDFTPAPGLAFNATAFDNRIRNAIANVTLGTSGNTTTRKRQNVDAVHARGLEFGARLRAGAISLDGSLAWTDAEVEASGISASLDGKRPAQTPRWAGTATLAWRPAERWSLGLTLRHVGAQFEDDLETDLLPSATTLDGFAQLPLHGPISLVLRGENLTGETIVTRLQDGSMDIGTPRTFWAGIRVEVR

SEQ ID NO: 15580 - protein, 592 aa, Sphingomonas sp. SKA58
MLQYTYRHAHENKNYYSGKLKDVAYCGILPNGDQRDIFPQLCGRSRVLPDNVDYHSRSWLAKLGYHFTPQHFVQGFFENLEQSRKILEKSFYASNRQEAGDITPYQRFGLSYNYTPTESWLNKFSVQLAQQKVSQQANSNQYGVSPQDYNIITDKRLYKTEQKHYQLDVSFIANEIAGKFAHHQLSGGLGYHWGKLENRNQEYGAYSRIKQREFTIQQPVARQAWYAYVQDLISINQKWGANAGIRFDHYRYKPTTSALKYDLASQKVEVLPKKQFSAVNFSLGLNYSLTDSTLLSYEFSTGFKAPKIEEMYFDLKGASDVQYLPNINLKPEKAQNHELSLTKEGDNYQLSLAVFYTKYRDFIDVETKPKIGSRQRTNWATKPITKYTEYYLDGVNYQQINIDKADVTGLDFHARANGKIVGLSKSWYAILKASYAKGRKNNGTAMLPIQPFSTTLGLGYQADNDKWNVLFSGRYVSAKKAKDAIDIPNVNSLQLDVDKKTGVVSDFRQPKPYRFLSSSYVVFDLTAQYRLNSHFTLNAGIFNLFNRKYTTWDTLRQIKENGALGDVYNSGKGLERFTAAGRNFALSLEMKF

SEQ ID NO: 15581 - protein, 443 aa, Sphingomonas sp. SKA58
MHRSTTVGVVATVLLAAATGDALASGFQIKEQSAAKLGNAFAGAGASGDDLSILFYNPAGLALFDRSQVQADSALIVPHAELSVTSATSGVGTAMTGGDGGDAGQGAFVPSLYAAWVLNDRVNLGLSVNAPFGLVTSYDDNWVGRYHAITSELKTFMITPMASYRVNDRLSVAGGPYLMYADARLTNGIDFGTICAGSLGVSTCAGAGVTPQGADGNVDLTGDAWGFGFAGGLLYEPIKGTRIGLSYRSQVELRVEGTADFTVPSRASFLTGSGAFTDSSVRGTITLPETASLSVHHDINPQWAVMADVVWTAWSRFEELRFEFDNPSQPDSVTPEQWNDTFFTSVGATYKPADGWTLRGGLAYDQSPVDDNFRTARIPDQDRYWATFGADYKFNGMVTLRAGYAHIWVDDASLNTSGSASGTVAGTYESSIDIVSLGASIRF

SEQ ID NO: 15582 - protein, 846 aa, Sphingomonas sp. SKA58
MGKCSQHKINKQPYNIEHSWLLLLPFITVGVLFYPAKTYSEDYFNIHALEIGTDFGSPEDIDLSIFTQDDYPPGIYWVDIYLNRDKIDTRNVTFVTINNKLLPKLTIQQLQDMGVKIDSFPELISLPPETELSDLSQYIPSASTTFNFSQQRLDISIPQAILNSQARGYVSPELWQQGLTSLLINYNYSGSNTWQDNPSGSTQTHYLNLRTGANWQAWRLRNYSTYTSRDKSWKSINTYLQRDIHALKGQLTLGDSFTPSYIFEGVQFRGLQLVSDDNMLPDSLQGFAPSVRGIAQSNAQVTIKQNGYIIYQTYVSPGPFVINDLFPTTTSGNLDVIIKEADGQEYRSTQSFSTIPIMLREGGLQYSITLGQYQSSNNRGREPNFTQGALVYGFSNNITAYGGTIFSKDYQSVALGSGYNFGILGSLSFDITHANTDLPSNISTKGQSYRFQYAKDLSLTGTNFTLAGYRYSTHGFYDFKEANDIENSNKSDWRYRTNKRSKLQLHINQSLGNFGSLYLSAFQQNYWQQPGYERNINAGYSTNYNNINYSLNYTYSQLPDTNKNEQLFSFSIQIPLDRWLKNSWTSYNFNTNKNKDISHQVGLSGTALQDNNLIYSLQQSYTNHGTGAGGHIHAEYKGAYGQLSTGYSYDRHSHQLNYGLQGGIVAHPYGMTLSQHLGDTLALVRADGAQGIKIQNNVGIATDWNGYAVIPYVSSYRKNRIALDTHSLADNVDIDVNAQTVIPTRGALVLADFKTRIGHRVLINLYYQENPIPFGAVVTLEKHHDIDEVNSAIVSHEGQVYLTGLPDSGRLFVKWGYKDIQECVVNYNLPEKTPLSGIYIIAAHCK

SEQ ID NO: 15583 - protein, 1095 aa, Sphingomonas sp. SKA58
MKITGFILLVISLQTTFAGFAQEKITLQLRDASIRTLLKAIEKQTAYRFVYSHNIISQDAKTTLNVHEASLDETMLLILKGTQLSYQQKEDHLVVIYSSTSAPEKAIGIRGRVVDAGGLPMPGVSVKVSGTNTAVVTDANGSYTIEVPDRTASLEFTFVGYARQVISVGSQTTLNVTMTAGSQDLKEVTVTGYTNYSRSQSASASSVVQGKDMTQASLSTFDQVLQGRVAGLQVSSGSGQPGTNAQVILRGIGTISGNTAPLYVLDGIPIENSYFQTLNSADFESVTVLKDATSKAQYGARGANGVIVITTKKGKTGKVQFSYRSQYGISKLSSPKFNMMNTAERLRFEEEIGLETGSEIGPGWTFSRNNPEYSDMTTVEQQRADFILDSISRINTDWKDIFFGTGKFVEQQVDASGGNDNVRFYSSVNYYKQDGIARRSGLERYSMRNNVDFTAGRLSASLNTSLGYSESSFIEREGSSSGNNPLSAVYYALPYEAPYASDGTLVHYGNSDEYEIYDLREGSNALERMLNTTNKTNQYKTILSGSLNYKLTNDLTVKTRLGIDFRESTDERFIRPDSYSGSNENGEQGSFGENLRRNFSIISTSGLTYNKVVDKHNFELTGLYEITKQRYRSFGYNAYGIDPRLPETPAGATPGTDENSFIPEFNGGRTRNALISYIALGRYTYNDKYTLNASYRYDGSSTLPAKNRWHGFYSVGLAWDVKKEEFLSESSFVDGLRLRASYGTTASPFAGNFTYLPTYATTSYGGNSGIYPASYGSADYDWEYAKDLNIGFDLDIWNNRVHLVTDFYHKETANLFLDLPVSLTSGISSMPLNAGAMRNRGVEVSLGLDVIRSADFKWNLGLNFAYNQNRVTSLAGAGEFEQNTTEIVREGLAYGSHYAPKWAGVDRATGDPLYYNRDGSITTDYNATEMSVAEFGSLYPPFTGGFNTAFSYRSFSLSALFSFANNVYRYNNEDYYNENPSFGSSGQSVRMLYNRWKQPNDDAILPRYDADRSYSSKDIQNASYLRLRNVNLSYALPKSVIDRAKFLTAVSVFVQGSNLVTWTKWKGFDPEDNNGEAMFDYPNSRTYTFGLNVNF

SEQ ID NO: 15584 - protein, 370 aa, Sphingomonas sp. SKA58
MVKHKPSAGPSKVLFACGIGIGISISGAAHAQSSVTLYGIVDSGVTYVTHSVTPQGTSGTQVALGTGNRQNSRWGFTGKEDLGNGLRAIFTLESGMAMNTGALQQGGRLFGRQAFVGLESDRYGALMLGRQMTPMYRYFLALDPLGYSSYGLSAQDAQFVGRADNSVSYLGHVGPFELNALYSFGYDAVTYSVPVAGSFRVGKQYDIGGRYVQGPLNLTFVYEQRQGSVIASSGDSERRYVAGGSYAIGKATLYGGYELLLNDVHSTLAASPPQSMAYGGVRYRVTPALDLAAATYYHAYRQVDAHALSTGVNADYWLSKRTALYTDITYVINSSKAALSATGWATSVATTTVKTGANQLAFAVGVLHKF

SEQ ID NO: 15585 - protein, 805 aa, Sphingomonas sp. SKA58
MRKYYLIGFICGLLTHVIQAQTPAHLQSNNYKSSRTKNPVKSYTISGLVKDKTNGEVLIGATVYIRSLGKGTATNVYGFYSLTVPKGTYQVICSYIGYQNLVQNIRLESNQKLHLEMSPTSDQLDEIVVTDKKINEHITKVEMSVEKLSMEQIKSMPAFLGEVDVIKSIIALPGVSTVGEGTTGFNVRGGGVDQNLVLLDESIVYNSSHLFGFFSIFNPNSVKDVKLYKGAIPAKYGGRLSSVLDIRQKEGNTKQFSGAGGIGLVSSRLTLETPIVKDKSSLLIAGRRSYADLFLKLSPNEALRKNKAYFYDLNTKFNYTINDNNRLYVSGYFGRDVFGLGDEFNFSWGNTAATIRWNHLFSSKLFSNVSAMFSDYNYSLGVPQGSFAFSWDAGIKSYQLKNDLTWFINSNYTLDFGVSGILYQFQPGKIKFSNALEGVTSLSVEPEKALEMAAYFNSEHKLNNALTLNYGLRYSAFMNMGERKVHTYKEGAPRRDENVVSTRNYSNNEVIQTYQGLEPRIGLRWQLNESNSVKMSYARNRQYIHLISNTTAPIPTDIWKASDSHIPPQIADQVALGYFHNFAHHTFELSAEVYYKKMQNLVDYKNGAELLLNENLETELLSGEGRAYGLELMLKKPTGKLNGWISYTLARTERMVNGAFPEERINNGNYYPADYDKLHNFTMVATYQATKRLSISANFVYNTGRPFTLPDAKYQYSNMTIIDYSGRNQNRIPDYHRLDLSVTLKGKGKPNRKWKGEWVFSLYNVYSRRNAYSIYFSGDGQAQNDATKLSILGSVVPAVTYNFSF

SEQ ID NO: 15586 - protein, 217 aa, Sphingomonas sp. SKA58
MDKATIKILIGMALLSSLQAAELDGAKKPKLADRNAFYLGVGYQLSAINTFFSSKTTNESYFMTGNGFGVVLGGKFVAKTKDIEHVGLRYGLFYDQTFSSHKSCISTYGLEFSALWDGINSPKRFLGVEFGLGIAGATYTPGNAMHGVIAQNLGKENSLFQLLVNVGVRLGSFHNEIAFGLKFPVIPNKKTEIIDGLSATTLWHRLPVAYVNYIYNF

SEQ ID NO: 15587 - protein, 575 aa, Sphingomonas sp. SKA58
MASLASDAAEGVSQFSLDADTTSLMAVAPEVDNTAPLSQNVMDLGFESSAETQEVAQVQPEMEQELRIADLEQINLYSEVADSMEQVTSVSQLSDVQPTDWAFQALQSLVERYGCIAGYPDGTFRGDRAMTRFEFAAGLNACLERVNELIAASVANLVTREDLAVLQRLQEEFAAELATLRGRVYALEARTAELEANQFSTTTKLRGEVVFWPGDSFGDRSRHNVAGVPFGPASDDPTETYLGYRVRLNFDTSFTGEDLLRTRLQALNIPNLSRFNLTNTLMSRTAIDGDSDGIELDDLYYRFPAFNRRAHIFIGANSLDLDDIMDVITPFNSGSNASISRFGQRNPAIFRGPEGAGAAAKFAFGNDRQFRLNLGYLAGNASDATAGNGLFNGSNTKSAQLIYEPTDRLAFGVEYARKYFTSDDVNMAGATGSWIADRPFGDNATTSDNLGFQFNWRIVEKFELGGWFGATWAHQQNNGSDSAAILNWAVTMGFPDAFSEGDLGGIIIGMPPKVIFHNIGALEDRDTSFHIEAFYRYAFNDYISITPGFYVLTNPDHNARNANILVGTLRTTFRF

SEQ ID NO: 15588 - protein, 989 aa, Sphingomonas sp. SKA58
MANHIVRKTKIATSLSLILSASVSLPLLAQEEANQDVEVIQVTGFKSSIKESTRLKRDAAGVVDAISAEDIGKFPDTNLAESLQRITGVSIDRSNGEGSKVTVRGFGPDYNMVTLNGRTMPAASLPAGGGTPNSRAFDFANLASDSVKSVEVYKTGKASIASGGIGATININTARPLDNPGFISSIGVKALHDTTNRVGDDITPELSGIISWTDSDAKFGASLTASMQQRDSSSTGAFVNQWNTSAFDGTIPQAADDIVLTNAPEIGQLYSMPSDLRYTIADRERTRTNAQLTFQYSPIDDLTATLDYTYSKQDLFEARAEQSLWMDNYKSALTFDDNTVKTPVYYREERRDLQTRDLGLAFQELNQVNKNDSIGLNVEYYFNSELSFMFDAHNSKATSKPDAPYGSWVNAGLGANVINAQEVDFSRELPSMSIDFNDCRRANLNCNNTLDPADVGTSILDSNFASQESEVNEFRLHGKYELENGVIDFGVESRSMESHSLQSLTRNTMGNWGVENPGELPDGYLNPTNFLAEFDDYDTSGSFNQGYTGSASQIGYWAGEQYGFNFAADGAFATNRTIEEDITAAFVQFTYTGYFNDMPYNIVVGARHESTDITSTANIDLPNAIAWEGNNDFNVRFGSDKQDFTLKSSYDHFLPSLDFDIEVIENVKARFSYSTTIARPTYDNLSSAATVGVPGAPTLLPGSSPATASTGNPGLVPLESDNIDVSAEWYFAETSYVSVGYYTKDIENFIGLTPMTQNYYGLRDATAGPRAQAAIAELEARGLAVTDSNLFQMVAATENGVDFDSMTYEEFEAAYDVIANSDDPLLDFTAQVPTNNKSATIDGFEIAFQHFFGESGFGVQANYTTVNGDIDFDVNASPSTTQFALVGLSDTANFIAMYENDDFQARVAYNWRDKFLNSAARYVNEPGFTEEYYQIDFNVAYNYSEQLSFFVEGINITEQNSREHGRTSVQLWNLQQLGARYNIGMRYNF

SEQ ID NO: 15589 - protein, 751 aa, Sphingomonas sp. SKA58
MALSNTAQPINTTLRKIAVVVATAVTGMSAYAQAAETPKKEDTITVTAAPAAQESAWGPAATIAARQSATGTKTDTPIQKVPQSISVVTAEEMALHQPKSVKEALSYTPGVAVGTRGASNTYDYLIIRGFAADGQSQNNYLDGLKMQGNFYNDAVIDPYMLERAEIMRGPVSVLYGKSSPGGLLNMVSKRPTTEQLREIQFKMGTDNLFQTGFDFSDAIDDDGVYSYRLTGVARSNNAQQDDKGEQRYAIAPAFSWRPDDKTTFTFLSYFQNEPETGYYGWLPKEGTVDPLPNGSRLPTNFNEGAKNNTYSRNQKMVGYSFDHAFNDTFTVRQNLRYAQNKTSQNSVYGYGMCSDPLYSSNPATSPCASVPQSQWGHTLTRQYVIDNEKLENFSVDTQLQSKFATGAVDHTLLTGVDFMRMRNDIDSWFGYAGSVAPSDIYNLDRGDFDFGSHPGPSGAYQVLNKQKQTGVYAQDQIEWDKVLVTLGGRYDWAKQDSLNRVAGTTDSRNDKEFTWRGGVNYLFDNGVTPYFSYSESFEPSSQAGEGGKIFAPSKGKQYEAGVKYVPSDRPVVVTGALYQLTKSNNLMADPAGGIFSVEGGEIRARGVELEAKAALSASVNVVGSYTYTDAEYTTDTNYKGNTPAQVPKHMASVWGDYTLFDGALSGLTLGTGVRYTGSSKGDPANSFTVGSYTVVDALVRYDLARVGLAGSNVALHVNNLFDREYVASCFNTYGCFWGAERQVVATATFRF

SEQ ID NO: 15590 - protein, 371 aa, Sphingomonas sp. SKA58
MAPAPGFGANNIQGQGDSRQLLEKVKDFLNLLVYQDKDKKPTQPQSGYNVIANQGSVKGLSYVIHGAIQEVQNSMRVLALNMNTARLTSEKPFRIFGSLSGQASSQRNSGASTQAGVMYAIPMFPKLWVGTAISQGRERKKEYQGVDIAKAYGGAKAKTETNQASVIAAWNVAEPGLMGYVEGTFGWGETKNTRVFTHAGERITTKGAAHTSTNGGIARVGYNIEITPMMMLTPYAEVSIATARWDSYKESGRILPAKISATREHVIEHRAGLKVDWHISDVCKIQAWGAAILGERNNTGVTAKPISLYSVSISSGKDKSRYKQLEVGSNIDFKITHNCGVGVNVGIRTKDGEKDKSIKPQCMGIHFWYDF

SEQ ID NO: 15591 - protein, 160 aa, Sphingomonas sp. SKA58
MAMSIYDYSAKTLDGQDVSLADYRGQVLLIVNTASKCGFTPQYEGLEALYKAHKDRGFTVLAFPCNQFGAQEPGNAEEIANFCSLTYDVSFPVMSKIDVNGADAHPLYKFLKKEQKGVLGTEAIKWNFTKFLIGKDGQVVDRFAPTVKPEDLKVAVEALL

SEQ ID NO: 15592 - protein, 145 aa, Sphingomonas sp. SKA58
MRYTMDIEFSQIHEMVYMHDIVNSDSKKKPRIPLKKFLNAENVLTQTTSWTLNSRYVNVNSVNKVNVKSKVKNSYISRSVNDEFSLTDDEINSFKETLVLSSIDSLSKLVLNNPLSVLFTSTVRRNNNRAKMNVEFDSWICTRCC

SEQ ID NO: 15593 - protein, 138 aa, Sphingomonas sp. SKA58
MTRLAEILDQMSAVLNDLKTVMDQEQQHLSMGQINGSQLQWITEQKSSLLATLDYLEQLRRKEPNTANSVDISQRWQEITVKTQQLRQMNQHNGWLLEGQIERNQQALEMLKPHQEPTLYGANGQTSTTHRGGKKISI

SEQ ID NO: 15594 - protein, 101 aa, Sphingomonas sp. SKA58
MAVGQAVAEPFGGLALVHLHRDGFVEGGGITALSGAGRNDDAGFSTLGSRLTTSFTLSPVWWRCPGWWHPGSTHSVPRRRSRIWRSAAPASGSVAIRCAAS

SEQ ID NO: 15595 - protein, 147 aa, Delta proteobacterium MLMS-1
AERQTDSATLGVTLPWTSWRSELWGSEVRGYWDIYASRWSYDGESGGSGHATLAGVTPTFRLRPDSGRSPWFLEGGIGITYMDKRYHTSHKEFSTRYNFASHLGLGYSLGAQRQHEIAIRVQHLSNAGIKRPNPGENFVQLRYAYHF

SEQ ID NO: 15596 - protein, 1013 aa, Delta proteobacterium MLMS-1
MQTSFHKFFLSMILAYSCCSLSGGGYAAEIMIPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFIANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFIRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 15597 - protein, 143 aa, Delta proteobacterium MLMS-1
TRTQVQTYDTIARFGWFLSDETGRGWYRGRHELLMELPLHLTVDPRVRSMTGGYLLGSWKFTSLEDFAPYVFAGGGVLFVDLGLPTMGSRLDFSYQGGTGVQYFIAKDKAVSLEYRYHHISNAGTASPNEPLNSSKILLGITL

SEQ ID NO: 15598 - protein, 817 aa, Delta proteobacterium MLMS-1
MSIASFAQKTSVSGTVSEVSTEMPLKGTSVVLRGTNVGAVTDVNGKYILKNLNPGTFMLDVFYIGYKTISREIIITEGSSLVENFSLAESSSMMDEVVISANRRLQKVTRAPATVNIISSEDIERYAGNPAELAARQKGVDYVRTGVLGIGLNIRGFNSAFNSKNLQVEDGRISSLIATGLPFGSFSTIIRDDVERNEIILGPNAALYGPNAHNGLISTITKDPRSSEGTTIALAGGNQKQFNVRARHAQVVSDKFAYKVWGERQQGEEFDYVDSVYVGTTAYPELELDRDFSVTRYGASTYYSLTDRSDLIASYGHSNNNSIGVTNAGRNQIKDWSIDYAQLKFVSPRLFANVYHHWSNTDDTYAMNQRTQNYVSFINNGFSDEEARARSFTEAFLPIPGAPGGGITLPRGAVFKDASRRLNAEAQHNNQIGNLLYVAGAQFQQDRADSQGTYLLDQDGAIIIDQTGLYGQLEYNVEGLDLDILLVGRYDNHELYGGNFIPKAALVKNFDFGSFRLTYGKGIAAPSILNLSGNLFGGLVLGNGEGFTLQDGTEIQALSVETIRSLETGYKGKLFGDKLFIDVNAYYNVSEDFLSPLLNVAQTDNPVVRRGGTPIADVTPGANGAFVLTYLNFGKVDTYGADLGLNYYLNDSNKLAFNYSYFNYSLDENDSANDSNRDGIVTQTDLPINTPRHKANLGYYYTGNKFFGSIFSRWVEGYDFFSGINVAAKTQDLDGDGINEIVENERVGRTFNYGPLGGFVNFDINLGYNINENLTLGATITNIFDSEVREFVASPSIGRLFLLELKYQFGQNKSNKM

SEQ ID NO: 15599 - protein, 1079 aa, Delta proteobacterium MLMS-1
MGKRIHLFLLALAIGVIQGAAQVTTVRGIVTTEEDGEPVIGASVIVKGTSLGTVTDVNGRFELSGLPPSATRLLISYISLMAKEVAIAPQVSVTLKSDTHLLDEVVVTALGISREKKALGYTAQEVKQDALVQGKDNNLLNSLSGKIAGVRITNTQGDVGSSRIVIRGETSIAGENQPLFIVDGIPVDNSQLNARSSGRDFKNAIADLNPEDIKTLTVLKGPNAAALYGARAAHGAIVITTKGGDKRQKGIGITLHSSTQVSFVATLPEFQNLFGQGAGGRFSYVDGKGAGVNDGVDESWGPRLDIGLLIPQFDSPLDADGNRVATPWVSHPNNVRDYFRMGISTNNGISVARGDDKYQFRVGYNYEKQVSIVPDAGTNKTNISLNTDYHLAKWIVVGATANYIVYTAPSLPGSATPSGSNVRSNSPMLQFLWFGRQVDTNSLKADYTRNWNSSYYDNPFWSASYNTQSQERHRLIGDLHAEFRLTDGLNVRFRTSTDWYNDRRKSKVKWGSAGAGSPYGSYAEDAYTVKENNTEVLATYIKQLNKNWGIDALLGFNVRNKQYENNYQAAPRLAVADLYTLTNSRDPLTSSNDFYRLRQYGLYGSIQLDYRRWAFLNITGRNDWSSTLPVDNNSYFYPSVTASVLLSEAFGWRSKAVNYLKIRGGWSQVGADANPYQLATVFTSETAFNGNPLQSSSTIGMNPNLKPEKTSSIEAGFEAAFWDNRLCLDFTYYKTDSRNQILKLATTAASGYTSQVRNAGHIRNRGYEIQLGAVPIQTSKGFRWNLDLNYGANSSKVVKLDDEGLITSYRLYSSGIQILASVGEAYGTLFGTSYVRDANGNVVVDANGLPKISTTNKTLGKFTPDWTGGISNTFSYRSLSLSFLIDASVGGSIFSNTNKTGKYTGVLANTLSGRDAEHGGLWYYTAAMGNNVRLPESPSYSVSSDGLYYAQVNGQSTRVYQDGIMVEGVTESGSKNEEVVSAEKYYHRIYSIAEANVYDASYVKLREVALSYRLPRLWTQKLHLQEASVTLTGRNLWTIYKSVPNIDPESALTTGNAQGVEAYSLPTTRSFGVNLSVKF

SEQ ID NO: 15600 - protein, 818 aa, Delta proteobacterium MLMS-1
MNKKISAMPGCGAIARWRHKTISLAVATYACSGAAYAQSEAVPPVAQPASPAQQSGGQDNVQIQDRVVVTGTRTATKASRSLTPVDVITSEQLQSTGQTDLRDALVSLSPAIQRQAMGGAQAALVDVLTLHGLTPDQVLVLVNGKRRHSTATISLNPGPQQGSTGVDIDLIPVSAVDHVEILRDGAAAQYGSDAIAGVINIILKSDTKGGSIETSTGQTYQGDGLHQDESAHYGLALGAGGFLDLSAEVSHENHTDRTSQYAHTGALAGSISNIYFGDPESTREVVGFNAGYYLGDNVELYGFGTYAHKDAASYQSIRGSVVLPAVYPNGFIPQDLLGENDFSVTAGAKGDNLLGWKWDLSTTYGGDYAHFSQATSENIGLYQATGQTPTNFYIGNQQSTEWTNNLDFTRPFNVPLLPAPVNVSFGFEQRTEGYSVGAGEPNAYLYGGTPALVGLTPASASNNTRDVLATYIDLATRLTQQWQLDLAGRFEHYSDVGNTTNGKISTRYDFTPWLALRGSVGTGFRAPTLAEEYYTTISPTPTSAFALLAANSSAARLLGAQALKPEKSTSYNLGLVLTPARDINVTLDAYEISIRNRIVEGGSQVGQAAINAIGLAGFSTPLGIPASAISASYFTNGANTRTDGIDLAATYHTYIGQYGTIDWDVGINFNNTTLTHLAAGANGQPLLNSRQIDYLTSGTPKSKIVIGGVWNWGRWGVSLHETRFGTTSAEESYSTGPNAGSVSVFIPFTNKVEYTTDLEARYEVTKHFEVAVGAKNLFNEYPNKLPLAAQYAGADIDPTTSAIGMDGGFYYLRAKYLF

SEQ ID NO: 15601 - protein, 200 aa, Wolbachia endosymbiont
GPISDEEPSYYVRLQYNGQVLPFKTRIDGIEYKKGTEVHDPLKASFMAGGAAFGYKMDDIRVDVEGLYSQLNKNDVSGATFTPTTVANSVAAFSGLVNVYYDIAIDDMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 15602 - protein, 252 aa, Escherichia coli
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVDGEGMTNNGRGALRQNGDGVGGSITYDYEGFGIGAAVSSSKRTDAQNGTYYIGTGDRAETYTGGLKYDANNIYLAAQYTQTYNATRVGSLGWANKAQNFEAVAQYQFDFGLRPSLAYLQSKGKNL

SEQ ID NO: 15603 - protein, 252 aa, Escherichia coli
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVDGEGMTNNGRGALRQNGDGVGGSITYDYEGFGIGAAVSSSKRTDAQNGTYYIGTGDRAETYTGGLKYDANNIYLAAQYTQTYNATRVGSLGWANKAQNFEAVAQYQFDFGLRPSVAYLQSKGKNL

SEQ ID NO: 15604 - protein, 252 aa, Escherichia coli
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNL

SEQ ID NO: 15605 - protein, 252 aa, Shigella flexneri 2a
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFETVAQYQFDFGLRPSLAYLQSKGKNL

SEQ ID NO: 15606 - protein, 252 aa, Escherichia coli O157:H7 EDL933
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSVAYLQSKGKNL

SEQ ID NO: 15607 - protein, 252 aa, Escherichia coli
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGVTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSLAYLQSKGKNL

SEQ ID NO: 15608 - protein, 252 aa, Escherichia coli
DGDQTYMRLGFKGETQVTDQLTGYGQWEYQIQGNAPESENNSWTRVAFAGLKFQDIGSFDYGRNYGVVYDVTSWTDVLPEFGGDTYGSDNFMQQRGNGFATYRNTDFFGLVDGLNFAIQYQGQNGSVSGEGITNNGRKALRQNGDGVGGSITYDYEGFGVGAAVSSSKRTWDQNNTGLIGTGDRAETYTGGLKYDANNIYLAAQYTQTYNATRVGSLGWANKAQNFEAVAQYQFDFGLRPSVAYLQSKGKNL

SEQ ID NO: 15609 - protein, 252 aa, Escherichia coli
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNL

SEQ ID NO: 15610 - protein, 133 aa, Escherichia coli
DFSGFSGSVQFVPIQNSKSAYTPAYYTKDKNDNLTLVPAVVGKPGSDVYYAGLNYKNGGFAGNYAFKYARHANVGRDAFELFLLGSTSDEAKGTDPLKNHQVHRLTGGYKEGGLNLALAAQLDLSENGDKTKN

SEQ ID NO: 15611 - protein, 252 aa, Escherichia coli
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSVAYLQSKGKNL

SEQ ID NO: 15612 - protein, 252 aa, Escherichia coli
DGDQTYMRLGFKGETQVTDQLTGYGQWEYQIQGNAPESENNSWTRVAFAGLKFQDIGSFDYGRNYGVVYDVTSWTDVLPEFGGDTYGSDNFMQQRGNGFATYRNTDFFGLVDGLNFAVQYQGQNGSVSGEGITNNGRKALRQNGDGVGGSITYDYEGFGVGAAVSSSKRTWDQNNTGLIGTGDRAETYTGGLKYDANNIYLAAQYTQTYNATRVGSLGWANKAQNFEAVAQYQFDFGLRPSVAYLQSKGKNL

SEQ ID NO: 15613 - protein, 252 aa, Escherichia coli
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRSTDFFGLVDGLNFAVQYQGKNGSPEGEGMTNNGREALRQNGDGVGGSITYDYEGFGIGAAVSSSKRTDDQNFGLYIGNGDRAETYTGGLKYDANNIYLAAQYTQTYNATRVGNLGWANKAQNFEAVAQYQFDFGLRPSLAYLQSKGKNL

SEQ ID NO: 15614 - protein, 252 aa, Escherichia coli
DGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSLAYLQSKGKNL

SEQ ID NO: 15615 - protein, 772 aa, Candidatus Kuenenia stuttgartiensis
MSRKDRKGGQPFTMAGVGLVLLSSVSQAAESKSTTKPRPVLSGPQQHASAPKSKPAAPATPVPTAQHILVTGRTVSGATADYNKKTAYLGPLGNRSILDTPMSIQSVPHDVMVNQQTRNLNDLMGYMSSVQLEVRGDPNTSRPQSRGFEADVIANTRLDGLNIVSTTPYAAEMFEDVQVLNGVAGALYGAQNPAGTFAFSTKRPTDTPINRLTVGVDSIGTLMENADVSGRIGKNKWFGYRINLLHGDGTTYVQNSWMRRNLVSADFDIHFDPDTVLELDASHYTYVQRGTTPGFNLAYNATSLPPAPDLSKPNLGQDYAGYNMETNLFMAKIKHTINRDWSFTLGGNYEDSIRQVFSNTNTLTTGPVGEYTQTIAAAVTANDFRSGANLAYVNGHFHTGFITHDIVAGTNGYMMGNYNPTQGETIALGKSNMYSPSVLSGSQPYYHGRYESAYIRNQAMILGDTLHLDRHWSIVGTLTWNWLSQDNRSTKSRTVKDGNTTYSYTTPLGWTSKHIDGAFSPMASLVYKPAENQTAYFTYGRAIQAGVQAPASAANANQMTQPFRSEEYEVGYKISYQKMLFSVAGFRMNRPYAYQDANGYFGTFGMQTNYGVEVQAQGRITPDLSVLAGMTWLDAELGGTGNAATNNKEVVGAPPVQANILLDYRLPIPHGAFASGLAVNANVHYTGRRAATITNSAYADAYATLDLGIRYPFFAAHHPWAARFGVTNVANTQYWSSLYPASNNGSLNNDTGASSIYAGLPRMFHFTLEADF

SEQ ID NO: 15616 - protein, 347 aa, Candidatus Kuenenia stuttgartiensis
MTNKMFYILVIALICFNNNAFSQGCEGDLPGSGSDSLNANKPVLFGYLQSQYDYTFSNPGESTFKFKRARIGVRGRAYEDFSYYFMLETSPFIGSSGDAYIMDAFITYDKYNWAKISLGSFKQPFSLEVATACHSLTTIDRSIVADQLVAPQRDFGIGLFGGNKYTKLNYALAIMNGRGLGVVDNNTNKDVVGRATYKLTDFLTLGGSFRYGYPNTNGDSRTTFGGEMALKFNNLKVQGEYIYDEGDYNRAAGGGCGATPVELGEKRDGAYIMASYDTEWKLQPVLKYEYFDPNIDIKEIGYQEMMTFGFNYFLNDKIRLQVNYQAHIETHINIDNDMLLAQLQVRF

SEQ ID NO: 15617 - protein, 851 aa, Candidatus Kuenenia stuttgartiensis
MNRLTLAIGLALSAGSLRAAETPQAPVAAVAPAAAPDAAAPAPSIYTYDPLKVIGQRLFPYQEGMSLDRRYIDEQIRGNGDIGTLLRINPSVQFDDTATNSRNMGEIRPADISINGGLYYQNAFALDGASFNNDTAPGGSTLAASIIDVPSHSQGIALDASQIGTLTVYDSNVPASYGGFSGGVVEAESRRARDAFSGSVVARMQRSVWNETHIVAPAVQNFEQSSTESLQPRYDKYQLRASLEGRTRNGLGLSGTVSRLRSVIPLRGYTAGRNSPTDENEKEQVRENTSASLRADWSDGDGLEISASVNYAPTDERYFIVNAKNGYYDLKQGGPVASARVNYQRGDWTWRNTLSYSDLDSSRRSQTDYWKSWARSSEMDWGVTTLSAEGSWGNIDQRNRNLGYKLVLEREPLRLGRGEHRLQFGLEYRDRNAEYHRLNDHYSYLTPAATLTCTAANGGVDRDGCSLAPVDATGSGVIKGRGQYFTRRNLYREGAFSVDNREWAVFAQDDLRLGRWSLRPGVRVDGDSLMGRTTVAPRLAASWDVFGDRDTLLTAGVNRYYGRNIFAYKLREGRERLQLEQRRGADLIWRDVRVSPADYRFDRLRVPYGDELALGWNQRWAGLDLSLKYVRRDNRDEVLRQTIVNTDDSGFYDTRVNRYDNRGRSRSQTYTASLAPAQPLRWGPAVTTAEAAFDYTDVRRNYTDYETVYSETFETWVRYQGKLMRTWELPATSFNRPWTARLATQTRWEAAGLLWSNFLRYRSGYRGKRTVGNESYQGEAIAVIEEVAYPATWTWDSAVEWTLRLPRDQQAYARVEAQNLTNRANLISSATTATTVYEPGRSYWLELGYRF

SEQ ID NO: 15618 - protein, 994 aa, Candidatus Kuenenia stuttgartiensis
MANRYILFFLFILGFIQSGFCQHYTIKGRVVDNKNKSPMEFVTVYLPGYELWAISNEKGAFTINQVPAGKVKITAQYLGYVTQTLDIDVQKNIEDLLITLQENNLTLNEVVVTAQKKISDPTTSYTIDRATLDHAQILNVSSLSTLLPGGKSTGDQNLASSDERIALRSGSSEMGNASFGTAITVDGVRLQNNSEMSETKGVGLRNIGSSNIESVEIITGIPSVEYGDLSNGIVKINTRKGKTPFIIELVTQPKTKQIAISKGFLLGDRAGTINTSLERTKSTSDLASPHTAYDRNSLTLTYSNTLNRKAQRPLSLNAGFTGNIGGYNSEADPDAFKDTYTKTRDYTFRGNIGLNWLLNRPWITNLSLTASMSYSDKLSKVNTNKSSASTQPLIHSTQEGYFIASNYDENPNAEIILSPTGYWYQLAYTDNKPVSYAVKLKADWAKRWGKISNRIMLGAELNSSGNKGRGLYYDDMRYAPTWREYRYDELPFLNNIAGYLEDRIILPLGENSSSLELTAGVRSDITYIKNSEYGTVNSFSPRFNAQYTLWKNADKWVSNLNVYGGVGKSVKLPSFEVLYPSPSYSDKLAFAPGTMSDGTTFYAYSTIPSKAIYNPDLKWQYTRQAEIGMEATIKGTRVSVSAFRNRTYNPYMRTNVYTPYSYNLTTQEHLNNCEIPSANRVYSIDQQTGIVTVTDKTGAYPSQELSYNTRNTFKSNIQYRNGSPVERMGLDWIIDFAQIPALRTSVRLDGNYYYYKGIEENLIAWMPSSASNMADGNPYKYVGYYGGSSITSTSSSTSASVSNGSLSKQLNMNLTITTHIPKIRMILSMRIEGSFYNYKKNLSEYSNGESRGFALENAGDYFSTDYDIYGKNKYVAVYPLYYSTWEDPDTRIPFAEKFAWAKENDTALYNELAKLVTKSSTSYYFNPNKISSYFSANINLTKEIGDFASISFYANNFFNHMGRVKSSQDNQESSLYNSSYIPQFYYGLSIRLKL

SEQ ID NO: 15619 - protein, 668 aa, Candidatus Kuenenia stuttgartiensis
MFGQIYFRVLGIGCFLSMALLSSAQSKLDSLHHLNEVVVTARINKEVIPVQSLSGDKLEKLAAHSVADAIRYFSGVQIKDYGGIGGLKTVNIRSMGTNHVGVFYDGIELGNAQNGVIDLGRFSLDNMEAVTLYNGQKSAIFQPAKDFGSAGSIYLQSRTPVFREDRAYHVKATFKTGSFGVVNPSLLWEQKLSENVSASLSTEYMYTTGKYKFTYAVDGGYDTTAVRRNGDVNALRAEGGLYGKIKSGYWRTKAYFYNSERGYPGAVVRNRFSHEDRQWDTNFFFQSSFKKDFGDVYSLLLNAKYAYDYLHYLADPQKEEATMYVNNTYRQQEVYLSMANRVTLFPFWDINISADYQWNKLNANLTDFPYPRRNTALVAAATSLHFERFKLQASVLGTFVNENVASDTTSAGNKMEFTPTVITSYKPFKNIDLSLRAFYKRIFRMPTLNDLYYTFIGNIKLKPEYTNQYNVGFTYQKLSSGTWLQALNVQLDAYYNEVENKIIATPTNNFFRWTMINMGLVKIKGVDVVLQGLWKFGNDWVFDSRLSYTYQKAQDFTDKSDKDTYGGQISYIPWHSGSAILNAGYKSWELNYSFIYTGERYDVSANTPENYRLPWYTSDFSLAKKFSWRKYDFKLTLEVNNIFNQQYEVVRSYPMPGTNFKFILNLTI

SEQ ID NO: 15620 - protein, 858 aa, Candidatus Kuenenia stuttgartiensis
MIGRDVRIQRTRGPYSVFDTGSREEAVKIPGLSGALQMAFRLEAVKSRQGTPFAAGRLRRMTSWLLASTILCCAGASLSSPSFAQQPVPASAQSRAVQFSIPAQPLPAALDAFIRATGWQVGYSTRLTDGHRSTAVNGMMPPAQALRTLLAGTGINLRLTGTNTATLVAPNSVAAGGAAPSGAISLDTIDVQGETAWGPANGFVASRSATATKTDTPIVEVPQSISVVTRDQIETRRNLTLNETLQYTPGVFAGTGGHQHSAPQFQIRGFQTTPLNGAFYLNGLRSIGSGDLEPYGLERVEVMRGPASVLYGQGQPSGVIALVTKRPTEQPFHEVRLQGGSFEQRGGAFDFGGPIREDRTLLYRFTGLLREGGNGIDFSNDKRAFLSGAVTWRPTTATEITAFGLYQKDQGKWNFGLPARGTALPNPNGRIPITRYIGEPAFDYDNTESTAVGYNLEHRATDGLTFRQNLQYGRQVWDYRYVSPRSVQADLRTLNRGGAQNYRTWDSFAVDNQAELKANTGPLRHTVLFGVDYRWGQITNVGTDSGVVGPIDVFAPIYNTGVFMPPADYGTQQTLNYTGIYLQDQIKLDRWIVTLGGRYDWSDLKTADIFNANGPSTNQIASAFTKRGGLGYEFDSGVVPYIGYSESFLPVSGTTFDQVPFNPETGKQYEAGIKYQPRDTNLRLTAAVYDLRRQNVTTADPAHPGFSIQTGEISSRGFEFEAVASLTSNLNLTAAYAYNDARVTQSNGADLGKRPFRSPPHLASLWADYTIRDGALSGLGFGGGIRYVSASAGDFLNTFEAPAYTVVDAMARYDIDNWRFSVNATNLFDAYYVAACFSTTQCNVGRTRTVLGTVTYRW

SEQ ID NO: 15621 - protein, 144 aa, Candidatus Kuenenia stuttgartiensis
MKNTIFTLAAIISLASVSVYSHAENMKNNDVAENGIYVGANYGYLKVDGKDDFDDNSDVIQGLVGYRFNQYLAVEGGYVNFGDYGNSLSNAETDGYTAALKVSYPIVDRVELYAKGGQLWYSTDYDVYSASISLADPATINLAG

SEQ ID NO: 15622 - protein, 1508 aa, Candidatus Kuenenia stuttgartiensis
MSCTRYRKNNDHPKLAQSMGVLVALVGAGIVPAHATCTAAGTTVTCSGAADPLAPSYANSGNNLGVTVNSGASLGVLLGVGGTALSLTGSGVTLTNNGTIDPTVLGFGLGVLSSGAVVGNASPSTTTVTNNGTMNGSTGVSISGLTGMALAVENGTGGVSNITNTGTIGSTPLAGATLLGPDSPVVAAYGGGQVNFSNSGTITGRVAFQSNGTAGQGNTFVNSGTIDGSVSMGTNSTNTFTAMTGSTVSAAGGTGLSLNIGVGSLTLGFAATGIVDGGAGGNNTLVLQQATGGPATGAIAVDNYINFNHLDVTSGAWTISGASSAQDATLSGGVAIIGNNASLGTGAITGNGGALQAGAAGLDVSNNVALGAGGLTVQGATGLTLSGAISGSGALTKNDTGTLTLTGANTYTGGTTINAGTLAIGAGGSLAATGAVNLAGAGAALDISAAGANQTIGALSGVAGTNVNLGANGLTFGDGTNQTFAGAIGGTGGVTKQGAGVETLTGANTYTGGTTINAGTLAIGAGGSLAATGAVNLAGAGAALDISAAGANQTIGALSGVAGTTISLGANTLGFGSAANQTFGGSIAGTGGIVKNGTGTETLTGANTYTGGTTVNAGTLALGAGGGLSGSTTVNLAAAGAGFDISGATGNQTIGGLSGAAGTTVALGGNSLTLAGSGSATFGGTIGGTGGLTFAGTGTQALTGNNTYSGGTTLAGGTVALGSGGALGTGAVTVAAPTTIDTTSAVNLSNAVALNATATVGGTQSLTLSGAVSGPGGVVMNGSSTLTLGGANTYAGGTTVNAGMVVVGNGSALGTGGLTVNGGGVSLGGSSVTLPTLNGAAGGTIDTGAGSLAVTGGGSFGGALTGGGSLAVSGGAPLTLTGANTFTGGTTIASGGALQIGNGGTTGSLAGNVADNGALVFNEAANLAYGGAISGSGLLTQAGSGVLTLTGASTLAGPTTVAAGTLAVDGSLANSTVTVQNGATVTGTGTLGGLIVASGGTASLPQPGQALNVAGNVTFEAGSTLQVAANPQQSGSLAATGSATLNGGTVQVLASQASYQANTTYTILSANAGVAGQFAGVNSTYAFVTPTLGYDANHVFLRLAPNGNAFTSVATTQNQTAVAGALGTLGAGNPLFDTVLVSDAPTARGAFSQLDGELNASLQSMLLSDSRYVRDAVTDRVRQGLAPGSGPLAALSAGGAALCDDAGGGAARHDAMPPERRLGSRDSCVGRTPYRPVVWGQAYGGRSRLASDGNASTLNRSMTGFIAGADVALNDRWRAGAAAGVTHSSLDNDLNASASLNSYYVALYGGAQYGAWGVRGGAVYTWYRINADRSPAFANFRDHDSAGYDANSGQVFGEVGYAIPVGRFALEPFAGLAYVSLHTDGYQESGGAAALKSGAQTSNVAFSTLGVRAATALDVLAKGTLSAHAMAGWRHAFGSARPTSTLAFARGGASFQVAGVPIARDSAVLELGIDASVTKNLTLGVSYSGQYGSGVRDNAVLGNALWRF

SEQ ID NO: 15623 - protein, 546 aa, Candidatus Kuenenia stuttgartiensis
MSMHVPAALWMGTGLWLGLAPATIAFDASTIRQVNAIANEDLPAAQVTSITQLSDVRPTDWAYQALQSLVERYGCIVGYPDRTYRGSRALTRYEFAAGLNACLDKVIEFAASKEDLDTLKKLTEEFQSELATLRGRVDGLEARVTELEATQFSTTTKLQGDVLFSLDRAFGPSGLDTGTSFSQRVGLDFNTSFTGKDLLKTRLETNSITSPGLRDLNGFAAGAGIPSPGAALAYDNAATGADPNFTLNTLIYQFPVGSVNFTVGTSNVQVDDVFSTNGSFYAPELSYFFNNPVPGIYNDADTSNSAGAGFNWQINPNFNLGLAYINQQGPTSGQNLEADPTAGVFGADSQTTAQLAFKNDDGTFIGALAYAYRKGPAFDPVNPDGVGLPAQFGGVSYGTVRSLIGPSNSPTDLISSNNIGLSLGWAVSENFTISGSYGISFLSGSAGSSTVQSWNIGLTFPNLFADGNELGLAIGQIPYVTSDSRGAAFADSGPFAFEVYYKLQLTDNIAITPALYAVTNAGGGLTLGNLANGDYWVPVLKTEFLF

SEQ ID NO: 15624 - protein, 976 aa, Psychrobacter cryohalolentis
MKTLQKKLLFFLLILPLGILAQSTLNGTVLDGANSSPLPGANIIVEGTKNGATTDFDGKFTISNIKKGDVITISYIGYKDQKITFNNQNNITITLEEDSKELKDVVVIGYGTVKKKDATGSVSTISSKDFNKGANVTVDNLLTGKVAGVTINSNGGSPGSVPTIRIRGGSSLLANNDPLVVLDGLPMDSRVLATLNPSDVESFTILKDASATAIYGTRASNGVIIITTKKGSKELQVDYNVQYGTGQKVNKIDVLSADQFRQVVNNLYPVGPGITDSAFNQGIRNKMGDANTDWQEEIYRRTDYIDNNLSLRGNFLGFLPTRLTIGNTYQEGLRLTDYMNRNNVSLNLNPSFFNNHLKAKLSLNYTNTQRRNAPGVEGGAIAMDPTQPVYDPTSPFDGFFEFRNGPSINDFATIATANPVAQLLQTNNRSVNRKLFGNFEVDYKFHFLPELRLVTNLGLDRDEGYSKNFTPATARTSPVRQNVLIGNNSYSDGVSTNKLLDAYLVYNKTINDLTFDITGGYSYQIFEGNGYTSRNQNNADDVPQYFVSDDIVYVGFFGRTNFSFKNKYLLTLSYRRDGTSRFSDANRWGNFPAASLAWKVNEDFLKDNKTISELKLRAGWGITGQQDIGAGLFYLPQYFLGDQNSQYAFDSNYYNVAQPGGFNPNLKWEETTTYNAGIDFGIKDNRLNGSLDFFYKVSNDLFQVAPFADGSNFTNEGPQNIGSMSVKGFELNINYDVLKQENLNWSVNFNASKFERRIDEIAGGVPIFVGNIGVGTESQIMQEGYTPNSFYVFKQLYNSNGMPIEGAFADLNGDGIVNNSDRYIYKNVDPDLILGFSTTFNYKKFDLGFNLRASFGNRILNVVKSRSSYYNQILNGELQNLPSSVLDYNFQTPGVGQVLSDLFVENGSFLRMDYATFGYTFPKWLEGKASLRVFTGVQNPFIITKYSGLDPEFSGGNDQTIYPRQRQILFGANVKF

SEQ ID NO: 15625 - protein, 1004 aa, Psychrobacter cryohalolentis
MRETRTLPRTRRLTSALLFAMSTPLAAQTAPAPQSASTVPGSSQADPATLDTVQVSGIRGSLTSSMNVKRDAQGIVDGIVAEDIGKFPDTNLAESLQRISGVSIDRSLGEGSRVTVRGVGPDFNLVLLNGRQMPGASIEESNASNSRAFDFANLASESISGIEVFKTSRASTPTGGIGATINIKTARPLDNPGMHANVGLKGVHDASNENLPGRLQGDWLTPEISGIFSNTSADGRFGVSLSGSYQERDFGYSQVGVPNGWRAFRGDSTAYGTIPQPGAPGSENIVNRPGPNDIYSVPQNLNDRVVGVERQRTNGQLTLQYKPLDNITATLDYTYSENKIQQQRNEMSVWFNYGPSASSWTQGPVSGPITYSEIVNPPTSDLATAGSNAATRNQNKSLGFNVDWAVSDQFKLNVDIHRSTAEAGADSPYGSSNSLGVSGFYRGTSVVDFSKDFPVLQQQLGFGLNGLDPSRTLVTGSAFRNSYMKSEIDQAQVNGDFTFENYSQLTFGIGSTEVKNRSAFSNVQRNTWGGNGTAADYPDDLWIPSSFAQYFDAIDGSGNPQQFNQLYLFDFERVRQAAAHAAGDESLYRISPVFTTDRRVIEKSKNAYLQWNNSWDDLRVPISLAAGVRYEETKVQAQALVPVAVGIDWVANNELPIRLSDSAFAGGSGKYKYWLPSLDLSFKLREDLVLRGSYGETIGRPGWGDIQGGQTLNQIGRIEGGSGQEGNPGLKPLLSHNIDLSLEWYYGEESYASVGFFRKNIDNYVGVTTRNDTSLGLHTPVGGAYWNQALANGCATAELTCIRNYIFRNFSGQPGVVRGTDDTNGNATGTISGQPGDPVANFSITAPANQRSASLDGWEFNVQHMFGQSGFGVSANYTKVNSGLTYDNYVIGEQFALEGLSDSANLVGFYDKDKWQVRAAYNWRDEFLAARFDGSGLPNPVYTEAYGQLDLSIGYQWTETLSLSLEAINLTNEIQRQHGRQKNEIIYATQTGPRYMLGLRYTFW

SEQ ID NO: 15626 - protein, 288 aa, Psychrobacter cryohalolentis
MKKLLLASTVLAGMTAAASAADLPRRAAPPPVFTPVPVFTWTGFYFGVNAGYGFDANSRNTTNYALPGGSLINSPGTAGVVSVNNRSNNDGFSGGAQIGYNYQFTPGSGVVIGFEADAQYVDFARRANATQNYAFGGAPGIAFAAPRAFVATSGNGLDYFGTVRGRLGYAFDRTLVYGTGGFAYGSGQDDQNFAGNRFRDSFRTGWAAGGGIEYALPTDSFLNFFRSNAVTLKVEGLYVSLDRQKNSAGGVFYGNLLPPNGIAYLNGAAAKTEFAVVRAGLNYKFGSY

SEQ ID NO: 15627 - protein, 386 aa, Psychrobacter cryohalolentis
MGANFNLKTLTVAIATLSIASVASAAGLDRSGQDITAFLQDGVYAEAVYTYIDGDVTGKDSSGKEIDDIAESYDFFRYGVKADINDTFSVGVLYDEPFGAAAKYSGDNKFVNAKGEGTNVEVRTENLTAIMGAKLGENKNFQVYGGPVAQRVQADVKLRGDAYQAANGYTAHISAAQDYGWLAGVAYSKPEIALQAALTYRSEIDHTLPISEKFPALGAAANRVGEIDITTPKSVNFDFQTGINPTMLATAKVRWVPWSDFEIVPPLYNQASKLSLVSYDEDQWLVELGLAKRLTPVLAMTGTVGWDSGAGNPVSSLGPIEGYYSAGLGAKYNLTDNWAISAGGKYLWFGDAKGQIPNKTVVSNFEDNDGFALGVKLSYQAKQSFN

SEQ ID NO: 15628 - protein, 7446 aa, Psychrobacter cryohalolentis
MRASTKRFLIVLPTLLLAGGSIGRVIAQTENIGSSSGTYLYGSSGSGTVTTAPYIYGTGNPGPTITYTLGGSLSESGGANSGGDTGSKGNSPTFGNGGNGGQGASPGSVTVVLSSGVSITVDGGDLLDGFDNVVGGIASAQAGNGGDGGNAGIGGSGGSGGAGGSSQNQIVNLTVDSDVSVNVSIDSTDYGAIGLLSQSVGGVGGDGGDGGWYSTGGGDGGNGGYSGLATITNAGSIVVNSENDAGPGGSGILVQSVGGQGGATGSGGLITYGGQGGTGGTAGNVSVTNTGDISATGDSVTGINVQSVGGGGGAVTGELSVANLGGSSGGVGGNAGVAELVMTSGSVTTDGNNAQGILVQAVGGGGGSVGNQTSLTTVGSEAGGGGNGGSASLTFTGGRITTGASDGGANVGSTGILVQSIGGGGGNAGTSSGVIAVGSSGGDGGNGGSASAVLSNGSVFTEQDYAGGVVVQSIGGGGGNGGNANSAGAGASVAVGGNAGGGGVGGNVSVGTDSSESGAISLVTLGFQAPGLLVQSIGGSGGTGGSATSVSAGTTASYSLAVGGDGGTGGNAGTVTVGSTDLPFKANVSTLGAYSTGVSINSIGGGGGNGGNAVSGSVSAQSFAVGVGGIGGAAGNGASVTVALEGELQTHGFQAPGLQVQSIGGGGGNGGSSMAISGGAIAAAPSIGGSAGAGGNAGDVTVNFNGPIETRSSYSPGAIVSSIGGGGGTGGSSLSASAGTVSASVAVGGDGGAGGSGGNVSATLAGDITTHGESSPGALIQSVGGGGGAGGSAVSGSMTAGVVSGGVAVALGGDGGSGNSAGSVSLTFSDSSIKTGRSIEGILIGHSPALLVQSVGGGGGQGGSSVSGSVSLSSDGSFSGSFGLGGSGGDGGTGGAVTVSLTNMVLDTLGDYSAGLIAQSIGGGGGQGGSSTSMQASASGGTSVAVGGVVGGSGGTGANASSVSVINSGGSISTRGDFAPGLYVQSVGGGGGSGGSTSTLGLSASSGTSVSGTVSIGGSGGDGGTGGAVTVTNSTRIITTKGEHSPGIVAQSIGGGGGTGGSTTTLNGSAGGSTSVTGGVSLGGAGGSGSSAGDVALTTSGVIVTGNTLRPDLLLPAGAFSYGILAQSVGGGGGAGGSTSSYSLSASSSGDAVTLGADFGGDGGDGGTGGNVSVTVSGSISTVGFQATGLLAQSVGGGGGAGGSTQSLSASGSKNSSSISGSLSVGMGGSGGDGQTAGAVIVEGPSADSVLRISTSGVMALGLNAQSIGGGGGQGGSSMAGSVTVSSSQYSFGASAVEGGSGGTGGTGGSVQIGSSTSSPLRLVVETTGLAADAVLAQSVGGGGGAGGGAVSGGTGGSLSSNMSFGAQGGAGGDSGSVNVFLLGDISTRGVHSSGLIAQSVGGGGGAGGSAISGSTTSDADVDFSFGASVSDGGDGGGGGDAGAVTVAFGGSISTRGIGADGLFIQSIGGGGGRGGAAISSASSSSSPGQSNSNSSGSSSSSTTSNSSTQTSSSGSVSMGFGGNGGNGGDGGSASLQGLRDITVSTRGTNAAAITVQSVGGGGGRGGAAKSTSTTDGNADFSFGVSAASGGDGGSGGAGGSVTMGSSSSPVSAKASTIGNNAIALLLQSVGGGGGIGGSSQSGASGGNLSTSFAMGGDGGNGGSGGAVNLYADGTYITKGTLSHGVLIQSIGGGGGQGGSATANASPNSSANSDFSFGASAGSGGDGGGGGSAGAISGSISGLIRTLGDSAIGFFSQSVGGGGGAGGAVTSSANTGGSNLSASASFAMGGDGGNGGRGGSINLLVPDGLTVLTGDADAGTGHGSHGILLQSIGGGGGQGGAVVSSSNVSTSSSNTSMSFGLSTGDGGDGGYGANSGSVTLGSNATPASLSVETSGDNAMAVFLQSVGGGGGAGGAVNATTSGGNLSASFAMGGDGGVGGTAGAVSLFADGTYLTRGATSHGILLQSVGGGGGQGGAVTANATPVSSDDSANATFSFGASAALSGSGGRGGNGGRVSASLSGAIRTLGDSAIGLFAQSVGGGGGSSGSVTNVADSGGGELSAATTLSMGGAGGSGGSAGAIQVTTPTTLTVITGDSNAGNSEGSGHGSHGILLQSVGGGGGQGGSVVSGTTAGTSTSNSSFSLGATVATSGSGGAGGAGGRVQLGTSNQRTDLQVQTSGDTAHALFLQSIGGGGGAGGSVNSSSAGGNLSASFAFGGPGGNGGTASDVTVYSDGTFITTGHLSHGVLLQSVGGGGGQGGAVTSNADGTGTANSEYSFGASAVTGGNGAGGGWSGDVTASLSGRIVTTGQGSIGLFAQSIAGGGGAGGSVTSNADGGNANVSAATAFSMGGAGGSGGSAGDVTLLAPEPLTVITGDSNRSSGSGAHAILLQSIGGGGGTAGSVLGSNVSASTANSSVSLGASAAVTTDGGNGGNSGDVSIGTASQPARLNLVTAGDNAHALFLQSVGGGGGSTGTVNSGNTSGNLSASFSMGGAGGDGGQSGRVSAYIDGTLITTGDNSHGVLLQSVGGGGGQGGAVTSNVDSDTTTTIESIYTFGLSVDEDSDADGGNGGLGQQLRGEVTGNVITRGDQSVGVLIQSIGGGGGAGGSVIKTSDSDQASYASSMTTTMGSDGGSGGNGGRVNFSHGRNDSLTVLTSGEASPAVLLQSIGGGGGQAGTVIAKATRSTTTTSLGGGGGDAGAIQVSLGELLIQTSGNNSPGLTLQSIGGGGGAASHTIDDVQNGLVNVNVALGSAGGDGGEGQALSFSSEGGRILTSGAASTALMLQTLGGGGGLATTVAAGTTRSVIDLEGQIGGSGGSGGNAGSINATNSTNLLTTGVNAIGLYAQSIGGGGGGASVSIADAEQRTAVRGSLQIGGSGGSGGSGGDGGSVNLNNSGTIVTTGMQSHGLFGQSIGGGGGRIAIAGGGNSLLNNASVLLGGSGGDGGNSGAVAITNSGSIEVRGEGSYGLGAQSLGGGGGSVSSTSALNLKLGTRGGSGGDAANISITNSAPISTQGPDGIAISALSIGGGGGDAGMTSGSISLGASNGGNGNAGTITITNSGAISTSGINATGVVARSIGGGGGRVTGSVSNSAIQLGNSGGSSGDGGAITITNRGTITTNRRNSAAIAISSIGGGGGEAASNYSTATLGSNDASGDAGAIALTNSATLITEGIDSPALVVQSIGGGGGGVDQITAAAQLGSQAANGSQRGGELQLTNSADLQTERSFAPILMAQSLGGGGGHVSSVGGSATLGSLYSDAGTTLDGASIQLTSKGDLLINKGDYSPALMVQSVGGGGGWVGPVSGALQAGASNSSGSMLGGSINATNQATVVVSGNYSGAISLQSIGGGGGAAGSVVGQANLGSTASSGEQSSGVITFSNRGSILSTGEHSPLINVQSIGAGGGSAGEIGAGNSPIQLGAITLNGSGDGGAVSVTQTGKELISRGNNSAVLRVQSIGGGGGSIASLQTAVTLGGSGTGSGSGGEVSVTNRGLLESHGRNAIGLLAQSIGGGGGIAGLSAGDSITLGGSLSGSGGSVNVTNRGAITTLGINSAALLAQSIGGGGGTVATAGGARTQLGGGNTRNASSDRVSVTNSSTLQTGANGSPALMAQSIAGGGGFIAETSRQSTDTPFSVHLGSTRVGNAEGGMVQLRNSGERLVTLGEISPALVVQSIGGGGGWSLLLSTADAQLGAQAGTTLQGGAVNITNASAISTAGDSSAGAVIQSIGGGGGVVGNAGDSIALGASQVSGTLSAGGVSTTQNGSVITLGKQAAGLVVQSIGGGGGLGASTLGSVQLGQTNSRGSGLSDAGAVRFTGSGDTIQTSGLNAPALVVQSIASGGGWLGSVIGSAVLGSSGAASGTAGAVTVTSEHTQIATEGRNSTALLVQSIGGGGGYTGLTLGDDLVLGANQQGANPGGDVTVTNRSTITTLGLNAAGLMAQSVGGGGGTSATAAGSSIAIGASGSGQANAGNVTVTNQSVIQTAGKGSAALIAQSIAGGGGFISEANGNEDYNLTFGATGNVTGNAGAVTVTSTAAQLSTRGDNAPVFTAQSIGGGGGYALVNAGNRAQTRLGTNGSDGNSSGGNVAVTNRSDLLALGDNSAALTVQSIGGGGGVMASAGGSLQLGATDLGATARGGGITVTNRAAIETQGVTSPAVLVQSIGGGGGSASGSGGTSAQLGTTNSTARTGVSGGDITVNSQGATITTRGQGSAGLVVQSLGGGGGRLGLSNSPSTLGGSSLQTSNGGDVEVSNRANITTLNGGSSALVVQSLAGGGGIIGLTEGTSLQMGGSDLAIANAGAVTLSNSGDLRSFGRSSALLTAQSIGGGGGFTTIANNPVFARTITLGSQGVSDGNAGDVEISNSGRLVSTGTSSSALVVQSIGAGGGIARRLGEKTLDFDLQLGSNDTLDGAGGSISVTNTGAVVTTGDYARPLLAQSIGGGGGWITAEVDASTNALLGATDNNGNTSGGSVSITNRADLTSTGAGAAALVGQSIGGGGGVVGNQAGALSMGSVRGSGRASGGAVTILNTATLATQGNDAPAAFAQSIGGGGGRANNLAGALQMGIVQTTDSLVANGASVSLTNEGARVLTTGQNSGGLIAQSIGGGGGYAGSQTREGLSLGRLGGGTDLISLNDTYVISGGDVSLINTATVTTAGIQSPGLLAQSVGGGGGVAGRLGNDVLRFGMQGAATANSGDVSVSNSGPVATTLRGSSALVAQSIAGGGGFASASDSPAITLGAVQASRATAGSVSVTNTNTLTTLGTGSVALLAQSVGGGGGFLSDVSRSNDQGSGTVLNLGATSSDNSTAGSINVTNSGTRVSTRGDGASALLVQSVGGGGGWTSFDGNQIANGQFGQRGGSGASGGALNIRTSGNVLTLGDDAQGLRLQSIGGGGGASSASINTLRLGSTEAAGDLSGGSITVTNSGTVVTRGANAAAIAVLSLGGGGGTLFGSVDTQADLGASEATGANSNLSGGSVSATNQGAGAFTEGNNAPAMVIQSIGGGGGMVDTVQGAVHLGSSSSAGLQRGGAIAISNDADLQTTGNNSGGLIAQSIGGGGGFTALSSLAGRGEHLILGAALASSNSSASGELTLANTGQIITTGDAAPGLVAQSVGGGGGAVQGLGQASTTRLQLGAKTAINASAGALTLSPIRGLIATAGNRSAAAVIQSIGGGGGWALVDSSTSSNLGSTALTGGSGGAINLIMRGTAQTTGEVSPGVVVQSVGGGGGFAGNTTGTGTLGSRRSSGALDISGSSGLLYPVACPIGSCPEAPVEQALLVDLQGSVTTAGSTSPVLLVQAIGGGGGRLGSVGGDATLGMQDAIGSANGGSIRMISNAGASLSSQGNNSAALMVQSIGGGGGSVNNVGGTLQLGSNGIGDSQGGSITLNGPFQAITLGEESPGVVLQSIGGGGGYASEVAGRSIELGTLSVGDTSAAAVRAISANWQISTEGNNSPGLTLQSIGGGGGVAFTSSASVRMGSKAIGNTSAGLVTLVSKGSSRIQTLGTSSPAVIAQSVGGGGGYVGGDGQGVAAVVRLGSNYRQLGSSGALDLTISRGTRLITSGEESQGVIVQSIGGGGGFTSQNALRMRLGMEGGRGNAGDVTVDNQGTVITLGDRSEGVIAQSIGGGGGTAGSSLSSLVMGAANASGDAGAVVVNNRNGRIQTSGAYSIGVVAQSVGGGGGRVGQASGTMTLGSNDGGGDGGEVTINNANGVIATRGAYAPAYLMQSVGGGGGQVGLGDSNGSGTVVLGGGTEGTYGSGGTLTLVNAGGTLQAEGPFSPGVIHQSIGGGGGWIGNVPEGQVALGGHTTDTSTGADLTLALPFEVLTVGDNSPGVVLQSIGGGGGVVADVGGSVAIGGDVKAGVDASGGSLNYTQLRRSVTTLGDDSPGVVLQSIGGGGGLMGAVNGSVTVGTVSAVRSDVSAGAISASSAAPVTTTGVSSPGVTLQSFGGSGGLVGSAPTSVRVGGDGRGNSSAGAIDFTNTGAVVTTGANSSGVVLQSIGGGGIYTTSSGRATVALGGSVVGQNGSGAINFTNRGSIRTGGTNSAAIVAQSIGGGGGAVFAEPGSTATTVSLGGTTATSNQAATVTLNIQDALNTFGDGSPAVLAQSIGGGGGYAPLTSRAAQVGATTSIGLDGAAVDIVMRANATTHGAASDGVIAQSIGGGGGLVGSTTNSLILGAGSGGHGDAAAVSVRSSQTITTTGEQSIGIAAQSIGAGGGRGGEASGSVTLGADGARGNAAAVTLNLTSLALGNDGSIVTTGAQSPAFVVQSIGGGGGLVFPNTNITSGDLLLGGGNSGTQGRGDGITFTAGRRSRVITTGEGSSGLAYQTIGGGGGYAGNSSANAQLGGTYRGLSSGADLSLSSQVATATSGSNASAMLMQSIGGGGGRVGNIGGNAGLGGSADTVTANSGSLDGHGGALDLTINTALTSSGDRSTTLRAQSIGGGGGVAGSVGGNAALGGLGNGDRSGGTIQLSVDNTVGAGGDHATAIQVQSLGGGGGAVGVVAGDLNLGRISDDLHNGDANAGALSLNLTEGANVFSSGFNSPALIAQSIGGSGGFAASTGGTVQLGSGGLGSRNSEATGSPITWSNAGRISTSGDLSPAVVLQSIGGGGGYTTGGSSVSFSAAGHAGTSTSSGDIEATNTGIISTTGDNSFGVLLQTIGGGGGVAGSSTGAVSLNNTNANSSSGNITFTNSGLISSRGSKAHALIAQTIAGGGGFVFGGVSKDSSETLLDSPTGRSGDITINNSGTISASGTNAVALLFQNATGGAYLYQNPDGHVSAITEGAIDGVAPAGEVIVLNTGTIISSGTGGVGITKSTNGIQHGNLRVDNAKGATIQGGNGPDASAIHLSTIEVERINNRGWIIGGDVGTSPAITGEGGPDEIKNWGIISGDVLIPGLTKNIYNAPGARLEAELVDANGNVTLVQRGLINPKGPYRIGDLNVKANYTTGLTSLYEADLVLRSGETDNLTTHYRADLNGTVELLANQVGQAMPGTFISDGIVNAQEGITIGDLKLIAPQSAVASFGFDLIENRTDLAFKYTVDYTPKGLDPNSTAVGKAVNTIQAAGSTSAFNSTAALIFAQETTKELNSLYRQLSGATSAAFPQVALATGQAFQAEVNETLDSAVLSQLQRCILNVQSLKPGDTYTGDPADCGKWRTWVNAGGSDATTPGSGSSEQSGYSTNAFNTSVGADTLVGDNTLIGIAGRFDNLWTTTTEPTTFGKTEGWSGMLYAKQRLTPSTWLSGSFSAGGFSTDITRQVNIPGYPSTEQGSSSSTAIGGSLRLSHLIATGNQGSLTPSLGLSWLQLNQAQYSETTTSNNTAYVQPGNPLIKTPNPGKASYALTYDAATYNSIPLELGLSYKQPFKAGSTTLIPRISLGYAWDLGDTNRALTARFNSAPKGSFTVDGTPAPSSWFNVGLGLDLAINDRFSIYINGLGQLSPSSTQSINYGGGLEWKF

SEQ ID NO: 15629 - protein, 645 aa, Psychrobacter cryohalolentis
MVLSRSSSTTYLRLCILSAFGAFAMSANAATDVNIVSDSDLPQVELDKIVVTATRTPTKTSNVIAQTRVIDSEELQRYQGQTVTDVLKNQPGINIAQSGGMGTISNFYMRGYDSKQVLVLIDGIRYSSISAGTSSLNLLPADQIDRIEILYGASGSSIYGSDAMGGVIQIFTKGNIVEQSNISTSVGYGSNNHYQVGVTGQLKNDTSSLSLGVSRNKTDGFNAIADSSSSDYNADDDGFESTNASLGLQHKLSDSLSAGLSALYSDSTTDIDSAGTLFPNAYSDQKNGSANAFIQHQTPLTVTKFSYGQSIDRLTSHDNNSINYQQGSQFDTTQEQARLESQINAQPGTVTIGAEWLSQKLDASDVLDFSGYPNPAVQTAYNPDDRTVKSAFVGYQLSESYYDLQANYRVDDNSQYGNESTYNIGAAVRPLDGVRIGASYATGFRAPTFNDLYYPGYSNPDLKPETSKNTELFVEYNKGNQISRLTGYHTDVEDLIGGNTNTGEAKIKGLSLISDWRVNSFLFGLGYDYLDAKDKTANSANYNNDLVYRPQNSGLIYIGYQQPTFDVRLEAKHTDSRFSDVSNQTKLDDYTLVNLSGSAYITPNLRANLRVDNLTDENYTLSNQFGTEYATDGTNFFTSLTYNWF

SEQ ID NO: 15630 - protein, 373 aa, Psychrobacter cryohalolentis
MDLIMMKNTLKVVLLTSMLPFSASADEGLTPWYVGTGVGINNYEPNCDLMTMKTCSKDDPYAWDVHGGYLFNENFGIELGYLDLGRAEWTDYSNKSHDVGARGLSLGLVALFPLANKWSITAEAGAMNYLIYNKKQWHTEYYSDSGVAPYVGAGIGYNFTDNLMLQAKYRRYENLDEKQWNTLSMESNYWGLALNYRFGTAAKPAAKPAPIAPAAPGDADKDGVNDNIDKCPNTPMTHKVDAKGCSVYEFVTQKYDLGSILFDNDSSVIKPGAYSDVEILVSHLEKYPQHTVVIEGHASNVGTPDYNLLLSERRANAVAALVTSKYKINGSRIKSVGYGLTKPQMAGNSAEAHRLNRRIEAIVTGTEKRVVLR

SEQ ID NO: 15631 - protein, 416 aa, Psychrobacter cryohalolentis
MVIGGSGKDNVKVENITVDQSNVDLDELDNINHIISGVNQGNIGNIGTNGGGEISLSFDPITGKLTTDFNLNASISGATFRSLISTTSRRSTFIDNVMGNSMQSFALASSSKSQSIAMSEKGNLYADASDYIKSDLNNGSYGSNKEHSLFILPYTSSQNVELSLNEESKGHAKGTIIGYSTLKDSGIYGVYAGYEDRKMGSTYFDINNRTYYAGLKYFNTLFTTEKGQEVYIKAQGKAALIKNDLTKKIGNNEAKAEPNSYAYGVNTALGMNFISNKDIFSPEIGLAYEGGYTEAFSMKDTIGQATVKGGERTYANYLNLFSTKTSLTWFRDWLPNLKTSVELGAKFNINPKVEAEARFGNIKVSDEFDLPRVQKFVSTSFIVPVNEAFYFSLSYNGMFDKDGNTHTGFAQFNYLW

SEQ ID NO: 15632 - protein, 240 aa, Psychrobacter cryohalolentis
MKLQQALGVAALACITTTAHAQSAGSIYFTAGWFHLAPQSSSQPLRETNVNGTPVNITLPNTGATAGDGDTIGFTAGYFFTDHIATQFDVGIPPQFDLKGSGAFQQYGKLGSAKQWSPTLLLKYYFNQPQAKFRPYLGIGVSRVWFTDEKISNGTFQNNVLHGPTTVTTDSSWEPVFNAGFTYAFTDHWFAGFSISYLPLSTTAKLNTTANTPIGPVNVQSETKIRLNPIVTYVNLGYRF

SEQ ID NO: 15633 - protein, 414 aa, Psychrobacter cryohalolentis
MPRNGAQKRRTHRGGPTSARPPNQGLEISIMKKHIISAAALLAFAAPVFAQSSVTLYGVIDEGFNYTSNVNVNGVGKSNYQLASGFAQGSRWGLRGSEDLGGGLKAVFTLENGFDVNNGRLGQGGRMFGRQAFVGLSHAQYGSLTLGRQYDSVVDYLAPLTANGNWGGLLFSHPFDNDNTDNSFRVNNTIKYASPDWNGLQVGGTYSFSNATGFSNNRQYSIGAAYTLGGLQLAAAYLQANNPGKTAGGAIADNDANFTADRLRIFGGGVNYTFGPATVGFVYTKTDVKNPVSTVYLPTATFAGLGLTATKFQNFEINGKYQLTPALFIGAQYVYTDGKFDAAAGTVKPKYHTIGLMADYNLSKRTDVYLQGAYQKVAGDKTGTIADGGYVVGTDGPSASANQFAVRAAIRHKF

SEQ ID NO: 15634 - protein, 719 aa, Psychrobacter cryohalolentis
  misc_feature (702)..(702): Xaa can be any naturally occurring amino acid
MRDEMLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHXTIPAAGFNAAIGFVWNF

SEQ ID NO: 15635 - protein, 950 aa, Nitrobacter hamburgensis
MACDCVSEREFHCNRCNVSATARCGALVAALHTPRMSSAFHTNFFSWRAPTWPPGSGPAPPPSENLMTFAPVHPARRPRHAVLMLAVTAALTSATVQAQQAGAASTQTTELDRVQVLGSYASSLERALNDKRYAPSVIDSIEAEDIGKLPAQNVAEALQRLPGVTIERDRGEGVYVRVRGLGPNFQVTTLNGQTMAVNENVRNSGQTGRQFRFDTLPAELVSGLEVIKSPTAALDEGAIGGVVNVKTFRPLQLGNAETHLSAELSHPQLADENDPRVSGLYNWVNADKTLGVLFAAAYAERSLRQDRVNETYWEHYADGIDGNGDGIADTGAIYAPSAIRPTLELEQRKRIGVASSIQFAPSESLEFNLDLFYARQQVDYDEFAIGTGWEPRNMRNLSIAGNAVTAFDYQNGQVQLSRETSGMTDENRSVRFSGAWQGDAWKLQGTGFVSRAHSWNDAPIRRTRLRTGTTVDQRVVFPTASGNNLPQWSFTDGYDPTDPAQTPGRRLEWRIIDAVDHERALQFDADRMLEGGVFSALKLGAKYRTRERRYDRTDLVNNSIAGRRFDASYFYPSLPVSDMLDGGNGQLPRQWLAPREAPFWGDWPTATDLANSPTSEDLQNSYRVLEDISSAYAMLEFSTPLGGRDVRGNVGVRGVHTQQRTEGHANLDGAAQPVVFERSYNDVLPSLNVAYDLRPTMVLRGAAAKVITRPDLTDLSSKLTFNSSGEVLTASGGNPNLEPFEALQYDLTFEWYTSPSSALVAGVFYKDISRFVQTQFSNLDYQGRRYLLSSKVNGGKAKVQGVELAWQQVFTGLPAPFDGLGMQANYTWTDSEANYVDGDTTFQDALEGVAKNSYNLVGFYEKGPLSVRLSYSWRDDIVNSVGTADIATNNTRAYGTLDGNISWQITPALAVFANAINLTGEVQHMYVGDHLFSGYTDYGRTYSLGLRANF

SEQ ID NO: 15636 - protein, 322 aa, Nitrobacter hamburgensis
MSNDFYNRLRRNTKYLETQIAFFSLPQGISNSGIHMKKTLLAVSAALALTSSFTANAAENDQPQYLSDWWHQSVNVVGSYHTRFSPKLNNDVYLEYEAFAKKDWFDFYGYIDIPKTFDWGNGNDKGIWSDGSPLFMEIEPRFSIDKLTGADLSFGPFKEWYFANNYIYDMGDNKASRQSTWYMGLGTDIDTGLPMGLSLNVYAKYQWQNYGASNENEWDGYRFKVKYFVPITDLWGGKLSYIGFTNFDWGSDLGDDPNRTSNSIASSHILALNYDHWHYSVVARYFHNGGQWQNGAKLNWGDGDFSAKSTGWGGYLVVGYNF

SEQ ID NO: 15637 - protein, 396 aa, Nitrobacter hamburgensis
MLRYVIQLNHSFILFMTIRKLIMKRKVLALVVPALLMAGAANAAEIYNKDGNKLDLFGKVDARHTFSDNPGDDGDGTYLEFGFKGETQISSELTGYGMWNYKIMANSTEDSNTSYNKLAFAGLKYGDYGSFDYGRNYGVIYDVEAWTDMLPVFGGDSYTYSDNYMVGRGNGMATYRNTDFFGMVDGLNFALQYQGNNEDDGNGNEGTTNGHGIQTQNGDGFGLSTTYDFGMGFSASAAYSSSDRTSKQVNEGRGDSIVAGGERADAWATGLKYDANNIYLAATYAETRNMTPYGDGDGIANKTQNIEIVAQYQFDFGLRPSLAYLQSRGKDLWYAGKYQDNDLVKYADVGASWYLNKNFLTYVDYKINLLDSDDDFYKDNGIATDDIVGIGMVYQF

SEQ ID NO: 15638 - protein, 3504 aa, Nitrobacter hamburgensis
MTRHSAGNLIFLLVFALLCGDWAEPAKARAAVGGHKALSKLLPASSNASTTDVLLAQAPKPKNFPDDQKIPLPGPDTKDKVTLWQLPEDFKSVIATDSGDFYGIYYSAWNREREDVQLPGVYGSGWIDGSKNNNYQPWKDDEDLAEELSVKYLAQKQSFMVECDSSKDYQTGCVDEVNGEKVKNLNLYGFWNGGGFAYGAIKPDQSVSRPSGGNSPKIGYYWNGELYQTNGGDNYKIQFFAGCNLNTINSSVSDSGLSSPEDCKNGTAPVLDGGSLNFDTKQEYSSSLYVTSKGGTIDNNGRNLILDGTIQSIGDTSDSPSSLFFDGEGSTSLQGNNSYLNPTTVKEGVLEITNVDGLGSADAGTRVEESAVLRISVSGVQTPEGQGAINDAKINEEITLAGGEIDLNGNYIDLKGGVVLEGDGVNSTIRVKGGSTEVFARSIISGDGGLIKDGEGFFRLGGGGPQTYNGETIIKAGELRFADSTSTPKTTHVTVKEGATLRLVGENEVSSIEGSGRIFLQNDGSALTVNVEDESNPDFEGSIRDPRDDLEGTFIKDGGGSLTLTGKNAYGSLIVEKGQLDINGENIDTEDMDPSEASVSLSLGKDLSVKGGTALRVTGRDVDETYGPRTPPRKDGIGNTSTSNKLAPHASPILEFDDSINELTVENGSLLVASFIGALPTDYEAYKDNCKIGADPKTCYSIRPQILFKGGEDTLTNNGLIVGPGEAGTGNHLQLRFEGGNDTLNNGLSEGNDRRSGSWLGCVTAGADDQGFNGYKYGNTCDVANEETGGNLPDANSKDAKRNYTVNVYMGAGNDAFTNHQGSYLRGNFYGEGGDDVFGSQGVIRGNIVMGKGSDTVTFQGGGAENKGQLRGIGVLDDRLALGTAIKIENDNSLDTDVNKLNLFGNAVVSYRNSLGWGVKEDLENCGGRKSTTGRSDYGCRWDDGGYGYAAIVGSKGKDSIWVKKKSDGTQPVAIWGSVELGASNDALRLGNTQDKFGGDLHLIGDLDLGSGNSQIISIDKNSDFSVRAIRGDNIDFQIYGLATLGGDSELGVFAADRDVDLKQGNTLSSYTGTTTINEGGTLRAGQAWSLSSESIHQVDGKLILGDNDNRREDQEIGELTGKGLVSLQNQSYLFYGGLNGDVEFSGTSKGDGALVKKGSGTTTFSGTFGHTGFTKVHDGTLLLQEDESLSEKSTVLISSSTKQPTLDLGDTTQRAPKYNLHGGTLRNGTLGAAEINVERRTNNAIDSIEGELVSVNVSSRNDFEEEVGLTFSGSNQFKSLQIDRATVLIDESANVELSGDILGGDFVSRGAAFELSDKLDIQGSLTVGGSIDLDAGNDLIRIGNLASVSSGVIDGGSGDFDVFWNQNASLDFDTSNVKGFEIISYKGEGLAYLGDKASLIVTAADRDIDDSLYTEYGLIVSTPSNNTLDFSSNSNAKNIESGITVGLLQLDGDSTIHLRQGSLDIAALQSNAKGKRNKFILGAPLELSSEAPLQSLRESLVSPGSGVDLDQVASGRLSVGASDQSIASIDQQGGLWSYEGDFSSTSLSGQGVVVVGDGNDDSESSATFKSLTADGSRRLLIGARKDGVLSVTNGIHDSWSPDLGFLNVSKASLISNGDVVLGISGGDNPSTYKGLTVVMQDGSIKTLENDAIGPQSPTLVRGLLQIGESEGSGVSQNFARRLIVGETGSIQNGDLSVTSLANAGDVQIDSLTVNNGMKRLLDVLDEKGRRPIPVDSPLRKIKAQGSLKNLGGNIEISGDLKYQDNQDASAGHALFNIGRPRLRKQPGLLQANRIFMGPKNDLIFNSGIIATTTDEKTSIDLGGGNDLILNRGTFEIGSSIIDGGEPLEITGSILTREARSATGLNIFRGSGTEDPGVDENQLVNFAAIKLTADGDWIFPQGNDCRVTGVGRTFSKSKLDCVGIVGQRNADQFLQITDGAIVKTGVMELGRSSDNRIEVLDGTLEAGLIDGVVGSARINRYSGEIVFDRSVNASFNSLIVGDESSTASLKAKAIHNISSIHVVNGSLDTDLLHAKDLEDLGQVPELKIGATIDSSLLSTGSPKSLIEQISDNAVKGTLRVDETEGYSKAQQLGGMWGYEGDFSDIDLSAQGIVTTTKSSDDFSIKDDANEDLQEDIDEVTFKSITALGNRRLLVGAREGGKLTITDGLHETETSNKAAILNNGELVLGTSDRKVPQSSTYSGATVVMKDGHIQTLNADAIGPESPTLVRGRLSIGDETTGVIEQNFAKLLIVGKGGIAENGALSVTSLTNAGDVQIDSLTVNNGMKRLLDVLDEKGRRPIPVDSPLRKIKAQGSLKNLGGTIEITGDLKYQDNEDATAGHALINIRNLRDVTQYNQKGGLKPQPGTLVANSIFMGSNNDVILNSGIIATTTRQSTSINLGGGNDLILNRGTFEIGSSIIDGGEPLNTTGSILNPDARSVTGLNIFRQGLDPYRGLSDQASGLEEFQLVNFAAIKLEHDGDWIFPQGQDCQVRGESKTFDADKRCVGITGLKKENQTIVIENGARVEAGVVALGRDSTNTIQIEKGSLRAVLIEGGNELLDRIRDKRGLASNNLPTKKEAILLGKEGSDASGELIVGGIVDVEKITQLGGTWAYAVNASEDGFGVFPETTAAGTLAVKEITLNRRSNDSSVVSRATFQKIDGNANDLSVEVDSDASLAVIDGIHGAKTTLSTEGEVRLSGESDYRGVTTIQNGGILYSENNSALSEKSSILIEVGGVLDLQGFDNTISSLSGSGDLVLNPRTSTMQISADEVKGADLEIQAGEFAGIIADGGLSGLGSITKTTDGELILSGVNTYSSPTFVDGGTLVAASSSALSPESDFTLSNNGVLDLSTYPRQARFKADDKNYSAYLKSLTIGDQSSNQFKPRLTVSSLAPLRVKEQLAFDQGEIATFLDSGVESTAPIQIDQAGKFVFREESRNLGPASLYMVVSNEEARQQEGTWNVIDGVVENADELAKNTYLLVPALPGEKKRENKADFVEINGVDYRIAQFDGVDQPLADAALSDVRLEKGSLKLVVEQKSFDGIQEDLNGDEGDVDELPGCENDDELCDVISDIDGEEDQASNAEEDSAAEIIDGVVDGLQDQEIEIPLGFNYGQLAKLVTSGLAPRNVDAAGRGIALFNNQLVDSVFDRHPLRQFEELIAESSATQLNSDLLSETAVVKSDSDDVLSSDIGIVEADGVSYVDLENDSLDLSSRDGVSAWMKGFGGNSRADNSSILYNDYDLSSYGTSFGVDIALSDSFQIGAYANYGDVRIQHSSDDTGGGSWDSDGWGGGLTAQYSTRNFYVQGLLGASEFSGEQTRNILQINQDFGANTAKGDKKVTSYLGALRMGAPFKVGGVVLEPQAQAVWTQNREDGFSETSGTEKNLRLKYKDRATNFLETELGMKVSMPIRTGDRSLLVPSLRAAWLADWNQNNEAQQIGYKFTNQTVDFDSQLETQNGALIEAGLDYTIQNFNRTSLKVYARGGAEVWGGDRGTTWRGSGGVTFQF

SEQ ID NO: 15639 - protein, 297 aa, Nitrobacter hamburgensis
MGRSKPRALARIVTLAAGIGVPGFVHAADLLPPPPPPPPPVEVGGGWYLRGDVGVGITDLRQTIAEDVTVPAKPYKYKTIQDHLSDQFFIGAGVGYQFNPWLRADITGEYRSQADWRFVSKDVSPGVGPGQNLYNRDTGKLSTVVSLANVYADLGTWYGVTPFIGAGVGVAHHMFGSVTDEGLGDAAGGFGYGPSNAKTNLAWAVHAGLGYAVSPNLKLELAYRYLNMGEARSGRLDCFPGCVNPPLSTVYTLKDIESHDIKIGMRWMLGGPVVAPVPVPVASFEPAPPPGPIVRKY

SEQ ID NO: 15640 - protein, 779 aa, Nitrobacter hamburgensis
MTNHRIMRAGLMTGAACVACCGSAHGQTMEAAPLQDQRAEAAQLGEIVVEARRTRENLQTTPVAVTALTGELLAKLNVRDVVATAQFTPNLSIGAQPASITAASVYIRGIGNASPSAVSEQGVGIYLDGVYIARSAGAIFDLVDLERIEVLRGPQGTLFGRNSVGGAIQLVSRKPAQSPGAEAKFGYGTFEDWFARVRLDTGPLGNTPLRASVSYMHRQRNGYFDNTLAKSSRDPGALNSEAVTAAVQGDFGDLTANYAFDYNTREGVPAFFQVVAASDDVKNYFGQSESFGGAPFQIGPVGLRQGQQLPATDLSERLTFSVKARVYGHSLTLAWQAAPHLTVKSITAYRSYRQDGANGLSGNGNMLGFTLSPVLFVDGSVVPEGISPVNLYDGYTTQRQHQFSQELQIFGEAGPIKYVAGAFYFDETSSEANYQTLSYVLPGGEAAVNLFPLQAFNGKARSHAVFGQVSFSPGNGDFELTGGLRYTHDRKWLTLAGDVQPNLDGSASYDNVSWLASASYRLRPGVMGYIRVSSGFRAGGINPSASEINVFAPEKIVSYEAGVKAEWFDRRLRTNLAVFHVDYRNLQISQFLAGTGGATSAIVNAGKVAYRGIEAELTALPAPGLTFDGSLGYTAPKYKTYLYVDPATDEVVNVASEARMSQAARFNAHAGAQYDHEVGIGRLSLRADYSYRSTVYWFTLDRLNTFNRDIRSRPDHNLRARIALDDIALGTARLGLGLWGDNLTDQRNIDFGIDFGSLGYGSASFKKSRTVGLDARITY

SEQ ID NO: 15641 - protein, 728 aa, Nitrobacter hamburgensis
MSVPHSRRSLIALAVAQACAFAPVAMAETSENVLPEVVVTSGSAPDGIARNASVGGFSDTPLLQTPASISVITAEQMQERSIRTATDAVKYDASVQNSYNAVGLSDWFAIRGFTLDMGSNYRKDGMVILAHSAIPMENKERLEILKGLAGMQAGIASAGGILNYVTKRPTDTPVRSATFEVRERGTVYSAIDLGGRSDDKRFGYRINAAAEDIKSYVKGSNGDRRFVSGSFDWRISPRALLQVDMDYQHKSQLTVPGFQLLGPEQRIPTGVSGKTMLNNQTWSLPVTDDTNNLGVKFEYELNDNWRTTLQANKFELRRDDAVALSSGCPAENLAFGYCSNGDFGLYDLRRENDKRSVMTTQALLQGKFATGGVKHELTTGVSTLNRRDNYADYLFTSTVGGLPGNIYTLPQRALNQEQALPVALRRKDNEQSFFVQDVMALNEQFKVHAGVRYTKLKRVQFAADGSNIRNTDSDFVLPNVALVYSPKANLSFYASYAQGMEPGGEIPSGLPNAESVLDPYKSKQIEVGVKADITPDISVSAALFQIKRRNEYVKASDLTATATTAAYVAAGEQINRGLEFALQGRATRELMLGASFTAMEAKAVDTGDAAIEGKRVGNVPKFKSAVYADYALPQMPAVKLNATWIYSTSKIFAPNSQIASLNKSVDGYHVLNVGARYATRISGKTTTFRFGIDNVFDKFYWGDSANAFGGYLIPGAPRLFRLSAQVDF

SEQ ID NO: 15642 - protein, 647 aa, Nitrobacter hamburgensis
MGQTGWNKKASYLKADGSYHHLYDEYLAQAFGKKLIPSTQGGLNYAYSGGVIVGAHNTRTAEQPHLALEKQINEYLHAPVKKEALHILWAGGNDLATVLATAVTKTTPEEKQAYVLASINTMAQTMAQQWGALQQAGVNQIIAPTIPNVTYTPEFFDKLGEAAGAQIQAKSYGLIKQSDFVANFKAAAEQLLVQPTKNLEEFEKHRVQTLEKAAEDFYNSRYWFTQIALSSAGYNAKGIAETLIKEYKTIVEQAAQATAFLNASITSALNQVGGNIVRIDTDGLLKDMMTRPAEYGLTNTTTVVCKESTADPAKPACKPEDQTAASQRLFADSFHPGPTAHKAMSDYILNVLQTPKDMGILTQIVQQQTELALDFIRTESNRHRLQQQSAQSVDTLAAYQKQKGGHSLHVGAKVQFNPQWQLALVASQQKQDVQQGLININTQNRVLSTALRYDADNWWLGSVLQVNNTTLTTDRVAYIGHSAHQQSAETEAESFSMGLFAGYEWKFKALGIALIADLNKTKTDVAGFGEQNRGITQMQFAARTEKSVRSGVGFDLRYQAASWQPYVTTRWVKEWNNDLPTIQASLNGSSFMTVLPSQDNQWVNIVAGLHFKPISSGFHANLAFRRDLGRKNALSNTTLQAGIGFTF

SEQ ID NO: 15643 - protein, 653 aa, Nitrobacter hamburgensis
MSKGVTMQSLLLKNSVAFVALSIAFPALAQAPEEMFDDSGIVVTATRTPTPLDRVSASITVLDKATIDRAQDIGATELLLRTPGISMSRNGGYGTATSLRIRGAESEQTVVVIDGVKLNDPSSTGGGYNFANLLIGDAQRIEVLRGPQSTLWGSQAIGGVVNIVTASPQAPIEGSFDIEAGSRDTVSARAALGGVSGPLSWRIGGQSFTTEGISAIAPAFGGGERDGYTNRNVAGRAELVLGANASIDLRGYYSTGRVEIDGFSGDAPDYSHNREFVGYAGLNFALLDGRLRNRIAYNYTDTDRDSYSPELERPLSFEAAGKNRRFEYQGIFDLSDRISATFGVENERSRFKSRSPSGSLADPLPDFVTGKAEITSVYGQLTVRPLDGLTINGGVRHDDHNRYGGRTLFSAGGIWTLPGGTTLRASYGEGFKAPSLYQLFSEYGNVNLDPERAHGWEAGAQQAFFGDMLMIGATYFERTTTGQIIYNGCDVGTTDPLCVVPGTDTPRWGYYLNVARAEAHGVEADTAFRLGGLTLDGNYSWTVAEDRSAGTANEGNWLPRRPRHLANASLSYDFAFGLTLGSAVRWAGKSYDNASNATRLDDYTLVDLRAEYRLSDSLRLFARAENVFDEQYMTAYRYGTLGRSIYAGIRGRF

SEQ ID NO: 15644 - protein, 126 aa, Nitrobacter hamburgensis
MSTSNTARAIDQLALSEDVLAFIEKTRDEASLAFQVFRETNTITANGTVGFVERIPGHELLVELGDYTLVGARAGIQTDRWSLFLFANNLTNTLAKTSSGNVLGGSIEAITSAPPRTLGINLNTQF

SEQ ID NO: 15645 - protein, 795 aa, Nitrobacter hamburgensis
MRCRTIFLSGCAFALNALPSMGMAQTAVPPQAAEAADVAAGDIVVTARRREESIQDVPISVSALSGEQLRRQGVTDAQSLQYATPSLSITSAQSQRNTVAFALRGQRTQETQLFTDPPVGTYFAEVVQPRPYGFGKTFFDLQSVQVLKGVQGTLFGRNMTGGAVLVEPAHPELGSFSGEVRGQYGNYDMKDLYGMVNIPVGDNFAIRVAGKTRKRDGWAHEVTTGRDYDNQDFNTFRVSTLWKPIEGLETLTVGDWYKSKEHGTAAFITDLRLPSVISNYEGLRAAGLITANIPAQYAAARDMFYKKHFTLDMGAGEGGNLDVFGKPYENIKNWGITNKTTWELSDTITLKNIFGYRRLQRDQVQDYDGIPAFLITPYQYARSRNISEEFQIQGKAFDRKLDYIAGLYYFEEKGKDGSLANTLPELNIVGAGQNPRTASATQFVTANPGVGYSRTAAAFLAGTFHATDQLSLSGGLRYNYDKRKITVSPSLPFRTNPAGGTGVCSFDIDAATAGTQTVPFDQCSFTNQKSFKEWTYDATVQYEPSANVTAYASYRHGFRAGGFSTRATSYVTLAPFLPEFVDEYEIGLKTSTRIGSSGRLTTSTAIFRQDGSDVQKQRATFVNGNVFTVIDNTAKQRNSGGEFEATLSVPNFSLTGFYSYTKVKILRGAAVSAIGPEIAQRGTPKNQAGFTATVSPPISEDVGQLNLIGNFTWRSKNYLDDFEVSGVQPAFALVNLRAELNDIGGSKASIAFFVNNATNEVYRIGVLGLVAEGLGFSSSVYGEPRMYGVELGYKF

SEQ ID NO: 15646 - protein, 692 aa, Nitrobacter hamburgensis
MSAAFVSGAYRRSLLASAVLASLGSIGLNTPSSAQQSASPNLLPPIRIAPPPERTTAPMRRAASRSRRAARSAPRQAPAADTHAPGTPGSTVVSPTGVVTPAAQLASSITVITENDIQTQQHRSVPDILRTAPGLNVVQAGGPGAQTSIFMRGTNANHTKVILDGIDIGDPANSNGAFDYAHLLTADIQQMEILRGPQSGLYGSDAIGGVISIITKKGEGPPRVTGSLESGSFKTFNQTLGVSGAERNFNYAVNVAHLHAGDVPVTPPELLPPGRQAIGNNYDNMTYSTKLGVDLNENLTVNSVTRYTDATLLFTGDGGFPSTPNASQSTHSVQQLFNRQEAVWSLFDGRVQSYFGLNFTNSRAYDIGPGDPAGAITTGERLKFDWRTVAEITHDNHLIVGAEHQTDRMDTADFAARNGNKAGFVQLQSAFANRLFLVANVRQDSNDLFGGRMTYRIAPAVIVPVTETKLKASYGTGFKAPSLSQLFRDYPTFNFFANPNLKPEDSRGYDAGFEQPLFNHRVRFGSTYFHNDITNLIDYNATFTSLVNVNSATTEGTETFVSAQITERFGIRADYTFTRAVNAATGLQLLRRPKEKWSATATWLPLDELTLSATVLRVSNWLDVTRDGSASGIVAPGYTLVNLRGDYALNDQVKVFGRIDNLLDIRYQNPTGFLAPGLAVFGGIRVASYGVR

SEQ ID NO: 15647 - protein, 229 aa, Nitrobacter hamburgensis
MFNGNGKYYWDNKKYNEATVRIGGGLGYQTASVEVSLFPFQEKRWYAGGSSGTNTMKQYADKLGIRLENVDWLSKTWQISTALEYGESRYKIRKHLDGNYYFVSSTLFYLPKSTQFWFVGMDFHRENTQALDNAYQQKTLRLGWGQDWFYGISSRLTFSYANRVYREKDLIGIQQKNREYTTTITLWHRNIHFMGLTPKLSWDYQKSTSNHAFYRYDKNRIYLEIGKIF

SEQ ID NO: 15648 - protein, 257 aa, Nitrobacter hamburgensis
MNKLLIGAVGALAIGLGAAPATAADLAPRTYTKAPPPMMAAIYDWSGFYIGANGGWGSSRNCWNFTTPAGAFVANEGCHDATGGTAGGQIGYRWQSTNWVFGLEAQGNWADLSGRRASLAFPAFTNDSHLGAFGLFTGQIGYAWDATLLYVKGGAAVTSNRYRSLATLTGAQVTNDVNNSRWGATVGVGLEYGFAPNWSLAFEYDHIFMGNSRTTFINNGVAGAAGTLFGTDNISQDVDLVTARINYRWGGPAIARY

SEQ ID NO: 15649 - protein, 237 aa, Nitrobacter hamburgensis
MKKFLLSAVALGALGAPAFAADLGPRPAYTKAPPATAPTVVYNWTGFYIGGNVGGAFAGSNNLQSDSGRFMGGVQGGFDYQFAPNWVVGLEAQYSWMASNNTGVIFPAGSTATENTRGLGSVTGRIGYTWGPALLYAKGGYAFRDSSLGVATAGGIPAAYSTSGSRNDGYTVGAGLEYMFAPSWSAKVEYQYYKFDNTAFTSGPADMVGTTFRNDDHTVKAGINYRFGWGGPAVAKY

SEQ ID NO: 15650 - protein, 924 aa, Nitrobacter hamburgensis
MSNAKFKLNAICMAMLVSSTNVYAQQESTAAEDADLEVINVTGIRSALSKSASIKQESSGVVDAISAEDIGKLPDTNLAESLQRISGVSIDRANNEGNKVTVRGFGPNFNLVTLNGRQMPNSSALQSDGVSRSFNFREIASESVSGVSVFKTGKANVASGGIGATIDISTAKPFDYDGFKAFASVKGVHDSSVDTGSSITPEISGMISQTFADGKFGVLLSASHSERDSGRDRVGTSSGWVRNRANPNGVDASAINTSNNPTGAYWVPWTPEIERFDTERERQNAQLVLQFAPNEDIEATLDYTMSRFEETSSTNKQAFWFDNPAGTTDENGTLVDITNVNDELNFWAWERYEKKENDSVGFNLKWQATESLNLTFDAHDSTSHSNPDGQTAETLANLKNPSGSVALIGANFSGEIPSIVVDDSGLAGGAYNPDNIVSDLYQLRGYEMENNIKQYQINGNWENIEDGALAAINFGVMHTDYQVDTYLSERFSFVDIPLDDLGLTFEPLGGFADQFSGANALFPYIPQFSANTFVDIVRDQGLFRAPDVTTNGVNEKTTALYVSFDFRTEFNDFPIDLNVGVRYEDTDVSAYSVQPGIVALNYRHAEELRPVFDTTATAQELDGNYTRILPNLDFSMELTGEVKTRFSYSRTLARAGISAMFPSTNIDARPEGPFNASQGNPNLLPITSDNFDFSVEWYDDDGSYASVGYFKKFVENFIGAGVEQRAINDVNGNPLRDPSINPRPGCPDSSDTPNPACLSQASDPIVIFDVATPDNLQNREVDGWELNAQYMFSDTGFGAVANYTLVDSDESFDPYDFDQTIALTGLSDSGNLVGFYENEKLQVRIAYNWRDDFLLSLGTEPTFTEAYGQWDLSINYEINETFTVYVDGLNLTDETVRRHGRFQEQLISAEQYGPRFSFGISGKW

SEQ ID NO: 15651 - protein, 745 aa, Nitrobacter hamburgensis
MYRTTPLAAAVMAAFATPLYAQTTTPATPAVQIEQAATSTSPASQPSASQPSESSVLPAVRVSGQADNANDFQPETSSVGAKVPTALRDIPQAATVVPKAVLQSQAVSSFSDALRNVPGITIGAAEGGQIGNNINLRGFSARTDIYLDGFRDRGQYYRDTFNLESIDVLYGPSSLYFGRGSTGGVINQVSKEPTLRKRADVSVQAGTHDRYRTTVDLDTPITDTSALRINAFGQSLGSSRDVMKNKDYGVAPEVKFGIGTPTEITLSALIQHNRDQPDYGIPPLNGHPAPVNRGTFYGYTDDRTIQDVQTLSARIKHRFNEDLILRNQTQFSHYSTQARATNAASVLTGPLSTSPALTSGNFTTIDPSKLFVKLQGKDRNINDHSVYNSTDLEAKFNTGPLRHDVITGLDLSHETYSNQSFTATSPGMTSNTIGVVPLIDPPYLPRPANVKEVATNLAESSANGVGAYVNDTVSIGQHWKVVGGVRWDRYEASIHNSINTPRYATQTNYFTSVRGGIIYQPADWQSYYVSYGTSFDPSLEALTLTNGQQNLPPEHNKSYEVGAKLDLLGGGLSVTQSLFNIEKTNARTANPDGSYTLDGDVRVRGYQLGLAGHITNNWQVFGGYTYMDGEILKAFDGTQGKIPANTPKHTLTLWTTYLFTPHWEIGGGPTYMSSRYAANNNFVQVGGYTRWDAMAAYHAKRYDIQFNVLNLTDKNYYDALIPSDGGRAVPGYGRTFLATVNYRFF

SEQ ID NO: 15652 - protein, 415 aa, Nitrobacter hamburgensis
MRSVARILVFSFTLITSAIFASGGQSFYPFAFINPAELSQVKHWKVSVGYYAAFVRNKFQGSVTIPTGLSFPTFQTVTQTFSGIARSSDVSHLPGGQIAYRINDRFVVGLRYSEPYDSTISFADTFGRFANNKSSTRVNDISPEFAFSFSPKFSIGAGLDIMHLFAEANINTIPFLIPFSPLSVNEGLSKNHASGWGLGWHIGMLINPWLGNYLGLTYYSRSRYTLHGVTQFNGSFLDGTPIFIKNGIVVPQARPDTFIFSDFQALSEKFGLFLHLTYTLWSILQSITVENVAVPNPPYDSNTFTIDFKYRNAWRIGFGGRYAPSENWIFFLGTTFDQTPVPSPQYRGLFFPETNGIHLWASLTRKFTKHFSTSLMYSHSFYQKRAVDNSFAGVTSLGVNRPVVDFIGLDLTYES

SEQ ID NO: 15653 - protein, 201 aa, Nitrobacter hamburgensis
MFRSLLIATAATGLAAAAHAQDSGLYLEGGYQYLDIKPDGAESGVDTNGIAARAGYQFNNVFSLEAELATGIEDGEFDYNVDEDEFNFDDNNDGDLGDVIGASGDVGLNYLTGIYGKANLPLTERLDAYARAGYAYVDLDASLVTPGGNVISVEDSADGPAFGAGMSYDLSENLYLKGDYTYYSFDNTDTSGVMLGVGYKF

SEQ ID NO: 15654 - protein, 890 aa, Nitrobacter hamburgensis
MAHCTAPCSWMPCVKRPMPYLLSLAVLSVLIPLAHADEATPATGKTLATVSVTGSNIKRSDSEGPNPVQVIDRQQLEQSGKVTVADALRSISANTGNATNETTNNGWASGSAGIGLRGLSQKNTLVLLNGRRLANYGFPANGLGDTFVNLNALPLVAVERIEVLKDGASAVYGSDAVAGVVNIITRQDFQGAELGLSGGTSDQGGMDTQRAKFVGGIGDLDSDGYNILFSFDAYNRDRLDQDQRALTRSGIYSDLPGGRWNGWSAKGARYLVGGRSVPMLDAQGNCPAGTVLTASAPIDGLAGDTCGFNQAPFTTLIPSTKRYQAYTNATFRLSDSVEAFGEALYSEVKGVSIFGSSPYFTLEGGRFALNASTGLAEPVSNLLPASSPYNPYGTAVPIEYTFFDLGQTVKTNRSQSYRFLGGVRGTTERWDWEAAAFAARSTEHETVSGGFANRFTLAQALADGSYNLLDPAATPQAVIDGINLSTLRPAQSTLRGVDAKVSGNLFELPAGSVGFAAGAEWRQEELVSRNPLQIDQGLQIRPAIAAVDGERKVSALYAEVNVPLLPSLELQLAGRGDHYSDFGDAFSPKASLRWQPLDAVLVRAAASRGFRAPSLSENAASTNISYGSVVDPYDPDVPGSRQNPTFFTVGNTALDPERTRSYNLGVVLSPWAETSLSVDWYKIELDNLVGTGNNATIVQNNNPADVVRNERGTLVAVYNRYQNLSELSTSGIDVELRQRWRTEAAGNFGLNTAYTHVRDYRRPTVVGGPLQDYAGSNLGPSLPRNKATTTLDWNLGTISAALTWYYTGGYDQKASAAASAVQSRVGDYNQFDLYLGYTGIDALTLYAKIENLADKQPPVDASFPGIRAPYDFTQYDLRGRYFTVGVDYRF

SEQ ID NO: 15655 - protein, 786 aa, Nitrobacter hamburgensis
MKRILFIGALLGGESYGALAVAQDSTNLPPVTIVSDGQPRNVRQNSTTNARGRTARRARQAVPSNQQPVPQQQQQSGGVRASQNSVLSTTPQLAGASSVTQQGIAILGGPAQTSFYQPLALIPSVSVQTPDPYGLNTTRNINIRGKGDFHLSRTIDGLPLMGIVGGSDLFDLENIGRIDVYRGAVPSDKGIGLSNATGVINQLTLRPQDKAGFTARQAFGTDSFYKTFVRIDSGLNPETATKAFLSGSNIGVDKWTGAGDQKRQNVTFGLSQDFGDRITLDVTAVYNNYAENFFRALTYPQTTNLRNNYSHDFNTTLTGVAATDVNYYKFNRMNAKTFATFAKLDYNFAEGQHLLFKPYYWDNDTTRYNAAGSNVQIWRQQNQNVGSVFEYAGQFPWGTDVVVGYWWQSMKPPPPPTDQRRFTVDAAGGLDFSHWQSLARIDNFSVNSPYFQVSQNFGSTFVTSGLRYMVLGAPQMLYYNTAGISDGTHGQALALNPAIYPDATLAARDYTAWLPNVAIRHDLNPALSVNFSYGRRFGRPDWGPQASNYISNRTVFTARGFSLQSLVDKVRPEISDQFDASLRFSQYGLTVIPTLFYAKYQNKQVKVIDPSIGPNIAYFQGTGSSTGYGFELEANYRFDEQFSVFGSTTLASETFDSDTPTLSGGAMLATKGKQIPNTPQVMIKGGVTYQVDRLAIMPIVRYIGPRFGEAANTQRVSGYTVADLTMSYDLGSHFGVESLNASFSIQNIFDRQYISQISPSDIDLSAGATYFLGAPRTVVGSLSMKF

SEQ ID NO: 15656 - protein, 741 aa, Nitrobacter hamburgensis
MPSCYPVSSGRSDGHAEPHPLYRKPRTTGMVAMALSLGVSLQAGLASEAKAQQNQGGSASEDLVGTQGRAIALPTMTVTARRIEEDPKDIPFSVTVLDGKEIEQKGNYSLEEVLRSTPGVSVNTSGGANVSSISIRGVGALYPLSMDDASVVVNLDGSPVNPRNLSLGILDLEQVEVLKGPQGTLFGGLGGAGAINLTTRKPTRHVEGYVQGEYGEDHQHRMAAAVGGPLSEQFSGRLAVQQSAYDYPITNRQTGEPLSEPDFLGVRGSLLWDIQPETSALFSVEYDHSRHMGENIVLKPYGDDPEIDLTPGVYDYSKKNMKRYSLEVNHEFENSQITSVTSYSDTYNISPVFFDRMVYQSMMGVPSEYWRDQEVSENVFTQDLRVSSLPGANLFWVAGASALYSERGYDHPRVGGASGIVYPGTSQYRDFTTQRYGVYGEVTVPVIEDLKVTAGVRHTLDLKTYDATYTARGVSVQDSGDLSDNFTTGRLGVSYAVTPEANIYATFSRGYNPGGYQDYAETAGDAEYKAGSIYSGEVGMKSEFLNKRLRLDASAFVTKVQDNYMIDSKGVSSFVLNADTRSVGGELAASWRVADALTLEGGVSYISAVIQDDVNATQGGAVKAGNHVPDVPEWSGKVSAIFNKSLPRIGFLPSPELNARLDYTYVGERPADVQNHYDLDAYHKVDTRIGIAQSGVELYVWGRNLVGDHYDLYGFYDVASATKYGAPAPGRAFGLGFSATF

SEQ ID NO: 15657 - protein, 337 aa, Nitrobacter hamburgensis
MRAMKSRLLTTVALIGAVSSFSSFAKAADIIEEQPYFPPPAPVIVEEVATGGWYLRGDVGYVFKSKTDGYYDFYNIGNTSPEAYDDDWVRGIDSTEHYDEISLKNSANFSIGAGYRVSDHFRTDLTVDYMRTGVSGSSKCAYLVEIGYGLDPTNNNCRYDDSSRASIWTTMANAYVDVGTYGKITPYIGAGLGFAHVKYDDMNNTISCDGGLCGSETSIYKGVHKGESSWRFASSLMAGASVDITHKLKFDAGYRYTRISSGDAFAFDEQDRSFGASGVQGSDNGFNIHAVRAGLRYEFGGGGGGFGKGKGKGVEPIYASTPLYEEPAPIYEEPIYK

SEQ ID NO: 15658 - protein, 544 aa, Nitrobacter hamburgensis
MTGNVTNDNGWAEQNASRVRQIFGKLRYTDADTTLSLSAGGADNDLHGTQTIPRSFLGNPKQPYTYPDQNLNSAGYVTLSGEHYFSDNVELSGNAYYRHFRNSNVSSNTNPNFGSIDDDGDVDTTQATNEKSVVSTDSFGASLQLTLLGKLGGMQNQFVAGVSADIANSRYTQSSQDAVFTASRATVGIGDFTQETAAKTHNGNYGIYLQDTLSLTKQWTLTLAGRYNWAEATIGDSSGLQPQLDGHHTFSRFNPAVGINWNPTSAFTAYATYNEGMRSPTAIELACADPAAPCSLPNDFVSDPPLQPVISKTFEIGARGRIGQTTSWSAAVYRTTLDNDIEFIASNGAASNRGFFQNVGRTRRQGFELSGRSQLGPLAVTASYNYIDATYRTAWTENSASNSSADANGNINVKPGDHLPGIPANTVKLQLDYAATAKWRVGANLTWRGGIYAQGDENNQDVNGKIAGYFLIDLDTSYQVTKQLQVFASVSNLLDKRYASFGSLGENFFNGPNHTFDGGNPSNEQFVGPGAPRGFWVGLRYAWK

SEQ ID NO: 15659 - protein, 247 aa, Nitrobacter hamburgensis
MKRILLGSVGLIALGMAAPAFAADLPARTYTKAPPMIAAIYDWSGFYIGANGGWGSSRSSWDYLGPGLAVGSEGSHDADGAVAGGQIGYRWQAGTWVFGLEAQGNWADLSGSNISSLFITDTIRTKVDAFGLFTGQFGYAWNNALLYVKGGAGVVSSKYDAFTTATGAALGSANSTRWGGTAGVGLEYGFAPNWSVAVEYDHVWLDTKSADFYNAGAYVGTDNIRQDLDLVTARLNYRWGGPMVARY

SEQ ID NO: 15660 - protein, 898 aa, Chromohalobacter salexigens
MGRVSLCLVIMFFICSAQKIDAQVQNIREKQDTISATKSLEHIRPENIKKGPLNNALDVLSGQSAGVNVTTNGTDRLAMLNSIRVRGTTSIMGGNDPLVIIDGVTSDIATLSTIYPADIESFTILKNATETAMYGSRGASGVIEIKTKKGTGRGFEISYDGNYGFESMYKHLQMLNGPEYIATAEALGLDYNNGGYNTNFHDVITRTGLIHQHHLAFSGGSENSNYRASFGFMDHNTIVKVNDYRNLVVKLDATQKAFDGRLVGDFGVYGYSSKIHDIFDTRMLFYSTAAQNPTYPAGTDVNGNWVKNSAASHINHPGALLYEKNDSEERNFNTHLGLKFNILDNLILSAFGSYSYSSTGNAQFCPTWVWAQGNVYRGEFKGEDYFTNVSLSYNNAWGDSHLDAVVGAEYLKQVRTGLWVQAKGITTNDFSYNNIGATSSRPFGGTSSSYEDPSLASIMGSVTYSYKDRYSIAAALRGDGSSMVSDNNTFGFFPSVSLGWDVKKEGFLSDTDFITMLKLRTGYGRSGNLGGITSYTTLNTVKENGIVSINGAPTVTMGSIRNTNPDLKWETRSTFNIGFDLGIWDNRLMLTSELYYSKTTDMLYEYDVPVPTFAFDKLMANIGSMSNQGVELGISVVPIQRKDMEMNINFNMSYQKNKLLSLSGEYNGMHMTASDITPIGSLYGAGQNGGDNNVVYQIVGQPLGVFYLPHCKGLKENELGGYSYDIEDLNDDGEIDFSDGGDRYIAGQATPKVTIGSNISFRYKSFDIAMQINGAFGHKIFNGTGLAYTNMSIFPDYNVLKGAPEKNIIDQNVSDYWLEKGDYVNIEHITIGYNIPMKSKAVKSLRLSAGISNLATITGYSGLTPMINSYVVSNTLGIDDKRTYPLYRTYSLGLSIQF

SEQ ID NO: 15661 - protein, 1243 aa, Chromohalobacter salexigens
MNKPRFTRYVLASALTLALSSARIVAQTATPSDPTVNSEDDQPIVLSPFVVDASEDRGSYQATSTLAGSRVKTDLKDVASSISVITADFLKDTGARNSQDLLVYTTNTEVGGVYGNYGGVGNTFIDGANENANLVRPSNNNRVRGLDSADNTRDFFQTDIPWDSYNVGRVDLQRGPNSILFGIGSPAGIINSSLNLATFGKNGGSVENRISSFGSVRNSIDYNYVVLKDELALRLALLDDHTKYRQRPAFNRDQRAYLSGRWAPKFLNTGSSRTSVRFNYENGDIKANRPRALPPWDSITPYFDSTAINKKVYDPYYAWESQAIGYPSSEPQNAMEPKNYWVVQYMVPGTQATANPMFFYDMANSTTHAYVTQAGPTTYYGLSSNGDRDAGIDGFPYGSNIGIASFNEAAYNSWRTLGQAATPYPAADKGFYKRKSLVDESIFNFYDNLIDGPNKGEWQKWDAFNIAVEQTFLDNRLGFELVYDYQDYRDGSYRTIGNPTITVDIRANLMNYPWTYPELGVVKNPNVNRAMVGGSGRGGGNAFFSTRDDIRFTGFGEFRFKDVLGNSLLSTILGTHRLTGLYSRDTVQQENRTWTLWKVEQKWSDVLGNGTVNGGSGIGGLVNGDVVPDVVTYISGDLSPRSSAAGLNLPRLATVQEPTAGGYVIPYFDSHWNATNVNPADPWTNPARQFWPGGNQVGFQSDNPANYVGWVQDKFNLLNWRSGDDINQLYTDVSKVRKVTDSQAFTWQGFLFEDTVVGTFGWRRDEQDLESGDSSASDVGGSGYAHTDPAFEKGPDRSAGESKSWGVVVHTPKRFRTLLPGNSYLSFSYSDGTNMRVENRYGFSGNALPNARGKTKDFGVALSTLNERLVLKATWYKTTVKDANLSTVTTETTTLGNNTYYLRNLEAWGTTSALIDLAGRQGGAPGWEWYWNWALIDNGWDGIYNDPNGDAFRDSPSTAKQTAAINSWLSQMPDQSWFDAYGFPIDVAAAKAGNWQNAIRGWTPSAGVGGVQPSGGGRINGVYPTGTADNESKGVEFELIGQVTKGLNISINASKQNASQTALGQDLVTFIEATHAKYESPAGDLRLWWGGDATLREYFNNNIWSAYLFQLETNGRMVAEMSPWRFNSTANYSFDKDSRFRGVNVGLSYRWQDKRILGYRLNADKSNLDINSPIWSETEDYIDMWVGYERKLTPKIGWRVQLNLRNVGDDARLLPLSVQPDGSPAMFKIQEGMTWSLTNTFTF

SEQ ID NO: 15662 - protein, 286 aa, Chromohalobacter salexigens
MHNKRLSLARRLSIAAAFLACSTFMATTAHAQKAGDNVVSAGWFHIETFGTSGPLTTTLLDVPINYPLGLPRSFSAPGSGLSTSNADTLGLTFSHFVTDNIAITAVGGIPPEFKIYGHGYLIPPGPAGALGHQSLGDPSLNPIITRARQWSPAAMVQYHFRAPDVTFRPFVGVGVSYNFFTNIDVNPAFAASVNNNLGAILAAGAGIPGPTSVHADASSSWAPVFNVGGTYNFTEHWGVTGAVTYIPLKSESTMTIKASDGTVLSTSKTTLRPNPLVFFLAATYKF

SEQ ID NO: 15663 - protein, 372 aa, Chromohalobacter salexigens
MNHPNGRALRLAVPLAALLACMTLPAAAQSSVTLYGRIDTAIEYANAGPNHVTRMGSGNLWASQWGLKGVEDLGGGYATIFKLEDGFNAASGALSNSSALFGREAWVGITGPFGGVQFGELYTILHTTLVTYSLPGLGAGLAWGNATNNFVGPAFLRVRNSMRYTSPRYAGFLLRAMAARGTNGAAGQPATLGDTYGAGLNYVRGGLSVDVDYMQQKFSPVAAPTLGATSAAANGNYTLGAISYDFNVVKVAALYLRHRGGPDVATAIDSQSAYPHSDIMELSATVPIGRASLLLSVGHYRKVADSDGNADSYGIRFDYPLSKRTVLYTGAAMVRNGAHARFVVNGAAGGGVAVAKPGATASSLVAGILTSF

SEQ ID NO: 15664 - protein, 393 aa, Chromohalobacter salexigens
MKKTLLATALLGLFASHQALATDETQELRKVIEQQQQVLQGLEKRLEETEKRVEKTADAVEETGSSKSATTIGGYGELHYNNISDNIKGKDKKEFDFHRFVLFVGHEFTEKTRFFSELEVEHALAGEGKKGEVEIEQAYIEHDFNQSFTGKAGLFLMPVGIINETHEPPAFYGVERNPVEADIIPATWWEAGLALNIKAAPGLAFDTAVTSGLAVATTGDKAFNIRSGRQKVSNAKGEDLAYTARVKYTAVPGLELAASAQYQSDLTQGAADVDTASATLLTAHAIYSIQNFTIKALYAQWGIDGKEAEALGQDKQKGYYIEPSYRFNESFGVFARYNAWDNKAGNDVDTEITQTNIGVNYWLHENVVFKADYEKAGGAKDADGFNLGVGYQF

SEQ ID NO: 15665 - protein, 349 aa, Chromohalobacter salexigens
MATGTQPDAGQILNSLINSILLIDDNLAIHYANPAAQQLLAQSSRKLFGTPLPELLSYFSLNIELMQESLEAGQGFTDNEVTLVIDGRSHILSVTAQRMPDGMILLEMAPMDNQRRLSQEQLQHAQQVAARDLVRGLAHEIKNPLGGLRGAAQLLSKALPDPSLLEYTKVIIEQADRLRNLVDRLLGPQLPGTRVTESIHKVAERVVTLVSMELPDNVRLIRDYDPSLPELAHDPDQIEQVLLNIVRNALQALGPEGGEIILRTRTAFQLTLHGERYRLAARIDVEDNGPGIPPHLQDTLFYPMVSGREGGTGLGLSIARNLIDQHSGKIEFTSWPGHTEFSVYLPIRK

SEQ ID NO: 15666 - protein, 862 aa, Chromohalobacter salexigens
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIEQEGNIRITWIEEGKPVSCFAHYQQNTTSEKIAQSIILNGLRCQIQ

SEQ ID NO: 15667 - protein, 1049 aa, Chromohalobacter salexigens
MLHKGRLSTKLKPHYVVEGSLMMPGKTASKVDGYLFQQGVVCALRTLAGAWFVMAVSVSPAQAACAPDGQGGITNSGGTCSVAPPVNRITATGSGTTTAPGVTLAVPYGIAVTASGGASVSLGRSDAGGAPAISALNGGGLTGLFATGVSSTITADSLAIGLPSGGGNAAARATAGGHITFLNSANITFVPGGGGGTGLLADGAGSQITGTNVTVAGAGGGGDYVAHSNNGGDIALTGGALSLNSPGGGGVAVLSENGSTFTGDGVAISVSASGGDAAVKSVGNSHVSLSGGSVTLNGTSGETGLLAQGATLTAVGVPVSVTASQSSAGTVQGGGTLAITGGSVTASGSGTVGMLVNGAAGAANTLALNDTTVTSTADSLHVVGANANITAAGSTITDNNGVLLSTTGSPSTTTFDAGASTLGGAITTGAGTTTTVTLHDDTDWTVTGNSTATNLTNSASNIHFTAPADPSQAASYKTLQVQNYTGADGNLHLNTFLGSDDAPSDKLIVSGGTATGTTNLTIHNTTGPGDMTVADGIQVVQTLNGGTTASDAFTLTGRLRAGAFDYLLFHGGIGGSRPNDWFLRSSFVVPESITPTVPLSPATPSSPPGEPGTPSSPPGEPGTPSSPPGQPGTPSSPPGQPGTPSSPPGQPGTPSSPPGQPGTPSSPPGQPGAPSSPPGQPETPSSPGQPGGQTTLDVSRPFPADPPASPLQPGVTYPVIGPELATYGVVQPVARQMGFTMLGTLHERIGDTLTADNAGPDSEGWGHSGWARFFGQQIDNRYQAFASPRATGQLLGVQAGVDVWRGSLMPGHRDVAGVYFAYGNSNLDVDGLVTNATATAYLLGRTGKLNLDAYSGGAYWTHYGPGGWYLDLVLQGTSYQGEATTQSARLPTTGDGFVTSLEAGYPVPLPLGPRFVLEPQIQVLWQRVSFDQENDGLGPVDLGSTTGTTGRLGLRGQWTIDGDHGQVWQPYGRVNLWHDWGGRATTLFGVDQVPLRDAATRLEFAAGVTAKATLRLSLYAQAGYQFAVGAGENSRRQGVQGNLGLRYTW

SEQ ID NO: 15668 - protein, 403 aa, Chromohalobacter salexigens
MTKIGKVSAAAALMLGLAAPAMAGPQITFGPDDKGVLQIDYKGQFQMTVRDSGSGTNNDDTTTNFNFRRNRLALMGAYGDMMSLYVQTEFVDQTSINTLGVNSTPTNPEFTILDAVVRFNLHDAFNVNVGKFKYNFSRENLEACEMPLTLDRSLFIRAPFVTTRDMGLAVWGNVYKDMFQYRLDVMEGRKAASGESAPKSNFRYTMRAHASLLDPENDYGYKGTYLGKKKVLTIGGAMQYEPKVAYSNVAAKTGEKDYYAWTLDGFFEYPVKDMGTITVSGAYANYKLDNAYLGANPDTNTIGLNGEKNGWYLKGGYMLPNLPLQLFGRYEKWKFAQLNNIYDQRVDWAGVGANYYIWGQNLKVTMEYGMTMFDKKGTYSGPDGTNVRTKDFNTFITQLQVIF

SEQ ID NO: 15669 - protein, 171 aa, Chromohalobacter salexigens
MKKTLSLFALTLCSTSAMADSWIYAGGQIGQSDIDSENDTTYGIHVGTGILPFIGIEAGYFNHGKVDLSLSGSRGSADFDSFYLAAKPSIDFGPLHVYAKGGINAFNVDYDGGLRNLDKDDGVSYMYGVGAEYFLLDNVSVGASYQAFGVDIEGDSDTVSSVTGNITFHFL

SEQ ID NO: 15670 - protein, 627 aa, Chromohalobacter salexigens
MSRSRAQPSQLVLPMKTSTFATLLCLPLPLLAAERDDALKLPDVLISANRQVESRTATSAANTVFTRNDIDRLQPTSVTDLLARVPGVQVAPTGGRGSLPGIFIRGTKAAQSLVLVDGVRIANATSGDSGLQFLDVDQIERVEVLRGSRSAIYGSDAIGGVIQIFTRRSNGTGLQPRLRMAAGSNQTWQRSLGLSGGDGATRFNLGASLDETAGIDSTGPSFASDGDHDAYRNKSFNLSLSHTFGERFETGLNLLDSRGRHEYDEPRGLSPQEPYSHFAVSTIGIYLDAQLTDQWNSRVELAHSENRDDSRDKLSHSSFPFNTYRDQATWQNSLTVDERNSVLLGGDWYEDRVHSSTDFKEDSRWNRAIFAQHRFQGDNFSTELGLRHDENEQFGGQTTWSSTLTLPLNEANDVLVSYSEGFRAPTFNDLYFPGYNNPDLQPEHSKSYELQWRSQLNGSSRLEASLYRTDLRDAIEYSMQPENVGSARINGFEMALNQEWNGWTSQIGLALVDPRNRDNGHTLSRRARRTLSLDIDRKFDRFSIGAGWQAVSSSYNDEANTDPISGYGLLGLRTSWAASRELKFDLKLDNLLDRRYSRTHYNYQGASYGYREEGRTALFSVTWTPAL

SEQ ID NO: 15671 - protein, 696 aa, Chromohalobacter salexigens
MQDFIFNKKWLIYSSLLPLFFLNPLAAEDDGFFMGVSYQTSLAIQRVDNSGLNASQDASTYIRQNAIALESAAVPLAYYLEAMGQQTRVLMQMLCPDPSKRCLLYAGGYPKESNGGTGNNPPRGNVNATFDMQSLVSNLDKLTQLIGETLIRNPENLSNAKLVEVKFGNQSTVIALPSGLASVMNALNDDITNALTTLWYNQTLTNKSFSTPDGSPVSFSPKVLQHLLQDGLATASSNQTICSTQNQCTATNEANSIAQNAQNIFQALMQAGILGGLANEKQFGFTYNKAPNGSNSQQGYQSFSGPGYYTKNGNTNGTQAPLKELPAGATVGSGNGQYTYHPSSAVYYLADSIIANGITASMIFSGMQNFANKVAKLTGTSSYSQMQEAINYGQSLLSNTVAYGNFITNWVAPYLDLNNKGLNFLPSYGGKANTNNVTPNLTPQQAQQEQKVIMNQLEQATNAPTPAQIDKILANPYSPTAKTLMAYGLYRSTKVIGGVIDEMQTKVNQVYQMGFARNFLEHNSNSNNMNGFGVKMGYKQFFGKKRMFGLRYYGFYDFGYAQFGAGSSLVKATLSSYGAGTDFLYNVFTRKRGTEAIDIGFFAGIQLAGQTWKTNFLDQVDGNHLKPKDTSFQFLFDLGIRTNFSKIAKQRRSRFSQGIEFGVKIPVLYHTYYQSEGVTAKYRRAFSFYVGYSIGF

SEQ ID NO: 15672 - protein, 288 aa, Chromohalobacter salexigens
MRRAIYGGLSFSILAGAVFAGGYKIPEQSLRSTGTAGAYFSSANAPDASYYNPANMSFMKDGWGLEVGMRYITLPSIKFSGRVFNPFPSPGSFTSNQSFSSEKETFFVPYFHYVSPRVGALRFGLSFTTPAGLSKSWEDSIAQAYAKTFLLEVYEASLAVSYAISDAISVGGGLRGVYSRGEVEYAHPTGAYSVSMSGNTDVKPGLFASVSFKPLNNLTLSTLYRTKVDLKIDGNANGHIGSSFFNTSGKVEIPLPAEWRLGASYSLGATTLEFTYERTFWSEKDIRL

SEQ ID NO: 15673 - protein, 363 aa, Chromohalobacter salexigens
METTMDKRLSALCGLGLASAGACAQTSVTLYGVADAYVEYATNQADAKGEPAALARMGSGGKSGSRWGIKGTEVLGGGWRAAFRLESGVNLNNGAGTGAGGFDRSAWVGLEHPRWGALRFGRQYTTMFDIMEHYSPTGAYSTLYEPDGAIVGISFRENNVVKYLATAGPLTFEAHYAFSNEPGAFQASAAHGAGFEYTGGALSFAFAYDDVHTPQAGGFAHLRRYAAAAMLTVEATQLIAGAAHGQGNVATPSVVTRYTFWWIGVRQAITPVVQLIGALYAERVRAQNPASPPAARHASGTPQQATLQLNYFVSKTTTLYAATGYARHAALDFDNYNYGFLHYSLAGARAGSAGVAVGVRKLF

SEQ ID NO: 15674 - protein, 298 aa, Chromohalobacter salexigens
MTHRTASMAAPTASALALFGIQLLLGAEAGAADLNARDFFGAPAGTTLGVLYLPATRAHEFHGPADRNGKAELKTNAVAYRQVFFSDICGTLCTPQFIIPFVDIDARLPGSVGHTGETGFGDPQVGGTLFFVNDLERRRYSGLLTLITLPLGEYHAKNPDVSPGANRWGATFVYNYTQGIGRDWVLEANLEAQFYAKNDDYFGSDLEQKPLYRLQAFASYDFSQSTYGALKLVHADGGELKLQGHTLDDTHQRYTQLGFELGHWLDRRNSLMFGLSRNVATDNAFHGSQALLRLVHVF

SEQ ID NO: 15675 - protein, 199 aa, Escherichia coli
MRKLCAVILSAVVWLVAAGTPASAAEHQSTLSAGYLQTHTDMPGSDNLNGINVKYRYEFTDALGLITSFSYANAEDEQKTHYSDTRWHEDSVRNRWFSVMAGPSVRVNEWFSAYAMAGVAYSRVSTFSGDYLRVTDNKGKTHDVLTGSDDDRHSNTSLAWGAGVQFNPTESVTIDIAYEGSGSGDWRTDAFIVGIGYRF

SEQ ID NO: 15676 - protein, 251 aa, Escherichia coli
MEIIEMNKVFVVSVVAAACVFAANAGAKEGKSGFYLTGKAGASVVSLSDQRFLSGDEEETSKYKGGDDHDTVFSGGIAAGYDFYPQFSIPVRTELEFYARGKADSKYNVDKDSWSGGYWRDDLKNEVSVNTLMLNAYYDFRNDSAFTPWVSAGIGYARIHQKTTGISTWDYEYGSSGRESLSRSGSADNFAWSLGAGVRYDVTPDIALDLSYRYLDAGDSSVSYKDEWGDKYKSEVDVKSHDIMLGMTYNF

SEQ ID NO: 15677 - protein, 1041 aa, Escherichia coli
MLMCCSLLVWAQNTVTGTVLDESNLEVIGANVKEKGTANGAITDMNGVFHLKVSNLQKAVLQISFMGYEPQEVPLNGRKQLKIILKETANELQEVTVVAYGTQKKETLTGAISAVSNDALVRSPNASVANTLAGQITGLSSVQTSGQPGQEDPKVFIRGVGSLTESASSPLILVDGVERSFYQMDPNEIESVTVLKDASATAVFGVRGANGVILVTTRRGKEGKAKISVNSSVGIQMPTRMLEMADSYTYATLRNEIITNDKPNATENDLVFDNYAVERFRLNDDPIMYPSIDWRRYLLNKTSVQTQHNLNISGGTKDIRYFISLGFLYQNGLLKQFEGVGYDNNYKYKRYNYRANLDFDATKTTTLKIGIGGIVGNRNEPMINDATNSIWTLINQTTPFSSPGVIDGKLIVTPEERFDNKINLGNSALPKCYGTGYSTAINNTMNLDLLLNQKLDFITKGLSAEIKGAYNTSYGFTKKRKGQVEQFMPFYQSSLEDPSLGYDSPDFNKNIVYKIKGENKSLQYDETSSRARDWYLEASLRYNRKFGSHNVGGLFLYNQSKKYYPAQWVGVPSAYIGFVGRLTYDYKSRYMAEVNFGYNGSENFAPGKRFGAFPAGSIGYILSEEAFMKQQKVVDYLKFRASVGLVGNDNLGNNRFLFLPDSYDVNLSGVDAWNNNKYGFNFGYNSKALIQGALEKRLGNPNVTWETALKQNYGLDVHFLKSRLKISLDYFLEERKDILINRKTIPLLTGLTSSILPAVNMGKVKNHGYEVEVKWNDRIGQVQYNIQANVSYSKNKIIFQDEVEPNEPYMWRTGNPVGALFGYVADGFYTEEDFGENGKLVAGLPDPGVSVKPGDVKYRDLNGDEEITSDDQTIIGNPTRPAYTFGLNYGINYKGFFLTMNWTGAAQRSLLLDGAFREPFGNGKIRGLMQFHADTRWTPETASTATTPRFTETNAVYNMRSSSLWVRDGSYLKLKNVTIGYNFTDKKMLKKLGIQQLGIKLTGYNLLTFDKFDIMDPECNPNNADSYPIIKIYNLGINLTF

SEQ ID NO: 15678 - protein, 1254 aa, Escherichia coli
MNMRIIFLRKEYLSLLPSMIASLFSGNGAAAVIDSCQGYDIKASCQASRQSLSGNMQDWSIADGQWLIFSGMANNASGGAVFLQHSAEFTISPQNETGMTLFADNSVSGEYNNGGAIFAKENSTINLANVIFDSNVAGGYGGAIYSAGTNDTGAADLRVTNAVFHNNIANDGKGGAIYTINNDVYLSDDAFNNNQAYTSTSYSDGDGGAIDVTDNSTDNTHLSGKTIINNTSFTNNYAEGYGGAIYTSSTTSPYLIDISVDDNYDQNNGVMIDENNSASGYDHSATAAAGGFMYIGHSVAEFNIAADKTLVIGNTSNDGAIDSLAGTGVIVKEGAGELVLNADNNAFTGEMSIQNGEVTLGRSDELMNVGDTHCQSDPQDCFGLMVGSTVHSEYQAELNVGNTQQTFVHSLTGFANGILNIDAGGNVTVNQGGFSGSIQGEGQLTVAQDGSYLLTGAQSMALTGDIVVEDNAVLSLAGNQADLRAMQSDPQSIVLNGGVLDLSDFTTWDGDSSYNDGLQISGSGGTVIGSNDVVDISSGDDLHIGGSDASQNGVYVVINAGDQRVTLANNNGYLGNTQIASGTLEVSDNSQLGDTSYNRSVIFTDPQQHSEMDVTTDVDTRSATTGQGRNIEMRADGEIHVEDGVDTQWGGLMADSTGQQLDSVSTLTKSGGGTLELTASGTATSAVRVEDGTLKGEAENIIPYVSSLWVGEDGVFETGQNQDIRSIDATSGGDIDITDGTVLRLTQQDTNQALDASLFSGDGTLVNATDGVTLAGELNTNLETDSLTYLSDVTVNGNLTNTSGAISLQNSVAGDTLTVNGDYTGGGTLFLDSELNGDDSASDQLVLNGNTSGNTTVVVNPITGIGEPTSTGIKVVDFAADPAQFQNNAQFSLAGSGYVNMGAYDYTLVEDNNDWYLRSQEVNPTPPPDPDPTPDPDPTPDPDPTPDPEPTPAYQPVLNAKVGGYFNNLRAANQAFVMERRDHAGGDGQTLNLRVIGGRYHYTAVGQLAQHEDTSTVQLSGNLFSGHWGDDGEWMLGIVGGYSDNQCDSRSNMTGTRADNQNHGYAVGLTSSWYQHGNQKQGAWLDSWLQYVWFNNDVSEQDDGVDHYHSSGIIASLEAGYQWLPGHGVVIEPQTQVIYQGVHQDDFTAANHARVSQSQGDDIQTRLGLHSEWRTAVGVTPTLDLNYYHDPHATEIEEDGSTISDDAVKQRGEIKVGITGNISQRVSLRGSVAWQKGSDDFAQTAGFLSMTVKW

SEQ ID NO: 15679 - protein, 673 aa, Escherichia coli
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETAEVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 15680 - protein, 744 aa, Escherichia coli
MSAPTCLSLPVKSTLTLAIMAALTVPAVATTADIERRALDGDKMEVIVVNADFSGINLDKMPSSVTVIDAQQLEDEGAQHFEDVLNSIANFNWSGGSSRPKYFQIRGVGEQEDYKGAPNSSVGFIMDDIDLSGLGSIASMYDMQQVEVLRGPQGTQYGANALAGLIYLKSNDPSQESEQGMEVSVGDDNLTTFAGFSSGPVSDSGKLLYRISVEKHNQDGFKDNLYLGRADTNERDEFNTRAKLRWYATDTLQLDLTLLHANFDNGYDAWTLDNNGRQTLTDLPGTDNQQTTGAGFKAIYSGAEQFELTSLTSFASTDHQHAYDGDWANDSYWSSKQCAVWDEDWTMSLGSLPCVYNATWDKKAERDTLTQEFRLASKESGKIFFDSTSWLIGVYGRQLKEDNSLIDYARYSNGQVNPSVKERTKYLDSQYDASNFAIFGQLDSELEHGYLLSAGLRIERRNSDYSDTNGDDFNPSETMWGGHLSLSKSINSQHTAYTRLAKGYKSGGFNMSLTEDFADKRSYDAETLNNLEIGLKSSWLDGDLVTNTALFYMTRDDQQVSTSLQNPNDKSDFIMFTDNAGKSNNYGMEFDFDWYATNKVKFYGSLGWLNAKYDEYQYAVSETEKANLNGRDLAHSPKLTYSAGMTYLADTGWFVNLNASGKSEFYYSDSNESTSEPYVIMNARVGYETQTWSAYLWGRNLFDEEYGVRGFYFGNEPDSDWADKQYLRFGDPRQLGLTLSVKFM

SEQ ID NO: 15681 - protein, 2458 aa, Escherichia coli
MQRKTLLSACIALALSGQGWAADITEIETTTGEKKNTNVTCPADPGKLSPEELKRLPSECSSVVEQNLMPWLVTGAATALITTLAIVELNDDDDHHRNNSPLPPTPPDDDSDDTPVPPTPGGDEIIPDDGPDDTPAPPKPIAFNNDVTLDKTAKTLTIRDSVFSYTENADGTISLQDSNGRKATINLWQIDETNNTVALEGMSADGATKWQYNHNGELVITGDNTTVNNTGKTIVDGKGATGTEIAGNNAVVNQDGELDVSGGGHGIDITGDSATVDNKGGMTVTDPDSIGIQIDGDKAVVNNDGDNAISNGGTGTQVNGDEATVNNNGSTTVDGKDSTGTEINGDKAIVNNDGDSTILDGGTETRITGDDATANNSGNTTVDGQGSTGTEIAGNNAVVNQDGELDVSGGGHGIDITGDSATVDNKGGMTVIDPDSIGIQIDGDKAVVNNDGDNAISNGGTGTQINGDEATVNNNGSTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDNAISNGGTGTQVNGDEATVNNNGNTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVADADSIGIQIDGDKAVVNNDGDNAISNGGTGTQVNGDEAIVNNNGNTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVADADSIGIQIDGDKAVVNNDGDSTILDGGTGTRITGDDATANNSGNTTVDGQGSTGTEIAGNNAVVNQDGKLDVSGGGHGIDITGDSATVDNKGGMTVADADSIGIQIDGDKAVVNNDGDNAISNGGTGTQVNGDEATVNNNGNTTVDGKDSTGTEIAGNNATVTQEGELTVSSGGRGIDITGNNAKVDTKGKMTITGTDSVGVSINGDSATLTNTGDIDVSNSATGFSLVTNEGIISLAGSMKVGDFSTGMALSGDNNSVTLAAKDINVTGQKATGVNISGDSNTVDITGNILVDKDQTADNAVDYFYDPSVGVNISGNSNTVSLDGKLTVIADSELTSRKYMEFDGSQENISGLTVSGDGNTVNLNGGIQFVGEKNALADGSTIADKRSYFGKTPLVSVDGQSKVYLNGDSTISGSLPLGYANILQLSNKAALEIGSDATFSMQDISVYEHYFTQTPQIIKVDTGSQVVNNGDVDIWNISFAGIWGENSTGINNGNITLSQYDYSSPETSFSEPDHMAFLSSSGGSAVNNGTITAKVMEQHSVLNMGSAAGVADPRVFNNSVSSMMGMEAYGKGTVLNSESGVIDMHGRGNIGMLAVDDSAADNAGKITLDTLWVDQNDTTTLRTDLPSSTAIDYGVGMATGTNSGGGARSNGVATNQQGGVITVYNAGAAMAAYGASNMVINQGIINLEKNGNYDGGLGANMLVGMAVYNRGTAINDKTGVININVDTGQAFYNDGTGTILNYGEINLLGSPMDSADSHMGAIPENLDLLTALTGSGETDMRTASSGGFVTTKALANYGNETLNSNVAAKAWLYNQDKANLTINGELSIGQGLENSGLLDSDTISAAANVYNRASGSIITDQLSLTGSNSFFNEGNFSGSVAGSSYKQNVVNTGTMAVMADGKSLISGSFLLYNEAGATLSNSSSAVSGGENAIVNVTRTGDSLAQVNRGTITAINGYSAIKTASTGSNSNGKWIWNTDTGVISGVNPNAPLIDLGRGYNFANAGTINVQGDGAVAISGGTTSYTVQLVNSGTINVGAAQGKADGTNGTGLIGIKGNGSDTTINNAQSGVINVYADNSWAFGGKTKAIINNGEINLLCDTGCDIYAPGTTGTLNDHNSTTDIIVPAATSTPTQGSVPTVPADSSAQQKLTNYTIGTNSDGTSGMLKANNLVISDNVKVNTGFSAGTADTTVVINDVFKGENISGAENISSSTVMWNAQGSTDASGNVDVTMTKNAYTDVVTDSSVNNVAQVLDSGYTNNDLYTSLNVGTTAELNSALKQISGSQATTVFNEARVLSNRFSMLSDAAPEVANGLAFNVVAKGDPRAELGNDTQYDMMALRKSLTLTEHQNLSLEYGIARLEGNGSDTAGDNGVTGGYSQFFGLKHQMAFDNGMSWNNALRYDVHNLDSSRSIAYGDVNKTADANVKQQYLEFRSEGAKTFELREGLNVTPYAGVKLRHTLENGYQERNAGDFNLSMNSGSETAVDSIVGLKLDYAGKEGWSANATLEGGPNLSYVKSQRTASISGAGSQRFNIDDGQSGGGFNSLATMGVKYSSQESALQLDAFHWKEDGISDKGVMLNFKKTF

SEQ ID NO: 15682 - protein, 326 aa, Escherichia coli
MKKLLLCLGLSSVLFGADNNVKFEITPTLNHNYFEGNLDMDNRYAPGIRLGYHFDDFWLDQLELGLEHYSDVKYTNSTLTTDITRTYLSAIKGIDLGEKFYFYGLAGGGYEDFSKGAFDNKSGGFGHYGAGLKFRLSDSLALRLETRDQISFHDADHSWVSTLGISFGFGAKREKVVAEQVKEVAIEPRVAVPTQSQCPAEPREGAMLDENGCEKTISFEGHFGFDKVDINPAFEEKIKEIAQLLDENARYDTILEGHTDNIGSRAYNQKLSERRAESVAKELEKFGVDKDRIQTVGYGQDKPRSRNETKEGRADNRRVDAKFILR

SEQ ID NO: 15683 - protein, 663 aa, Escherichia coli
MLNGIYSMRLKKRYLCTVLSLAFTQQSVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQNNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 15684 - protein, 1039 aa, Escherichia coli
MKRHLNTCYRLVWNHMTGAFVVASELARARGKRGGVAVALSLAAVTSLPVLAADIVVHPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRAEGTANTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRIVAGSRSHQTGVNGENNSVRLSIQGGHLGHDNNGGIARGATPESSGSYGFVRLEGDLMRTEVAGMSVTAGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSVSELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 15685 - protein, 656 aa, Escherichia coli
MYMNVIRTVICTLIILPVGLQAATSHSSMVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGEHAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPVGHRGVYAGWRAELSASATHVKKGDPHQAGYTIHSFSLSYKPVSVKGFEASVTLDNAFNKLAMNGKGVPLSGRTVSLYTRYQW

SEQ ID NO: 15686 - protein, 811 aa, Escherichia coli
MSRSLDTLLRPSLLAVAIALCTPLTSPLSMAAQQASVVAYDLPAGPMATTLNQISSQGGLALSLDPALVAGKTSSAVKGNFDAATALREALRGSGLQLVQSSAGTYTLMVMEQNALNLSDVNINANSTPLEGSEAAGYRSENVSSVGALGGMRLQDAPYSISVTPQALLKNIQATSLDDVIKHNPFTQMYSPTSAGYASAVNIRGFSSAGSLNIANNGLRFTNGADGSNYMEEMEQLEVITGLTGFLYGPASPGGLVNYVLKRPTYQRYNSVTLGNAGGENYYLHGDFGGPIDSEGKFAYRLNVLTQDGETAVDLNKRRREMISLALDWNVSDDLLVQFDASHKKTEIRGLTSYWYFGDQSLRPGAASLDNDKLYSQKWSFSDYESDKAGVRAKWRLNDTFTLRAAFAAQQYTSENTYTGPTVYSAGLYSQPLYAFAPIETEEKTGSLFLDAAFDTGFIGHKVTVGYQGNTSRQKQYEDHIPYTPDQPGPQYTSPVGTIPLDQTPQVGKPSYSIGHGDQRLANSSESNNVLIGDVITFNEQWSAILGVTNTQIKTYANEFVYAKAFGSAETETTYNESKTSPNISLVYKPLPWLTTYATYIEGLQSGGVAPGGTANAGQAFAPEISEQYEIGAKATLGETLLTLALFNIEKPNGYTTGANIYVVDGRQENNGLEFSVTGKVIPELTVVGGFTLLDPKIKKTGVAADEGNVPTNVAKQLAKVYAEYDINPVPGLAMTGGAFYTGKQYTDQSNENDLPSFTTFDAGARYRLRLAENDLTLRVNVSNLTNKQYWLNSSYLGDPRTVAFSAQLEF

SEQ ID NO: 15687 - protein, 746 aa, Escherichia coli
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAAGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 15688 - protein, 887 aa, Escherichia coli
MRLFHRSPSGFLCLPGPACIAQRRTLSLALGMAVAGWMQAPAQAAEAPADASPQTLDAVQVRTSFQSQNTRAIATKQAAPTVVDSVAADSIGQLADFNVGDALRRVTGVSTVEYQGEPRYVTVRGLNGNYNSMLIDGFAFASNDIGSRQAMMDVLPANFVDRIDVVKSFLPENDGGAIGGVTNLVTATGFGRPDGLLTFSAKGGANLMGSRYGGRSPVGEGDLKWGKRFGRDGQFAFLGAASQWRREISVPQQENGGGLNWYAADGTRDPVPYGGTGAAVPGERRWYNYANTRERRGLTARVDWQPEGPLSGHVSGYSFRQREASDRNTQNAQVQNSARLTRTGAQSGTLDNLNQYVELGQLRWKRALTGINGELLAELPAQWRAALRASTSRATVDNPQTWDRFQQNRLGYGFDWSGTLPAFTPLDPALADDPARYPNAYHQQERTGYAERVGDLQLELRRNTDEDSRGLGLAVGARQVRTHMRTTVQRTTWNGLPDTLADVLGRPTCALGCNREMMTIEPALADARWDALAGQARGVVDTTAQNSGSYGVDEQVRAGFAQAQWRGERWLLAGGIRLEQTRFASAGQQLSGTTWTPVSAVRTYRNWLPSLSGQLQTSANGTLRVGVSRSIGRPRLDQMALNGGVLTLGSTPPTLNQGNPDLQPRRSQNLDLGHDWSFDDGGSLLSIALFHKTIDDEIFRYGQMDSIDGEQVLVTQPRNVDRPVRLRGAELGAIKELGPWLPVLAGLSVTANVTFLDVDYPVVLGDGTRTTLDVLPQQPKQLWNLTLNYARGPLRATLAWSRTGELWDDRFPNYSSLQEFYRNRYQQPLDRIDLKLGWDVSPAVSLSLDVLNLAGQGYQYRIGRDQEYVQSAWKMAPTVMVGVNVKL

SEQ ID NO: 15689 - protein, 179 aa, Escherichia coli
MKLVQKTLLAAALLSSTTLYANALEGHRIGLGFNSTSIDDVAFDSKHSTSGLTLAYGYDINDIFGINVSLNKGSGSESLLDIDTSTFKFDTDIGYTFHMENASIKPYGVLGFAKFKEEFSVLGQDVGKWDDSTIFIGVGTRATFNQHFYTDLRLDFMNLKDSGDNIFADQFSFTVGYKF

SEQ ID NO: 15690 - protein, 682 aa, Rickettsia bellii
MSLGYKLKSTLLKYSFVVAISINLLAINSGILLLTLNNKAEAAPPPPPPPPPPPPPPPPPPPPPPTPPPPPLPKTPPVDPKSAAKDINAELGPTFNPYDTLKKNRKNIKNKKDNSDLEAFLNLNGIAQMSKLFSIVLTQHTDNDELRARFFKDIIRNNKLSPTEKFNLANQIAANNGIYEKDDKGNIIIDNTNLNNNIIGSTSYISNFNPNYKYIISYSTPTEILEKDLTSEIIDITKGFEKDSKGNSYRKFDETKLKQIEQERVYGLIKSKVESLIELAYGANIKYVDYYNSNINDNSYEKYFTEYEKEVITKALGYKRAYEEKTGLYKSEVDKLDRSILSEEEYIKKCEEILEKIGESSWDTYQVSKPGSSSKISYEEYEKLVTNEAKKRAVIARFLMEDNNKINGKRLKIVKEDGSEEYIDNTEFNLIRAENNWDLTPANIPLSKVMKDTNNLSENEKMKKLLARIEFLENNTNNLDIINELEDAKRQLDELKSKKITGLFALNNNGENASISFDQDLIDILKILKEVPDFVSIIRAHPDLFPTVFNDPDTLAFLEKCSPEDYENIIIELSLLDSKSQDLESLIVKKQISEEVTLHNQVASITNKPIHMGIHGRLLLPTAAITGGDEEDAINRGVWISGLYGVSNQKAWRSIPKYQGRTSGVTIGMDTELSNSSDVIGI

SEQ ID NO: 15691 - protein, 790 aa, Rickettsia bellii
MFNKKLLAVLISAQFSPLVWANNNDVAVLDEVSVVSSTPSISQGSEVTLLKVSDKIIAGKEFKKRSATLGNALAAELGVHSNPFGGGASKPIIRGQEGARIRILQNGSDVIDMSNLSPDHAVVADSLLAKQVEILRGSSTLLYASSSPAGIVNVVDKRIPTEIPEKGYEVELNSRFDTAAKEKVGALGATFGIGKHIAVRAEGLTRHSDNYRVPGINLGERLNYVPDTYNKSKVGTLGLSFVGEQGYIGASYSKRRDNYGLPGHNHKFDFCIGHIYGNKQGKYAYTYLYPHLIGEENIGSNPHFHCGTDHAEDGTHSHDNPFGHDHDHTHPGPWVDLESKRFDVKAELRQPFKGIDKIKVSYADADYYHDEKDAGVLATRYHKQLKKDQDYGKPVNIFKNRGKNARLEIYHAPLGGLTGVWGVQYQTQKSSMHAPKDREVKFPLVENTNKQMSLFGIEQYMWDNFALEFAGRVEKQKIEIEYDRNEIKRLQDHYRISGGKQVEPDLSPYNQNAYAYSSTLNWFFHPDYQLSFTASHNERFPTPMELYYHGQHIATNSFEYGNKDLKKEQSNNVELGLGYQTERVGYKVNVYYNHFKNYIYNENLFRENQLFMRRYNQAKARFYGIEAEASYRFNDKYQATIFGDMVRGWLTNLPPLTVNSDYSVFKDYLPKDAKPGEDYLIYRADQNTPRTPPVRLGFRFNAEFTPNWSGDLELIRTFTQRRTSQLEYITEGNTMLNIGVAYSNKWKDLDYKISLNGTNLLNQPVYIHTSYHQFVPQTGRNFILVVNVKF

SEQ ID NO: 15692 - protein, 1083 aa, Rickettsia bellii
MDYVQGASARARSTYNSRLRYGVSALALGAVLIGAPALAQTKPTDDAQTVDEVIVTSIRQSLKSSQQLKQSSEIIGDSITAEDIGALPDRSVTEALQRIPGVAINRFAAGVDPDHFSAEGSGVVVRGLNFVRSELNGRDTFSANNGRALSFADVPSELMGGVDVFKSPSADMIEGGISGTVNLRTRLPFDSKKRLLSLSAEESYGDFVKKWAPTYSALYSDQWDTEAGTFGLLLSAVDSKLWTRSDGTQVSNFGCRTNFTSAQTANPQAVTCPQGGKGVWFPRGAAFRSTETERERIGYAAAGQWRSNDDTMLATFQYLRSESQQSWTEHAMEIATDNVLAAGDSRPIDGTTFGVDSNGIFTNGIITGPQGWRDDQNSADPRTPSFGLQSNNISRSVEQKYVTSDYGFNFKWTPTDRIGVAFDYQHVDSTVDNLDVGIWGSSFQNLDLKLNGSDMPVFSFIPPASGASIPQCSPPSGSCSTYLRAPYDHFQNPHNSFWRSAMDHIEQSEGKEDAAKIDVDYRFADDSSWLDSARVGVRWAERDQTTRFSTYNWGVLSEIWGGGGPVWFDDPVNGNPATAGGETSVARTELYPFTDFMRGQVPAPTGLDARPFYLGNTATDYAGLQAFALKIGDEWRPRVAAGSTCPQNWVPLAQRCNTVAGTPFLPGEINPINEKTKSAYAMLRFKHEFDGDVKVTGNIGLRYTSTTRDATGFLTFPNTVPATDASCDLSFTNWQAQPDPKDPFVPSAFCALSPTARQSVRNFNNGATVAQSAHAKFTYWLPSVNLKVALSDGWQLRFAASKTITPPEVGLTRNYYDVKLDTNSTGIINGVVGGNTTVGNPYLKPTQSINIDGSAEWYFAPVGSVTLALFWKELTDVATNTTARIPFTNNGSTFAVAVTTPGNSDVKAHVKGFEIAYQQFYDFLPKPFDGFGINANYAYIDSKGVPQSTLSATDPDVGAGRVSTVDTGLLPLQGLSKHNVNFAAIYEKGPISARLAYNWRSDFLLTVRDVIVPFAPIMNEATGQLDGSLFYTINPKVKIGVQGVNLTNEVIKTTQVLNNDLLKAGRSWFMSDRRYTFVLRASF

SEQ ID NO: 15693 - protein, 1066 aa, Rickettsia bellii
MSFTKKLSLGTAAIALLAAAPAAVYAQETTGGVRGTVSADGAPVSGASVVVTHVPSGSVSRVTTSANGGFNARDLRVGGPYTVRVDAAGYGSQMVEDVYLALGAPANLPIVLNSGAADVIVVTASASMFTDIETGPAARFTADDINGLPSISRDPRDVARLSTFANLDPENSDAISLAGSNNRYNSFTVDGVAQNDLFGLNSSGFPSENRGPVSIDALAALSVEIAPFDVQYGGFTGGTINAVTRSGDNDFHGSLYYFRTDDSLIGDSSRGRAINFSEFAEETRGGWLSGPIIEDRLFFFVSYEEFDRAQPLFTGPLGSGALNERSGITQADIDEIINIGNTVYGLNLTNFPDASLGSLDEKLLISLDWNINEDHRAKLTYNTNDGGSVQERSDRADLGTPSTWYNRSEATETLSLQVFSDWSDNFSTELTISQSTQDTGQDSVDGSDFAQMDIELASGSVVSVGPDFFRHANALANETFQFKLRGEYVYDNHVISGGYERRTQDIFNLFVPGSEGSYDFGSVNDFRNQVADSLFYQNAVTNDENDGAAEFSFTLDTLYLQDEIDVSDRLTVAFGVRYDRYSTDDAPTANANFLGRYGYSNAGTIDGLDVIMPRASFNYEAPFTYDASFADFSVTGVTLRGGIGRFSGGNPLVWISNTYSNNGVSIDSVFVGGPIANVDAFNVPAGAQGALTAGDGSVNAIAPGFDIPSTLRASLGADVMFDMFDSNDWMFTVEYLHDEQANAPFWYDANCPAAGTSPVDGRPIYNCNTDRQDIVLTSVDMGQSDIWSFELEKDFDNAISFWFGYTNQNVEDAHSGTSSTATSNYSDYASFDRQNARVSTSNYEIQHDFKLRLGWSHAFYEDYETRVEMFVNHRSGRHFSYTYDYSNGDANQYRNQSPFGIHESAADDEGTLLYVPMTDGTGNVTLTSDPLINYTAGFDITGFNEYLQRTGLINYAGEIAPRNGFDSPWSTRVDMRFQQEIPAFFPAAARGVFYMDIENFGNLLNDNWGRFEQVGYEYFQPVVEIDNIDPVSGAYLYDDFRGDAASETRVSTSSVWQVQFGVRYQF

SEQ ID NO: 15694 - protein, 165 aa, Rickettsia bellii
MMMKTVKHLLCCAIAASALISTGVHAASWKDALSSAASELGNQNSTTQEGGWSLASLTNLLSSGNQALSADNMNNAAGILQYCAKQKLASVTDAENIKNQVLEKLGLNSEEQKEDTNYLDGIQGLLKTKDGQQLNLDNIGTTPLAEKVKTKACDLVLKQGLNFIS

SEQ ID NO: 15695 - protein, 356 aa, Rickettsia bellii
MDGDTFMQRKAFLVSACVLCATPAHASSVTLYGIVDSYVEFDRVGSLSSMRQSGGGASTSRFGLTGVEDLGGGTSTKFVLESGFSPADGSFQGGTLFYRQAYVSLQNARYGDLRLGRQYTPAFYVVYDGDPFGLNERLSPLALLATSTDTITSNTTPPIPRFNQAASYLSPDWNGLRVMATYGFPTPNALSTQAGRNYGAGLQYRIGGLYVGAGFQGDTSAGNLGPVVAPSTTRHYVFATNYAFARVKLYAAFLYGVGTAARLPAFSTASVGASINVGALDRVLVSVVRRDVKGSANDATALGVGYDHPLSKRTSLYARYLYMKNGGDARNTVVAGLQPQAGGTEQVFALGIVHRF

SEQ ID NO: 15696 - protein, 712 aa, Rickettsia bellii
MYNRTFLSASILFALATPVQAQDAGLFDEVVVSATRTNQTMDSVAASVTVISDKDLESKMAKDLNDVFEYTPGVTINSTQRQGVQSINIRGMEGKRVKILVDGASQPGVFDGGPYSFINSSAVSVDPDMLKSVEIVKGAASSLHGSDAIGGVVAFETKDPADFLKNGKVFGGQAKLSYSSEDKSFSEHVAVAKRFDNVEALVAYTRRDGKELQNFSKAPYDDYSVESQDYVKNDLLIKLQSQLSDDHRLEFLGEVIYNQNDSDIASSSYKNFNSEDTTKQSRLGLKHIWLVDTTITDSITSRLTWTDKEENGLTNRFKEASAGVPPWVPPNGDNQQKKDYQYTENKIELETQFDKELEAHYLVYGLSYKISRISNTNREFNSDPNTPDKIYVYTPDAKEMSFGLFLQDEISILNDKLVLTPGVRYDYFSTDPSDTVDESFIKFSDSAFTGRLGATYKVAQEGTLFTQISQGFRAPSFNELYYTYDNPGHGYTNRPNPNLESEKSLSYELGYRHNTIASASEVALYYSDYTDFIEQTSTRVGGLTEYTYVNISEATIKGIEVSNTLDLNRIANLPLGMTTRFVAAYTVGEDGEGNPLNSVNPWNAVGTVNYDAPNNLWGTSIKVNYTAKKSNSDINLDGNNGGTANQVELPSATVIDLTAYFKPTQDVTVRAGIMNLTNEKYYLWNDIRGEKELSRDLTQAERNYNISVKYEF

SEQ ID NO: 15697 - protein, 647 aa, Bordetella pertussis
MHIYGNMNRATPCRGAVRALALALLGAGMWTLSPPSAWALKLPSLLTDDELKLVLPTGMSLEDFKRSLQESAPSALATPPSSSPPVAKPGPGSVAEAPSGSGHKDNPSPPVVGVGPGMAESSGGHNPGVGGGTHENGLPGIGKVGGSAPGPDTSTGSGPDAGMASGAGSTSPGASGGAGKDAMPPSEGERPDSGMSDSGRGGESSAGGLNPDGAGKPPREEGEPGSKSPADGGQDGPPPPRDGGDADPQPPRDDGNGEQQPPKGGGDEGQRPPPAAGNGGNGGNGNAQLPERGDDAGPKPPEGEGGDEGPQPPQGGGEQDAPEVPPVAPAPPAGNGVYDPGTHTLTTPASAAVSLASSSHGVWQAEMNALSKRMGELRLTPVAGGVWGRAFGRRQDVDNRVSREFRQTISGFELGADTALPVADGRWHVGAVAGYTNGRIKFDRGGTGDDDSVHVGAYATYIEDGGFYMDGIVRVSRIRHAFKVDDAKGRRVRGQYRGNGVGASLELGKRFTWPGAWYVEPQLEVAAFHAQGADYTASNGLRIKDDGTNSMLGRLGLHVGRQFDLGDGRVVQPYMKLSWVQEFDGKGTVRTNDIRHKVRLDGGRTELAVGVASQLGKHGSLFGSYEYAKGSRQTMPWTFHVGYRYAW

SEQ ID NO: 15698 - protein, 673 aa, Escherichia coli
MKMTRLYPLALGGLLLPAIANAQTSQQDESTLEVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSLSDGSPDPYMRRCTDSQTLSGKYTTDDWVFNLISAWQQQHYSRTFPSGSLIVNMPQRWNQDVQELRAATLGDARTVDMVFGLYRQNTREKLNSAYNMPTMPYLSSTGYTTAETLAAYSDLTWHLTDRFDIGGGVRFSHDKSSTQYHGSMLGNPFGDQGKSNDDQVLGQLSAGYMLTDDWRVYTRIAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERINISVHVDNLFDRRYRTYGYMNGSSAVAQVNMGRTVGINTRIDFF

SEQ ID NO: 15699 - protein, 203 aa, Candidatus Pelagibacter ubique HTCC1002
MEFGVRFSNYKGRQMIKTTPHKIVILMGILLSPSVFATDINVEFTATVKATTCNITLTGNNVTNDGNNNYTLRIPKMGLDKIANKTTESQADFKLVASGCSSGISWIDTTLTGNASSSSPKLIIPQSGDSSSTTSNIGMGFKKRTTDDATFLKPNSAEKIRWSTDEMQPDKGLEMTVALRETDAGQGVPGNFRALATFNFIYQ

SEQ ID NO: 15700 - protein, 1021 aa, Candidatus Pelagibacter ubique HTCC1002
MKFIILTCLLLLGISWNVLAQQEVTVTGVVTDVKKLPLVGVSVSVSNMPGLGTTTDENGKYTIKMLPFKTLVFSYISFDKQEVLVKDQRVVNVILKESDASVLGEVVVTATGVQKKIAVTGAITTVNVEQLKANPSSSMANALAGVVPGIQAMQTSGKPGSVSEFWIRSISTFGANNAALVLIDGFERDFNEINVEDVETFSVLKDASATAIYGSRGANGVILITTKRGKEGKININAKVEGFYNTSTKLPDFADGYTYASMANEAKTTRNQQPLFSPSELEILRLGLDPDLFPDVDWMDVLLRKGSISQRSVLNMSGGGKTARYYVSGGYQNQQGMYKVDDALDGYNTNTSFRRYTYRLSVDMDITKTTLLRAGVSGSLRKQSDPGVGTDAIWTSLMGYNSIMMPLQYSNGKIPSWTGQDDNLNPWVQGTMTGYNESWSNNIQTTLNLEQNLDFLTPGLRFIGRFGYDTYNNNNIRRFKRPELWNANRYRDGNGELVFTRVAEEQKMIQSSGSDGERRDFFEWDLYYDKKIKEHNFAAVAKYTQASKVFTQNLGVDLKNGIARRNQGVAGRVGYNWNYRYFVDFNFGYTGSENFHKDYRFGFFPAVSAAWNIGEEPMLKDLEWINMFKIRYSYGKTGNDNLGNNIRFPYLYTIDQMADGGYNFGDFNSPNSTWNGIRYSTISSPDVTWEIATKQDLGLDYSLFKDQFSGAIDYFRERRDGIYMVRDFLPGFLGVESKPSANVGEVKVQGIDGNFTFKHKLREVDLTLRGNITYSKNEIVERDEENTIYDYRLQKGHRVNQARGLVALGLFKDYDDIRNSPEQTFGAVMPGDIKYKDVNGDGRIDDTDIVPIGATTRPNLTYGFGISARWKGLDVNVHFQGVGKSSYFIDGTSVYMFQGGDGWGNVLNELANSNRWKLGENEDPNAEYPRLTYGANSNNYRRSSFWLKDGSYMRLKTLDIGFAFPKSWINRMQVSTARLFFIGTNLLTFSKFKLWDPELGNPNGKVYPLSKTLSVGLSVGL

SEQ ID NO: 15701 - protein, 723 aa, Candidatus Pelagibacter ubique HTCC1002
MLNLIKKSKKLIIKGALKLKVFLVLFSLFFSSLALAEPTFIANFNVQDKETSPTGITFNPDGTKMFITGINMRKILQYNLTTAFDVTSAAFEKSVLIQVEQDKPQDVKFNSDGTVIFLLGTGTGVIDGVDAARNGIHRWSLSTPYDIGSITPANTTFTEVGGDNPRGLAFNNDGTKMFILDNTAQRVEEYNLSTPYNPDTKGSVANTLGNARSASHQGLGFNNDGSKIFIVKQDNKIDEYALSTAFDLSSATLTGTVSPTFPVTNKRLSGFAFNSSGTKMYHLDWHTLTDADNVNEYSLSCPFAVVSSSTCGAPQKNKDVRGVVDAQINTAKNFAKDSSQSALKRLSILRANKYYNASAQNIELNFQNELLKKVSNNVLSSAQAKLNPLQKLDQILPNDWEVWSEGSISFGKIGESSLSSAQDIDSLGITVGVDTKMDDDKILGVALRVGSTDVDVGTFGSKVDTNALSLSLYGINSLENSNYLKHVFGVSYLDSNIARKYDGNTDANKGEREGKQVFGSLNFGKEYENSDLIITPTGRIDGSYTALNGYTESGIAALSYNDQDISSLMASLGVLIDQDVDLENSTVRSRINLEYSKEFASSSKVVTSYVSNSESFEYQADNKNRDIYTAGLGLDFKHDQGLIISTDYERQQIKGHGYINKFTLSAGFLYRKETEFALGLDEEMTSSFKISKALGVFDLEFDLENNFSNQENHNANLSILSKF

SEQ ID NO: 15702 - protein, 212 aa, Candidatus Pelagibacter ubique HTCC1002
MKKILISSALAASLFGVAQAQTSGLFVGVNAGVPITTPSYGPAIPNSSMFPTSGIGWAVGLDVGYKQVLSENYGLKYYISYNYNQSKGSKDNSPLPKVNADINQHLITANVDYYFNFTPAFGAYIGIGVGYQQYDPTWKIAGNAMPTEAKGGLAVPVNVGLTYNFNDASQILLGAKIPLLGYDYKITQPVVGDVKAATLRTYIVQIGYNYTF

SEQ ID NO: 15703 - protein, 419 aa, Candidatus Pelagibacter ubique HTCC1002
SDQAEAKGIVEDSSLNLLVRNYYFNRDNKDGGRDQKDWTQGIWGNFSSGYTQGLIGVGVDAFGYLAVKLDGGDGTSGSGNMSRSDTVNADGSRDVNDSQGKAGGAVKVRISKTELKFGEMQPSTAPVFAVGGSRILPQTATGFQLQSSEVKDLDLEAGHFYSASSQDKNASDGGLFATYAGVEANSIDYFGGKYGITENLSASLYGAKLEDIWNQYYANLNYTIPFGGDESLNLDGNIYNTQDNGDAKAGEISNTAYCLAAAISIMQAHTISPAFQRVNGDTPFDYIGVGKNNRGRDSIFLANSNQYSDFYAPGEKSAQVRYDLKMAEYGVPGLSFMTRYVKGWDIDGTKTPVGSPYAGLFGEDGKHNVTIFEAKYVFQSGPAKDLSFRIRQAWHFANADEGRGDTIELRLFVDYALSL

SEQ ID NO: 15704 - protein, 418 aa, Vibrio alginolyticus 12G01
MSTLQPARQLLPGLLAMSCALPVFAANEGGFMEDAKATLNLRNFYINRNFVDPAHPQGKAEEWTQSFILDARSGFTQGTVGFGVDVLGLYSVKLDGGKGTTNTHLLPVHDDGRPADDFGRLGVALKAKLSETELKVGEWMPVLPILRSDDGRSLPQTFRGGQLTSKEIAGLTLYAGQFRGNSPRNDASMEDMSLNGKAAFTSDRFNFGGGEYTFNDKRTMIGLWDAQLKDIYRQQYLNLTHSQPLGDWTLGANLGYFIGKEDGGERAGKLDNRTASALLSARYQGHTFYVGLQKVSGDDAWMRVNGTSGGTLANDSYNSSFDNAKERSWQVRHDFNFATVGVPGLTLMNRYIKGDNVTVGNVDDGKEWARETELAYVVQSGSFKDLSVKWRNSTMRRDFSTNAFDENRLIVSYPLNLL

SEQ ID NO: 15705 - protein, 360 aa, Vibrio alginolyticus 12G01
MKKTLIALAVLAASGAAMAQSTVTLYGIADVVGRYSTTDLGKGAGSLAKSEIVSGGINTSRWGLKGSEELGGGLKANFKLEEGFAMDTGAGQTKDFASAPQAFSRESWVGFSGGFGEVKLGKTWTPFDDVIGTSDGMFNAVGMSPMRLAFASENYRDTISNTIYYATPNFSGFAAAASYSAREGDPKRARVEAFNVTYGSGPVAVQFAYQQEHLELATAGGIAGTTANNGTYAVLGGSYDFGIAKAKANYAKVTNKAWGGGSGENIDGNNTKEWQIGVDVPMGTALTLSASYAKSDDNNATGANRTQKRDGFGVAGKYVLSKRTFLYGGFSLNTASQVVTGSTTGDWKKNIVELGMNHKF

SEQ ID NO: 15706 - protein, 795 aa, Vibrio alginolyticus 12G01
MNKKLKTRYLAFLLISILFHLQTIGQELYTLNGTITDVSSNETLIGVNLIIPEAETGVVTNDYGYYSIKLPKGEYQIQISYIGYQSVQQTILLDENKKLNFQLSEASESLDEVLITSDFEGLNIRKPEMSVNKLSINTIQNLPVVFGEVDVVRSLLLLPGVSNAGEGSSGFNVRGGAVDQNLILLDEATIFNSSHLFGLFSVFNPDAIKDLKLYKGGIPAEYGGRVSSVLDIYQRDGNSKEFKMQGGIGAISSRLLAEGPIVKDKGSFLVGARSSYAHLFLKLTDNDNSAYFYDLNTKLSYKLDDSNKLLLSGYFGRDVFNISQNFENTYGNTVVNLRWNHIFSDNIFSNLSAIYSDYYYGLNLNFVGFNWDSGIKNFNLKYDFNHYINEKFQLKYGIQNTYYEFNPGEIEPIDENSGINYFKLSNKYAFENAVYISAEHQLSDKFSAEYGLRLSNFFRLGQDEVNSYENNDPVAYNPERGIYSEAEIIETNTVSKSEVLKAYNNFEPRIAVAYALNDDQSIKASYNRMSQYLHLISNTSSPTPLDVWAPSGQYIKPQILDQYAIGYFRNFKEKIYSLEVESFYKHIDNRIDYIDGANLIANTAIERVVLNGESRAYGIEFLLRKNTGKLTGWLGYTLSRSEQRTPGRTPLESGINNGEWYLTNYDKTHDLSITGSYKLNKKWQFNANFIFQTGLATTYPTAQYEHQGVTVPVYGARNANRLPEYHRLDLSATLTPKSNKNTKLSSSWNFGIYNVYNRQNAYSISFRENSDTNQNEAVRLSLFGIIPSITYNFKF

SEQ ID NO: 15707 - protein, 667 aa, Vibrio alginolyticus 12G01
MKKAALLVFLLAIPKLIHASPAPSDSTAFSSKVFSAGEITVTGKKGDGKEKVNASEMAQHDKKNITQAVGLLPGITRGGVGARNEGMIYVRGFDMRQVPLYLDGIPLYVPYDGYIDPNRFTTFDLSEITVSKGYSSVLFGPNTLGGAINMVSRKPAGKFEGTVKSGVIAGDNRIASKFASLNLGSNQGSWYVQTALSTLDTKFWPLSGSFAPTAYENGDARDNSATKDFKGSVKVGYTPNSGDEYSLTVDTQHAVKGIPVYTGINPSQSVRYWRFSDWDKSSIYLITRKALGEKSYLKTRSYFDNYYNALKSYDDASYTTQKTAKAFSSRYDDKTFGASVESGSELFEGNTLKVALHDKYDMHNEIANTGDIPKNYEDNTLSLSAENSWKASEDITVIVGVRHDNRQTKKAEDLVNNVITSFPLEDNQATNYQLAVVAHLDDHQEVTASVARTTRFPTLKDRYSYKLGNALPNPALNPEMSVNYVVDYSIRPLEKLKIKSSAFVSRLSDVIQQVDNVAFVNNKWVYQSRNSGRATYSGFECSVDWLPVSWLKSVVDYSYINRKNNTNPSLHFTDVPNHKVSGYLQFFLNRGSWAMLEGEYNSQRFSTSDGKYSAGSFGLLNVRANTALSPALSIQAAVENLFDRNYAIAEGYPEPGRQGVLSIAYSL

SEQ ID NO: 15708 - protein, 207 aa, Vibrio alginolyticus 12G01
MRKRSTVLFAALAAASVSAPALAQSKGDWLLGVGAHQVAPKSDNGSLAGGTLDVDVGTDIRPTITAEYFIADNWGIEVLAALPFEHDINIRGLGRVGSTKHLPPVVSLQYHFNSQGKVSPFVGAGINYTRFFSTETSGALAGNDLDLDASWGLAAHAGLDVKISDRGALRVDMRWIDIDSDANLNGNRIGTVNIDPLVYGVAYVHRF

SEQ ID NO: 15709 - protein, 699 aa, Vibrio alginolyticus 12G01
MFTKSHLALVIGAVLATPAVADVQTDEHVVVEGREFGYKADTNSTAMRMEMTQLETPGQVAVIDETVIDEQRASTLGEVLRNDASVSAGGTSRNRERFSLRGFELSSSDGFLRDGRQHWSHYRQPIELLERVEVLKGPSGLLYGKSEPGGLVNMVSKKPTTQTQASLSQDLGSNDHSRTVLDVSGALNDAETLRARAIFAKESYGSWRSYGDGTEPETDRTVAGLVVEYDITDNFMVSAHYDRTKDDGSVDSGAYIVDGKAVRGDKHIWDAQWSKIDNEVENYGIDINAQVTDNVNVKAGYNRQDFKRFDVESYPKFDNYDKDGVIRHKGNDRSDNWVFDTAYIDVTTDFTLFGTENTLLVGANYLDYSYDRFMAFHNEASIAPGETVPKPGYRSSKKSPTTEYDTWGIYAQNMMTINESWQVLAGVRYDEKRDDDLTENQVSPKFGVIFHPATNGSVYVQYSESFMPQGEVSSGRGKTYVNDGEKLDAERGISYEIGTKWELFDQRLFVSGAVFDITLENISLDVESGKDAGGNLLHKKTQGGEQVHKGAELMAQGFVTPELSLTASAMYLDAELTKADKKFEGNRPVDVPEFSASLWSSYKVQDNTNLNLGLIYEGDRYGDAKNTFKKDGYARVDMGVSYKHKYDENLDIIARFNVENLFDTDYFAGGGSTNSEQKGASGVVVGEDRNYMATIQFKY

SEQ ID NO: 15710 - protein, 333 aa, Vibrio alginolyticus 12G01
MKMKTLAVAVAALACGSQAFAAEVYNSDGTSLSIGGHVSVGVGEYFEEEVKVHQVSPRINIGGKKDIGNGVTIDAKGEWSLNYLNGGDNSFSTRLGYIGATHDQYGRLVVGTQWSPYYDVAGVADMPIAFANDFLYENHYNLGSGRAEKMVSYRKGLDFGDGFGLNIGLGWQGEQSIYDQRGQIALSTELAGFGLGYVYSGGDIELVSKSESATSHMFSAKYGQYGAGIYAALVYGMNEYFYDNLEETSQYEAVLAYGLDNGLNLIAHYESVEDDKNDKTQYSNMSVQAEYTVTPAFVTFAAYRFGLGDDVDPAPGDLDLDEDFWTLGARYYF

SEQ ID NO: 15711 - protein, 642 aa, Vibrio alginolyticus 12G01
MESNWLFMPSIDEINQEEIEFYNSHHFKELLNLSSGVWISRGSGQESLISLRSPVLTGSGACGSFQILEDGIPIRPAGFCNVNNLFEVSGNLASEIEVVKGPSSSMFGGNALHGVINIKTLKTEGDNKFILETDKNESLRSTIFLRMFSNKIIALDLDRDKGFRDQSGFDQQKLVFKNFSQSKDWSFNTSINFTNLNQETAGYVDSYLLPRGLENINPEAYRDAKSLRIKTEISKSLNKYDVFFTPYFRFSSMEFIQHYLPGKPIEKNGQKSTGVILKLSELEINNNFFEIGGQIEMAFVNLDQYQPDVLNSSNAFNNAVRPQGYHYDFEVVTSFLAAFISHEFELKDNYNFFSNLRLEHLKYDYDNLMSDGRLKDDGTVCPRGGCFYSRPTDTELSFTDYSYRLGVSKFTNIGKIFFQYSKGHRPPQINELFRLQKSQTLADLDSEIIDSIELALDNKGNNFFNKLVFYYSKKKNYIFKDSDSSMVFGGKSRHKGIEIKGAKTLNKFFSMKYALNLAGHYYDFTNQDIGVISGNEIDTSPNIFGSIFINFKVSNKLNLELEQEFMDEYYTEPSNNYIYKGHNLTNLRSSYVLNDDIRLNLSILNILDKDYAERADYSSFTGERFFPGIPLKWRLGINYKFN

SEQ ID NO: 15712 - protein, 935 aa, Vibrio alginolyticus 12G01
MKKTIAMLGTASVLALAAATAAHAGTIAGRVTDASETIGLEGATVRIVETGQTATVGADGTFRVTGLAAGDYTLRVSYIGADVREVSVNLATVSDTVSPTITLGDDVDYVENILVMGQRGALNSALSRQRANDGNVAVLSSDAIGQFPDENVAEAARRAVGVNVLNDQGEGRFVSIRGLDPNLVSTSINGVRLVSPEAEDRQVGLDVIDADVLSSVVINKSLLPNMDGDSVGGNVEIETMSGLDVDGMYLRARVAGLYSDLEQEFGHRGSINWANNFMDGRLGVAGSLSYQQRVFGSDSFEVDGGWDVDESVAFPNEVEMRNYQVTRERTTAALNFDYRVNNDLSLYARTTWSDFSDQETRNRVEIKFEDAEYDDVNSSGNLAVFTADEMEIDRDVKDRLETQTIFASDFGGEWLNGNTSIDWSLSYVYAEEAEPNRLDTDFSYEFENGELFTVDSTNPLRPELGFGGGITTDRVFDASNYENSGYELTNGLSQDREYAAAINVRHDMDFGTMPGYIQYGVRARTRDKKFALDFDVYDDDSLLLSDVVRSVEYGQGSIGPVADPSQVRDYFFSNLGNLDYVGIDSDIDSFGASYRVEEDVMAGYLMGSVENGPLRLVGGVRVEQTDMAARGYETFLAEEDATVNGVVLTEDTVFVTPTTASDDYTDVLPSILARYELTENVIVRGAYFASIQRPNPGQFAPRILVEQNDNDEVEGEFGNPDLERLEADNFDVSIEWYPNNDAVVYLGYFRKDLDNVIAGVGYENITLNGRFFDEAASFINLPEAEVSGIEFNYQQALDFLPVEGFIAGFNFTATDSEATLADGRVVPLPRQSDSVWNAVLGYDRAGWDLRAVVSSRSEYLDEIRGGADEDRWVLEHTQLDLSAKYSFNDTFQVFGDLKNVTDEPYRAVTRPDGIDRVEQFEEYGWSAVFGVRVTY

SEQ ID NO: 15713 - protein, 961 aa, Vibrio alginolyticus 12G01
MGIKQHNGNTKADRLAELKIRSPSIQLIKFGAIGLNAILFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKIKTDGSTGVYIGGLNGNNANGAARFTATDLTIDVQGYSAMGINVQKNSVVDLGTNSSIKTSGDNAHGLWSFGQVSANALTVDVTGAAANGVEVRGGTTTIGADSHISSAQGGGLVTSGSDATINFSGTAAQRNSIFSGGSYGASAQTATAVINMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFTTLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPDPTPNPTPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAHNGFYSDLVVKASRQKNSFHVLDSQNNGVNANGTANGLSISLEAGQRFNLTPTSYGFYIEPQTQLTYSHQNEMAMKASNGLNIHLNHYESLLGRASMILGYDITAGNSQLNIYVKTGAIREFSGDTEYQLNNSREKYSFKGNGWNNGVGVSAQYNKQHTFYLEADYTQGNLFDQKQVNGGYHFSF

SEQ ID NO: 15714 - protein, 919 aa, Vibrio alginolyticus 12G01
MKNLSFKTRLLASSMALFSMVAAAQAAAQDRTAATSETAEVGEIVVVGTRNDAMRTQMRSDNAVSVMSAEDLEHTAVHNVAEALALLPGVSVQNTGNSFFGGVDGASRGEGMFVGVRGMNSEFTLALINGVNAAQGMPYSRQVQLSLLPPSGLKTIVVNKNSTADMDGDAIGGTINFVTPSAFSMADDYASLSVSGRVESRARDYDEDGLGGGVSGEIARRFGQGDQFGLYVSAFYDKRNFANSMIAGLMAAQNDGGWAYLHSATDSAAGVNPEGMDQEANLALTGLNVGVSTGYTERFGGNFSLDWRADDSLDVYLRGSYAFAETQQNSTLNQLIQNRARVSNAATGLYDLNLTNSSVRMWYTTNPEDADLSTLTFGAVKRHGAWTLSPSIFYSYGGNDRPDHIEASIRNNQSDKYNTGTILPYSGLFAGYDADGYPIPLLTPAQQNLVNNSGSALLARRAGQRTEQFSNQQKVGARFDAQYDFDGGALSYVKTGVKYVESHRRVSSHDWTNDHFANLLGRAGVTWDELGLVEGYFDSAYPGLYGIRAPKVNHDRLVELFNQYFDAEAAAADLCYLNCNTLKGDENVAAAYVTGNWDMGAVEVIPGLRYEHSQIENTYWNNDDKAKRFESNSTEYNEWLPSLFVNYRPTGDAVYRASITRAYMRPALVQLGGSETTERGDNSITVTRGNPDLKTLKSWNFDTSAEWSNAFGGYAMVGGYYKQLSDYMYDNGSTTVNEGPNGGGTEYNGETFDRVTIVSPTNGGDGYVKGVEIQLYQAFDMLPGWLSGLGAGVNYTRQWTEVDIGGGEKHRMQNAPDELANVKLNYAWRNLTLDLNWNYSGETVTAYNRVAGLDYWTRPIRRTDLHAGYAFDNGVMLDLSVSNLFEDYSYWAHVGRNSLALSDVVNSGRTTLLTLKYDF

SEQ ID NO: 15715 - protein, 708 aa, Vibrio alginolyticus 12G01
MNKKGKMISMSFCVSMVLGSQLFAAQNSQNTTVLEEIKVSENNLILNSVTEETGSYTTGATSTATKLDLSLRETPQSVLVFTRQRLEDQNITSYQELLSKTPGVTLNKWDERVYPTARGFTIDYNLYDGMPTYSIADYGANDTDLIIFDRVEIVKGANGLMTGAGNPALGLNYIRKHANSKEFKGTIDLSAGSWDNYTSSADVQTPLNTDGSVRARFVAKHQDKKSYMDNYEKQTDVFYGVVDMDLTDTTYLSFGASYENIQRDGVRWGGLPAFYTDGSRTNFSRSKTVSDDWTYWDNKTTSYFADLKQYIYDDISINASYSNRTMDSKTAIAYYFGTVNKVTNNADGFLYDYVSDAKEEENNLNLYASIPFELAKLDHEIITGFGYNKYDFKKNNFAGTGYISASSLNFSNINIDNPQLSANTPTLELPSKTIQKGYYLAGRFSLMEDLKLISGIRVSSWEYQAKNGNGNREFDDEITPYAGLVYDIDKNYSIYVSYTSIFKPTDRQDKDNNYLDPAEGKSYETGIKGEYFDGRLNTSLSIFRIEQTGFEDTGIPIASNPLKNAFERIDGVVSKGFELGVQGNLTDDFSLDFGLANFEAENPDGSKFNTDSSRTTANLWAKYTISNYRFGAGLNYKSKVYTGSGATKITQDAFITTDLMAGYKINKSLDLQLNINNVFDEKYYEGIGVNSMLYGDPRNFTLGMKYTF

SEQ ID NO: 15716 - protein, 712 aa, Vibrio alginolyticus 12G01
MYKKSILSASILIALSQGAYAEDTSTFNEVVVSATRTNQTMDTVAASVAVVSEKDLEENMAKDLNDVFEYTPGVTVNGTQRQGVQSINIRGMEGKRVKILVDGASQPGVFDGGPYSFINSSAVTVDPDMLKSVEIVKGAASSLHGSDAIGGVVAFETKDPSDFLKDGKDFGGQAKLSYSSEDNSFSEHVALAKQFDNVEALVAYTRRDGSELQNFAKAPYDDYSVTDQDYYKNDLLVKLQSQLNDDHRLEFLGEVIYNQTDSDIASSSYKNFNAEDTTKQNRLGLKHIWFADLAISDTITSQLTWISKEENGVTNRFKEASAGHPPWVPANGDNQQKKDYEYTEDKIEFETQLDKEIQNHYLVYGLSYKHSDISNTNREFNSDPNTPDKVYVYTPDAKEQSFGLFLQDEIALLNDKLILTPGVRYDYFSTDPSDTSDESFKKFSDSAFTGRLGATYKVSQPGTVFAQVSQGFRAPSFDELYYTYDNPGHGYTNRPNPDLESEKSLSYELGYRHNTAASATEFALYYSDFTDFIDQTSTSNGGLTEYTFININEATVKGVELSNSLDWHAIASLPQGVTTRVAAAYTEGEDGNGNPLNSVNPWNAVAAVNYDSPNALWGTSLKVNYTAKKSDSDINSDGNNGGTKDQVALPSATVVDLTAYYKPMKDLTVRAGVMNLTNEEYYLWNDVRGETELSRDITQAERNYNISVKYEF

SEQ ID NO: 15717 - protein, 469 aa, Vibrio alginolyticus 12G01
MDKFFKVSALTAAMFGVVAVAPATASTESAAGGEYVEKVNEFMQDSSLNALFIVDTRSRTRTTGKPGGENGDRRSRLNYSSYNAILDFTSGYHDGWVGADVAAYYSGDLYNDSLYDSNEGYLCNEISTCNNLDWGAGDGQQLKVYKAALKFKANENFNARFGMLQAGGNGTIGNVWSFVPGTYRGFELNAKLGDFNLSYFGADQFTAPWLLHEDDYAPALWSDTSWSYLHSLGLNGNLTDSLFMQLGLGQATGVQYANGVDWGAGQVTSYHNETDNTSYKAYLKYTVSDRTTLAFDFYGVDDDVKYDGLGFHTGLSLNQSFGKLAWMSELRYTDTDNRADFVPRTIHTYGMNNGTWSQWWDALSDWNKAGELAWYNRLSYNQGNGWNYYLGFGYGTGADSAASGASGDWDYESEYAVNATVSYSLQSGALKGSTIRLHGTILERDEYAGAGDADETDLRLQVLIPYSFH

SEQ ID NO: 15718 - protein, 320 aa, Vibrio alginolyticus 12G01
MKKLAAVISASLLMASAAQAEVYVGGKMGKSWMEDACVAGQACDKDDSTLGAFVGYEMNKYFAVEAGFDNIGDFNQTSFGGHVEAITLAPKFSLPITEDIALYGKVGGAYVMFDGKDDYSYLGAAGLEFNLSQNVTARAEYQTLTDISNDVTRATGNTATLGVSFKFGGNDEPVIVEEPVVVEEVVVEEVVEEPVVVTKTFETQTIGTGSFDLNSTTLKPESAAKLDNLVAFLNEHPQANVEVVGYTDTSGPAAYNLKVSEKRAESVANALVEKGIDSSRIQARGEGENNPIASNDTREGRQQNRRVEIVVPEFEYQVQQ

SEQ ID NO: 15719 - protein, 373 aa, Vibrio alginolyticus 12G01
MSYLKKSLLATAITGMMFSGAAFADGANSDAAKEFLTKDSFSYEVYGIIAMQAAYRDYDSGNKATDDDLGGMQLNNESRIGFRGKKQFANFGPTFIWQIEGGYVDPSFGGEGAGLGERDTFVGFESASWGQVRLGRVLTPMYELVDWPASNPGLGDVYDWGGAIGGAKYQDRQSNTIRWDSPMYADKFSLDIAAGAGDKAGLGEGDDYWGGIAAHYKIGPIQLDAAYEGNRNIKMEGQTWENNTYLVGAQGWFDNGISFFAQYKYMEADASNGVSEKQDAMSAAIMYTTGDWQYKLAYAANFDLERDGKTINDTADDVLSAQVMYFVDPSAVLYVRARTLDFGDGAYQLDKPTEARWKSADYDEFSVGVEYYF

SEQ ID NO: 15720 - protein, 215 aa, Vibrio alginolyticus 12G01
MNKTLLALLVTCSVSVSAAPYVGLEYGLGTTDHDLEPHFSTDNVTLNPEIEDGIFSGFVGYAFNDNWALELGYSQFDLDDNRSKNLGIKQIDGKDYHHEMDWDASIKAKQVSLSPVFSYALNNKWTTKFKAGLTYTEYNAKVSKHQEYELVANDDVEMNNTLFHNTEKNNELGAMFSLGAEYRIFPQLTIGANAKYQLDSYANTASFNVGTTYYF

SEQ ID NO: 15721 - protein, 1105 aa, Vibrio alginolyticus 12G01
MKPKTSTLRTLCLLAFAGGLTVSAQQTTATLTGTVNDASGGAVPGVIVKAKNQETGIDRETVTNEQGAYTLPFLGAGDYTIEAMKTGFQSSKVSRLALQVGQTVRVDLALQIGAVNESINVTATGATLQTESVAVGTVIDGAKIVDLPLNGRNFVQLAQLIPGVQAGTPGSITVRRGRGSIGQADSSGGSTGLSANGSRDTANRFFLDGVEVMDYDAMTYSFSPSVDSLSEFKVETSTYSAESGGAPGGQVNMLTKHGGNSLHGTLWEFNRNSALTTTHDAIANTDVANAPLNRNQFGANISGPVWFPKVYNGKNKTFFFFNWESGYNAAGAVPSFRLVPTAAQRQGDLSGLKDNKGVAILLKDPLGAGLLPNNQIPKSLLSTQAAGHLSFTPLPNTINGAFNYLAPTFSALSRQKNFNGRVDHNFSGRNMVYGRFVYNDTFEAGLPVWGNDQRDNLGNTKNLSTGWTSTISNALVNDLHGGWHRFAETENFGTTNNKAFDVVGAMGLAGPSTNPKYYGPPTTSISGADGSFSLFNLQRDIGPRDRSNGIYQVVDTLSWQRGTHFLKIGTDIARRNVTFFQARNPRGSFGFDGTYTGSALADFLLGYVKTAGLNPAETSTNLWNNWQSYFINDDWKVTPHLSLTLGLRYDYFQPMKQVDDKFVNIEQNGFVPTGIVTPQTATYGRGLLKPNRKNFGPRIGLAWQPTFLKDSVVRAGYGIYYTPEISNAIFAMAEGGQATAGASLIGNLTGAPNLLYSNVFANIPTSGPNPYNFAVSNDQNLRDSYIQQWNLNIQKKLFAGIVLDAGYVGSKGTALIATLGDINRPIAIVDPRTPGLAALNARRPDQLFQRAVTGDKSIGNSIYHSLQVKAERRMARGVTFLTAYTWAKSISGPTDIGGQVGGGSFIGSVQDLYNLKSERAVSGFDQTQRFVTTVLYDVPLFKGAKGIKGTLLSGWQLSTIVTVQSGFPAPISFGVDTTGTGIGSRPDMLSGQSGALPGGDRTWQHWFNTAAFAQAPFGRFGTAPRTGDVRLPGSENTDFSFNKQFRLDEHKHLEFRTEFYNLFNHYNPDPATVDLNVRSLTFGSVGGGVRGITTRVIQLGAKLAF

SEQ ID NO: 15722 - protein, 343 aa, Vibrio alginolyticus 12G01
MKKTLLALAVVASATSVNAAEVFKSEEGSVDFYGQLRPTLLFLDSTDHTAELNTSSSRMGVNGVYVVNDNLKVLGEVEIGVALGDNYGAGADSSERTDDSVYVRRHIFGFDMGDMGTLRFGKEGTWADDIYGADYSYFFGGSALLYGHAWNNSSQIKYAYENDAFWLKAGYALGEKDQNEEIREVFVGKSFNDLSVHAGVLSSENKIASKGNNTENLSFEVTAEYALDEHTLGATYYYNENEDKAANETIDSHGISLAGMFAVAPKTTLYSGYELVMSSSDKSGKKDGDQSKFYAGVEYKFSKWARVFAEAGYNFDGDKLEAGKTTAETDSKTDFGVGARFYW

SEQ ID NO: 15723 - protein, 1033 aa, Vibrio alginolyticus 12G01
MKSNSFLRNRKALTALLLCTGFVATQPFSVMAEEIVTAVQTVQQQKQSVSGTIKDPAGEPVIGASILEKGTTNGTITDFDGNFTLNVAPGATLVISYIGYKNQEMKVIPGKSLNIILQEDTETLEEVVVVGYGVQKKSDVTGSVTSVGKERLGKLPVTNVLQAVQGAAAGVTITQTSSIPGDAPDALVRGQNSINANSGPYIVVDGVPISKSGGTLNDINPNDIESMEILKDASATAIYGTNGANGVILITTKRGTSGKPTIRYNGYFGVEDFSHKLDFCDGSQITQRYRDYVSQNPGETMYNDYVKNAYEAENQANGIENDWIDAVSQTGIIQDHNVSIGGGADNVKYYVSADYMSQKGVLKGFNYKRYSIRTNIDMSVTDYMKVGTNSYIVSHNRDGGRVNFLMAEAMSPYAKMYEEDGSYCINPMYSETLFTNPLMWTTTNPERRQWNININGYAEIDFEKLISPLKGLTYKFNGGYAYMPKRYNNYEGKSVNNQTGYAEIKNEETQSYTIENILAYNRDFGKHHLDLTALYAASRKKYQRSQAMASKFINDDQQWHNMGSAETPSVASYTDLYTTVSQMGRINYSYDSRYLFTFTVRRDGSSVFGDNNKYGVFPSVALGWNIARESFMESSSNWLNTLKLRASYGKAGNEAIGVYQSRVKMDSGMLALGGASNAGLWPNDLMGNADLTWETTKSFNVGLDFGLWNNRLTGNIDVYFSKTNDLLLKRNLPKVTGYNTVYSNMGETANKGVELTLNSRNIVSGDFTWSSNLVFSWNKNEIKDLYGDGQNDLGNRWFLGHPIGVIYDYTMVGIWQEDEIARGDHLNWDPIAEAGDVKLADISGPDGVPDGKIDDNDRTIKGQTTPKWIGGLTNTFTYKDFTLSIFIQTTQGLKKNNSLIGMAGDEMGRRNTTTEIGYWTPENKSNEWRSLRKNSNKHGYGFPCDASYTRIKDITLSYTFPQRMIQKMGIGGLQLYVSGRNLFTFTDWVGWDPEARQVARGNSSWDSTRGETVYDSSNYPMTKSCVFGVNLTF

SEQ ID NO: 15724 - protein, 186 aa, Vibrio alginolyticus 12G01
MKRLISCLTIICALNRSAAAETTSSPCSRWISLLKPVCQRIHQTWTEGHDDMYFSGYAWHNRYTYRPEKIKSYNEAAWGGGLGKSLFDEKGNWHGLYAIAFLDSHRHIEPAVGYAYLKTASVNKDIKAGLGYSVLVTSRVDYDNVPFPGALPWVALFYKRTTVAATYIPGSAGAGNVLYILGKISL

SEQ ID NO: 15725 - protein, 866 aa, Vibrio alginolyticus 12G01
MYKNTTALSVAISLALGTAAAVAPLTAQAEEQQVEKLQKMKVTGSRLTRASMEGSTPVAVIGRAEIERAGDVSIADVLRKSSFNSFGSHNERSGSSAQSQATISLRGLGSERTLVLINGKRLPGSASMGGGAANINVIPSAIVERVEVMADGGSAVYGSDAVAGVVNIILKEEFDGINVTLGSGIPSREGADEENVSIVLGTSGEKGNIMFSFEHDSKDEIYQRDRDYLSSTNTGSANYFDMSGVSIYGRNVYHDGQLKALKGYDTDASCDPSKGFVGLTNYPGLGDICGYDYTSEAAQTASLERNTVFMNGNIFLSDDTTFNAQVLLNRNESFGRFAPAAGYFEVDPTTTGGAAFFAENGLDATKGPAAVYYRFNNVGTRDNSVTDFQADLKAGLDGTLYTDSFGEVIWETGYHLNFSNSNETGTGYVFRSPAEQLANSGQFVNGEFSADATSQLSAGTGRETQMEMHQVYGGLQFDLAEVGNIVIPLYVGAEYTTYDYFDQYDPQSEAGNIIGSSGNSAGGDRETYAIYAESLIAFTDELEMNIAARYDHYSDFGDEISPKVSFRYQPLDNLMFRTGAGLGFRAPTLSDLYGADSFSSDYAKDYVFCSQNGISASECPETQYDVTRTSNEDLDAEKSVSFNFGISYSPIDDLDLTLDYYNISIDDVITLNTLQSMIDQERSSGVSNPNIVRENGRIKEATAGLQNLGTLDTSGLDLKIGYRYDFNVATIRYDFTGSYVLDYSSPEYVGGPVNNQVGRNGLPEYRFNTGVGVNFLEEHDIYLSADHIADQAQDVDDNYNKTGHISSQTTWNIAYNYLAPWDAKFTAGVRNLTDEDPAFESDGVTYDKDLYSIQGRVYFLKYSQNF

SEQ ID NO: 15726 - protein, 329 aa, Vibrio alginolyticus 12G01
MNKVAIAVAAVVAGSSALLNSAQAEMYIGGKVGMTTLDDACYLNSPCDDEAFGAGLHIGYDFTDFIGLEYGVDFLGDYKANFKSGASTVDTIDGNLTALTLAPKFNWHLNDSWNLFAKIGGAYMMSEDEKDFVATGSLGAEYSIDRNWSVRAEYQRYQDMSDDVWDDMDANFFGIGVNYKFAAAPVVAAVVTEEVVEPDPEPVLMSKVHKEEYGTGTFEFDSAKLTESVSERLDNFVSFLNEYPQAQVEITGYTDSSGPAAYNQKLSERRAQAVADYITGAGIDADRLTVKGMGEENPVADNSTREGREKNRRVEVVVPSFEYQEMVQP

SEQ ID NO: 15727 - protein, 3015 aa, Vibrio alginolyticus 12G01
MRLHLPPSLRSALLASLVSFSGIYSYSHAATSADFWQIPDFGGPDFTWTGAGEGDAVGTAGNWEGGSAPSRVDNKGPHLIFNGVDVTVTGTPPNTSDGGGISVTGNGSVSVGLGQWGGNVYVEKGSSLTTSFGTQLKNMEPEGHANIYVDGTLNMTTPGGNLNFDNGTGADNHYWHIGLDGMINLSNTTTITKNAKTWNVEVVVASAMEGLAVTNREMVDDALITRYFMSTGADLGASLDSLRIWKQTGDDAYEALTRVDSAGQLGAGNFLLVSNGSGMSVQYKGEGYDAETLVWNSNGTWSNTGTGWYKQGDGTKTDTSFLNGDAVIFTAAEGSKTVNFSGGLNVSSMTFETDYTLLPGEGATLFAQETVLSNGSSLTLGDGDHRFSGFESLVTGGENSSLMVYMKTEASSAGSVNLLEGSALQNLYVYGALRLGASSQSGSWMLGGASLHMMAGSTMVFGSDAGTSIGAGQTVIAEGSLNVYAQNVSDSNTYLWNLVGGESVSTGDTLTFNGTSNPTVAGNITYAGNIVSGAQTGSTVTFTGNIQAESFKVAHYYGRVHMADNELEVNKLWVGAGGGYDNSLYGALDLDSGNVTTAGQVRLAELGHGVLNVNQGSSLTVTGSNNTHSTSASFLLAHWAYSGELNLRGGSLTALQSSMHLSWDGTGIFNAASGTANLQGMDFWASGSGSFRGSFLLGGATSGDARVNIGSSGIANVAGAAVIKLGEGTLGALSNWGISYNPDFTASYIELLGTVNGTILDTLDANDHATGRTVTFSNGLKGDGKLVKVGDGVLVLNGTAQAPVPAEGETAAVPGFTGTVELREGGLTVKDSSVIGQGALLIGGGLTVNVTSADGYVLNAGSTLGSTGISGGTATLSAGLTLNGGTLSFSSLDSETAALTVNSISGSEATEVRLGLSSLETGISYALLSGAGLTESSFFTLGGAAAELYNGTFSVSNGTLYVNLSDKEGLLRWKSGTWNTESSNTSWSLDGTPSAYADGETVYFSNGDGVDKNVTIAGNVAPGRINVSGTDFIFTGDGSITGDTTLNLLDGASLTMNNANSYAGDTVLGDGSKLVVGNAGALGTSTVLLQGDSVLELTTGTWNGLGTRLNVNSSGTLKLSGNASGTTTAALTGVRYELGANTTLTLSAGTYGNTITGAGTLISAVGTNVLNGNVDITGEYRVLATNGTACTWTLGAGASVTAGSFIGRYEYNGTTTLNISRDAVMNITGTLRIARDGKGVMNIGSGGMVLAQTLDLGQNWDGVSAKGATINLNGGSLLLGSGGMTASGNTNTIALNMNSGTLGTTAAEGWSSAYNMSLTGNVTVDTRQYDAETKSYHDQASTGITLGGVFSGAGGLTKTGLGTLTLSGQNTYTGLTNVQAGTLAFTNTNAMALGSISMGAGARMTTASALTLNSGATLTFDMTGVVANEPVINITAGSLALTDSFCVLTINNYGELEASNYVLAQWAADGSLTTDSFTWTPDITREGFEYSVVVENNQLVLKVADVSGDNGFVWNGGTDRKWINTSVDGWTTRLTGADTLDNQEIYFSSAEAGEVKVSGIVTPKSVVFNSGAYTLVSDPDSEGAIADSTAPTTLTVNGTAEVALNLANTYTGGTILNGGTLTIGADGALGTEGDIIFNGGTLAYADSVAGEDATGYDISSRVNVGDGGFLNVSVLGAGDTVSWAGLSADVMGAGTTLTKTGAGTLALGYAGNTLAHLTVEEGTLAFTGGATIGVNPNNATIVRVSEGASLALSGGTVNLHAQLNGAGTVTIGTADTAGLVNISNTGNTNFTGRLELVGNGVNMNTNANWVAFGAGNTLGGGTVFIDGKGFHFSAGTTAANFEIGATHGAMQNGSSGATYTFSGNLSGSGTWAMAANVRMNNVLTGSLKDFSGTLSTNETSANNNRQAWNFGSGGVCATGEGNSVFGDGAILGGNTGSSDTGLAAQYNVNYNNTELVLNALVQGNSSLTHAGTGTLILDQANTATGALGITNAGAVVQLGTEDKAGQWAGTVLNGAGTLKIVNGALTSAMTRAEGATAAIVVDSAASVNLGGTDGSMLKGITLAAGGWLTNVSGDITVGAGATETLNLTLRADNINQDAAGAAIIDQGDGRLVINNPATVNLDIDAIVNTLVAHKEAGAESWLTLTTGTLECENLGDIQFSKILSNYGIRVTGTDGGSLVLSGQVSGLYMVDDSSTSDPDTVTNYGTLGMYSGVVISQDKTLTVQLAGAPGDSDGDGAVINNLLGATGSTLKVENTSADGGNAVVILNNERLETGLPAPDDYAGADSIMGGSIVGENGVTFVKQNTGNLTVNGSFVTDTLRVEGGSLALNGEGNSFNHVELAGAEEGSVLDINRNTVMGDLTDSGEGAALNIGSGASLSVNGASNLSSSTIQGSGTLTLRDTLEISGTASLQGGVLLDLAKDDDSTGTLDLGSTSGSTVSGIGGEGTLKSAGGVLTVNTGNSGGGSVFSGTLEGRGQLNISGNAGQTFENVMTAAGSSWAVNSTGLLNIRMGGTVDNPRANTALTLSSLTLGDGSSTNLTFNTDYAGPIISVTGNISISQGAEITLSSTGGNELTLDADGSYTLMHADGTIDLGGSDRLAILLDPSSSAFKKFENDAYLVMENGNLVLMATASKDNKYARLADTFNSRAGAELLWNLPGDLAADSILKKVDDAVGALTSSNPSEAKRTMAAVAGSTVNALGTAQRDALRDQMGWIRNRTTLMGVNPAYVNDDLPRFHMWMEGTGSYAKLDTRGDESGYQLTTWGGTVGMDADLSDRLTVGAAFTAGYGDLTAGAADSADGHLDSYYASLFGRYQDRRWAHTLILTGGWNDAKLNRTVNYGEGSYGTQGSTSGWGFGAMYELTYDVYLNENRSSVLQPLFNASVVTTRMDGYEETGAGNAGLNVGRQDWTTGTLALGGRWMGLVGSNIFGREALAEIRVNAAQDLGDRRGETNVSLLGNPGFAQSVRGAKEGTTALQLGAGLSVPVGTKGTIYVNGNADIRDGSSALNGSVGYRYDF

SEQ ID NO: 15728 - protein, 360 aa, Vibrio alginolyticus 12G01
MMKRSVLALAVTLSIVPTLSNAAEIYNKDGNKLDLYGRVAAKYIFTNHNNADDTYVRFGFKGETQINSQLTGFGQWEYNVAAKNAESQGDKGNKTRLGFAGLKFAEFGSFDYGRNYGVVYDALAYTDMLPEFGGDSIAYTDNYMTGRSTGLATYRNSDFFGLVKGLNVAAQYQGRNDDGDTTNNERAIQKANGDGYGLSVDYQDIEGSGVGFVAAYSNSNRTLGQKNLANSATGDKAQAWATALKYDANQVYIAAMYGETLNMTPYKALIANKTQNVELVAQYQFENGIRPSIAYVQSKGKDLDAVGSADLLKYAEIGVTYYINKNMFTYVDYQINLLDENNPLGLGTDDTVAVNLTYRF

SEQ ID NO: 15729 - protein, 673 aa, Vibrio alginolyticus 12G01
MKMTRLYPLALGGLLLPTIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 15730 - protein, 668 aa, Vibrio alginolyticus 12G01
MESPACSSIKLSSLCLAVGMALSTPVLAQDTESHFEEVVVWGTKVSSNTESMFADDMSLKQADHMSDLLRDIPGVDVGGTHSVNQRITIRGLSETDLDIRLDGASQHASMFHHIGNLTLNPDILKSADIQVGNNSVTQNGLGGSVYFETKDARDLLRYDETFGARVYGGYASNDNQQGSLTLYGLLSENIDAMVYGHYVTRDDFEDGDGNKTYGAAGDVYNILAKLGYELNDIHRFELSYDMYRDSGDYSPRPDMSGSANNGLSSTLLIPTDYDRDTVTLSYELRGEQHKGNVTLYNTETEIKRDESVMAPRWPSNRLSKNTAKNQNFGLNGKFQSDVMLGEFDNRITYGFDYMDKTSSSYYGSRKFMDESAISTALFVEDQFFFSDAFFVTAGMRFDDYKREAETGTSNYDDVTWALAVEWAVTQDWTLFASARSLFKGPELMETFIAYQDVAFLEDGLKPETGLNTQGGVRFDKTFDKHFFGANITAFQTEIDDYIADQYQNATQTYLIYNLGDVEIKGFEASASYGYDKFNSKLSYSKSDTKNKNTGGPVAGGNGRSIDMGDSIALTLDYQSDALETIFGWNSMFVLEEDNVFDGQPKKASYDVHNLYAQWVPSNIDGLSVTFGIDNVFDELYSSHASRSGTARGFTLDDYEPGRNFKLSAAYQF

SEQ ID NO: 15731 - protein, 703 aa, Vibrio alginolyticus 12G01
MQRPVRSTVTHGFRAATGVALSLAAPYTLACQGWGAADLEIRNGTTLTSPTTIVNTCTGGDYLSATISGPGSQWDLTGALYIGAMAATGEVLIENGGKVTTPSVTMGLGPTGTPGTGTLNLSGNNIARGILETAYVETGAGGAGIINFDGGILRASASEANFLRNFGPTDIKLLSGGAYIDSNGFNIGITTPSLLQGVGGLTKLSAGTLSIAGDNSYGGNTTVAAGTLRFDSYTQGAGQVLGIGASSINNYGKLAVNNTATFAADARIAVDVASVNTLAVNQTLNAVISAGTLNASTFNVSDNSALFNFQAIRNGNDVDLRIVANSNQGTGIRDAVIGQGTWSALDAARVLDTQLNNGVTGDMGNVINAFGQLPGNREVARATAQTLPLASGHQAIQGTLGTFQNLIQNRIGGNSGLSSGDTLKDKQIWGRAFGSRADQDDRKGSAGFSADSWGLGFGADAEVAAGNRVGLAYGYAKTSVNGNTDLAGTAQDSNISSHLFSAYGSKELSQERSLSWQADLGVSDNDSMRQLSFGGLNRSARADYRTYSAHVGAALTQRFALSETTSLMPALRADYTWLKSQSYSETGADALNLNVASQKTDALVLGADLHLLHSLSSTSRIEVNLGVGYDAINKSGNIVAAYAGAPGLSFVSNGIDHSPWLLRGGIGYTHRTGNGTEVSLRYDAESRSDYLNQSASVRAKWAF

SEQ ID NO: 15732 - protein, 183 aa, Vibrio alginolyticus 12G01
MRYSFISTLILTIFSLSANATTNKHIIGTNIGYGGVNYGAPTSEESGDMFLGEIYYRYMTMHNFGIEAGYKGAIDGIGSAIVNQISQISDASFSGLRLSGYGSYPLSSGFELYGKAGVTYYTLEYTYKVNDQTKNIDHATIGGEVAGGIGWSYRYFGLNVEYVYSKNSDFDSSGLMFGAQFRF

SEQ ID NO: 15733 - protein, 326 aa, Vibrio alginolyticus 12G01
MKKIAIAVATVLAGGVISNVALADTYMGGKVGYNSLNDACYLNEPCDDDSFAASMHLGYSFNEYVAAEYGVDYLGDFTANFKKPGLNTVDGDLWALTLAPKFNLPLTDSWNLFAKVGAAYMMAGDEKDFVPTGSLGAEYKINYNWSLRAEYQRYQDMSDDVIEDMDSDFFGIGFNYKFGSEPVVQEEVVEEVVETRPATRIVEHVYPAQTTATVQFDLESAEVKDASTLSGTVDLMNTYPQAQVEITGYSDTTGSAAYNQQLTEKRAKAVADEFQAKGIAAERMTVKGMGEANPVASNETRQGRQMNRRVEVVVPAFEYQTTEKAE

SEQ ID NO: 15734 - protein, 809 aa, Vibrio alginolyticus 12G01
MTRPVPPAALRRLAPTLLAACLCAALPATAQTAASAPVELHLPAGPLQASLTTLARQSGIQLLFAADSVSGRNAPALDGRYTPHDALQRLLAGQGLAMQERSPGVFVVNAAPASPKPRAPARAASSAASPATTTSLARVTVSASTARMPQGETAMPNTITVLTREDIAQQLALGSDVSRVLSAQIPAFAPAREKMSNYGETMRGRGILYMVDGVPQSTPLRDGSRDSHTIDPAMIERIEVIHGANALQGIGGTGGIVNIITRSAPSEPGAFLLDTNISYSSALPSRRDDNGQRGSALVGVRGEQFDLVAGLAYEKQGLYHDGEGRSIGTNAQGELMDSTSSNVFAKLGWNIAEGHRLQLMANRYELRGLDNYLAVNGDYRTGRPTISVPGDTPLEPPMNRSRSLTLDYSAADLLGGRFQAQAFAVDFEGRYGASQWDPWGNTGANAAWDQTQNESDKRGFKLTQSWARIADTTLDVTLGLDGLRDRTHQVLLASGMNWVPQTTYQSLSPLLQLHWWPTDHLMLSGGLRYEKGELEVGDYTTLPRYGARKVAGGKPTMSETLPNFGAVWYINDRLNAYASYSEGYTVADVGRVLRAINRDGQRVDNLIDLSPVVSDNREIGLEYDDGRFSGDIAYYTSESKLGSVLIYDPGIDAYAVQRQATRVEGFESNLRLHLGDSRLGLGYARANGRYDANVDGRLDSDLAGVNIAPNRLTAFWEQSWTPQLSTRLQASHAFDRDFDLRGARVAEFKGYTTLDLVARYVLDKHSFTLGVQNLANKQYISYYSQTTPSNPSYFSGRGRVLTLGWQYRY

SEQ ID NO: 15735 - protein, 160 aa, Vibrio alginolyticus 12G01
MMKKTLLAVALLGASSAAMADSWIYGGATVGQSDYKGETDTSYSVHVGTGILPIIGIEAGVTQHGEFNVNGQDTKLTSYYAALKPSIDFGPLHVYAKGGIHQWDKKVKGGKDDDDFDLMYGVGAEYFIFGPMSVGASYMNYTAGKDDIGTFSVNATLHFL
